United States Patent 10,858,650 (METHODS FOR MODULATING ATRX-DEPENDENT GENE REPRESSION) - sequence listing, part 3

SEQ ID NO: 4665 - DNA, 1600 bp, mus musculus
ccttggccctctggtgtttaagagcattacaaattcttttaggtgaaagaagaagaattcagagtagcagtcagcacacaggaacctaatgagatttttttttaattaacttatttcttattatatattttcttcatctacatttcaaatgctattcccaaagctccctatactctccctgccccctgctctccaacccacccactcctgcttcctgcgagacagggtttctctgtgtagccctggctgtcctggaactcactctgtagaccaggctggcctcaaactcagaaatccgcctgcctctgcctcccaagtgctgggattaaaggcatgcgccaccactacctggtgagatgtttttgttatacatttttataacaaaaaatacatatttcgatgtgtaaattctgacaagaaggggttttttttccacaattcacctttaaaagttgcttagccagtatgacttccaaaatcactcctattttttttaattattccttccattcgtttatatcttaaatgatatcccctcccttcccagttacccaaccacacccacatctgccctttcccccatcccctttgtttctatgagggtcccccctcccacccactccagtcccaccgctccagcatccccctacactggggcatcaaacctctacaggaccaaggacctcccctcctattgatgtcagacacggcaatcctctgctacctatgtgtctggagccatggagccctccttgtactctccttggttggtggtctagtccctgggagcactgggtggtccggccaggctatgttgttcttcctatgcagtcgcgatcgccttctgctcctccagtccttctgccagctcccactccgaggtccacaatctcagtctgatgcttggccccaagcatctgcatctgcattggtcaggtgttggcagaaccttccagcaaacagccacaccagtgtcctgttagcaagcacctcttggaaagagcaacagtgtcagggtttgatgtctgcagacaggatggattccccaagtggtgtggttcccagatggcccttccttcagtttctgctccatttttttgtccctgtctttcttttggacaagaacatttctgggttaaaaacattgagatggctggctggccccatcccttgactggggaccttttctctctactggagatggtctctacaagttctatctctcctatgctaaagtcatccctgttgggttctaggaatctcttgcttccctgttgtctgggaccctccagtggctaccccagttcctcatcccccactgttacatatttttattcaattttctgacaagtcactcttttaataagaccaagtttgattttctccttttaacatggtcctgggttaaagagaactgaaaatgaagatttggatagttaactatgagtagaacagaattactaattcacaatgcagagtaaggaaaaaaaaaaaacccagaagatttgtgttgatcatttccttcaaaacttaagctacaagccacgtttttgtgttttattttaaaatctatctaaacagttagaaactattataagac

SEQ ID NO: 4666 - DNA, 1000 bp, mus musculus
atttcaaatgttatcccctttccaggtctcccctccaaaaacctgctatcccctccctgctccccctgctcaccaacttacccgctcctgtttcctggccctggcattcccctacactggggcataaaacagtcacaggaccaagggtctctcctcccattgatgaccgactagggcatcctctgctacatagacagctagagtcatgaattccaccatgtgttttcttcggtaggtggtttattccccagtgagctctgggggtacaggttagttcatattgttgttcctcttttggggctgcaaaccccttcagattcttgggtcctttctctagctccttcattgtgcaccctgtgctccaccatcattctataatgagtagtgggagttgggccaagctcagaatatagagtaatgagaactttgacctcttgaggtccacattccccaaatacctgtttttcatgcaatcttatacttgtctcaattctttcattacatgatattagaacttttaataaacctaactaagatgtgttcaccaatcatatttgaaagacttttctaggccatggctttctggcctcctggtgtgaagaaaattggtgagcaccccatgtgtacctccctaaaaagcaaaataaaaaaatgtaatgctggctatctcactgtatctctattcatagtgtgtgtgtgtgtgtgtgtgtgtgtgtgatttgtttaaaaatcaggtaactgtgggtatcactaggatataaaatatgttgtataaaaaaaatgcaagatacttgtccacacccctttgctaatgacttttaaagccttcccagcctgaatagcccagaaaaatcccttcatcaactgctgtgcaaccttagctatttgaaattcagtcatgatgtccgtaaccccagttcacaagcctggtgagctgtgaagtagaggctacaataaggctgaagcaccgatgatttctcagtcttgatcactttggatg

SEQ ID NO: 4667 - DNA, 1000 bp, mus musculus
gagagatcccatctgaaaatcctgcccccactctcattggcacatcaagttactacaggattaggcacattttcacccactgaggctagacaaggtggcctagctagggaaactggattcaagcaggcaacagattcagggatagtcctcactcgagttcttggagacctgcatgaagaccaagctgcatatttgctacacatattgaaggtcatagttccaggccatgctcactctttggttggtggctcactctctgggagcccccagagttcaggttagttgatcttcttgtggagtccctgttctcttcatgtccttcaattatttctccccaactctcccataagagtccctgagctccatctaatgtttggccttggctggctgaatctctttccattgattgcagggtggagactctcagagggcagttctgctaggctcctgtctgcaagcatgagagtattatgaagagtgtcagggattggttcttgcccatggggtagacctcaatttgggcctgttgttggttagacattccctcagtctctgttctacctttatccctgcacatcttgtaggcaggacacactttatgtctaaaaatttgggggtgcattgctgtgcttatccttcaaatgggggttttgtctgatccatatcctccactgctaggagtcacaactaaagttgccctcatagtcaccctgaagcctaccctatccaaggtcttgggcacatcatagtgattgcccccaccccactgcccatttctgttctttcttccctgctctctgtacacctaacttccaccacccactcccccactcctctcctctccctcccagctcactaccttgaactaccttcaatatcaattttctttccccttctgacaaggatttgatcatcctcactcaggccctctttgttatttgcatttttggggggtctgtgaatagtcatagcttgatcataatcacccctttcctaattt

SEQ ID NO: 4668 - DNA, 1200 bp, mus musculus
tatttctgagaaggagagaacaaaacacccatggaaggagttacagagacaaagtatggagtagagactgaggatattgccatttagagattgactcacctggggatccatcccatttacagtcaccaaactcagacactgttgtagatgccaacaaatgcttgctgacaggagcctgatatagatctttcctgataggctctgccagtgccttacaaatacagaagtggatgctcacaaccatccattggaatgagtataacgtccccaaggaaggagctagagaaaggacctacagtgctgaaggggtttgcagccccataggaggaacaacaatatgaattagccagtacccccagagctcccagggactaaaccactagccaaagagcacacatggtgggactcatggctctagctgcatatgcagcagacattgcctagtgggacatcagtgggaggagaggccctttgtcctatgaaggctctatgccatagtacaggaggtggggggaatgccagggccaggaaaggggcgtgggtgggttgctgagcaggaggaggagggaggtggaagggggaaggtgtttttctgagggaaaaccaggaaagggaataacatttgaaatgtaaataaagaaaatatccaataaaaaaaggtgttaacttgtgaatactggaggggagtgtgggctagccacagggaggtttggaagtgcccaaccattgagctagttatggcatattaaaatataaacgttgcttgtgtgtgtgcttcatttgtgaatccagagctcttggccaggtgtagagccaagcatggatccttgagagcatagaatggactttgaatatttcttgctacatactcaggggcagggctgacatgcagtagaaaaatactgtgaacaatatagcttctttgaaaggcagcttacaaaatttctcacaaattcaaatacttattttaccttattaccgtgcttctcagaccattcatatggtgcttatgcttctcggttttgactcgaaagaatggaaattcacccaaaattgctttaaggaggctatattcattatttccaatacttagtacctagtaaattgtacttcaagtggtgcatgtataaaaagactttgagatacatttagataaggttttgtcagggtcaaaattaaatcaactatgaaaacataaaa

SEQ ID NO: 4669 - DNA, 1000 bp, mus musculus
cttcacaggaccaaaggcctctcctcccattgatgaccaactaggctatccccatgaagctgatttaaaaagacttttaaagattgtattgcttaaaattcaatcaattttcataatgacaaaaaatcaaaatgaagaaaccttccattaaaaaaaatcatcatgtatgtatgtcccccagagactcatttatttgaatgcttggctcatcgggcgtggcactattacaaggtgagacctccttggagtgggtgtggccttgttggaggaactgcatcactgtgaaagcagactttgaggtctcagatatgctcaaggctagccagcaccacagagtttctcctttctgcttgctgatcaagatgtagacctctaggcttcatctcttgagccctggtggcatataggctgtcttgcttcccaccatgatgacaatggactaaccctgttaagctactctcaatatcttcctttctaagtgttgctgtggtcttgatgttccttcacagcaagaaaacccaaactaagacataatgagaacaaaaattccaaagtttgcactaatcattgtctcataagccaacctctctgtaagaaaatctacaaatactaagaaaagggaaagaaaaaagaagaagaaagaaagaaaggggtttgaggaggaaacatttgctgtctcagcaccttatgtttctagagaattacttccactgagagaagttatattttaaaggaacttttttccctcggcttttatttttaaatgtgagtatttttgtacctgtgaatttgcacgtcccttgaaaatgattaaaacttgtaaatgtaacctgatcatattaatttggatgtgtgttctctcctctctctctctgaccttccctcccacccattaggcatccctttacttgactcaacatgtctatatcccataagaaaaagggtggatctagaatcttactgtttgatgaatatgacacccatcaatgcaaagtgctgg

SEQ ID NO: 4670 - DNA, 1400 bp, mus musculus
tgtgcctcttctggtagataagatctgtgaagttttatcaaattattttgtagctactcatttccaaagaactcctaagaagaccaacagtagacataagcacttaattattaagaagttcaaaaaaaaaataaagacagaatattaaaagcaaaaaaaaaaaagaagttcatataatagtggaaattacttttaaaagtatttgacaagcatttcagtttttcatcaagtataaataagtgtgtattcatagtttcagttctttaggatattttttaaattttaaactttttattgattctctgtttcacatcatgctccccagtcttgttcatctctccataccctcatactcaccctttgtccttgaactacccccccccaaataaaatacaaacaaacaaatgaacacaaagcatagaaaacatctcattgtggaagctgaagtatgtcacagtgtgtcgcacactatacccctctgtccacatatctccagttgcaaatgttcattgcagcaaattattggtctggtttgagatctctggcttctgtgatatcatcaaaattggatccccacctgaactccttctggttatcctgttgttaccctgtgtcatggagatgctgtagctttggaacagaaggactggacctttcatgtattccaatggttcggagatgatattgattttggggtgggccaattcagagctctgtatctgggtctgggttttagctgtactggttagctcaccacctctcccttaacagtaccaccagggcaagttctgcaacactgctgtgacagggccattggtaggaggcagggtcatctctcccgctctcacacaatcagggccagcttgcctgcactcaggcttctagagtcagctccactgtgctgcataatcaacttacaggactctccctcccaagccctgcagtctctggattggctcactcatctcagttcttaaaacagtgtaattgttgtgagtctgggtttccttgttacaattctagtccacttttctcccacaaactattctcatatgttctttcttttttggggggggcgggttacatacaatgaaaaccaaaagaactttggaaactaaataaatgcaatattttccttatctttggttctttttattctgttacagttgtccatatttaataccacagtactttttagctacatttcatttaatgaaaatttccaaagagtaagtataatctataaagaaaacatttttataatttattttagttgtctaaatagtatagtgtatactgatcataaataataacaccacagtgagaaatttgctttccaacaaacacagccatgtcatgggtgataaacaatttcaccatagaataaagaggatatacaa

SEQ ID NO: 4671 - DNA, 1000 bp, mus musculus
tcacattcaaaaaataaatttgaaagattgcacaaataagctatgtaattccttatttcctgctaatatgcaaaaatgtatttatgataattacacacgtactgtgtgccagagctgaaacaatacattcctcataatggagcataaataaagaaggtggagccagctgctcttaaactgtttctttgcaagcagtaatgctatagagaatataccttttccctctgttagtctggcaatgctgaacctgttgctgcattagacgagttgcgttttcctgggtaggggaaggagggctgtctgctgtctggtaggagggctttgtctgtgcctttctctctctctctttctgtttttctttctctctctccttctctttctctctcactggcttgcttgctctgtctctgtctttctctctctctctctgccccccttcccctccctctctcttgctctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattatgagaagagaaactcagcgctggggaagaaggtaggggcagacaactttcataaaaacaaccctgcctcctcagtccccttgcatttatcatcttatttactccacagtgcttttaggctttctttcctgaattttaatttctgtatctaaatttgacagagctaatgctagtttgaattttggaacatctataggaggcctaccctgtactaattttcttaattatttaagggtgtgaccttgtgattcagttttattagtttaaaaataattacaaacaaacctatttttcttactaaagtaatgagtaaatcagaatcgttcactcttttaaaacaaactcctccgtatgtttgtctctttgcttttctcgtctgtttatgcaattccatctgt

SEQ ID NO: 4672 - DNA, 1400 bp, mus musculus
gctcctgttaaagtgatgacatggctgactttagtcacaagtgattgtgacagataagtttgtcgagttatcaccacttagcacacttgtatccatcagggatgatttatgtcagtgtccaagcaatgtgaggatttatggtgcaagatgtgcgtagcccacatgctcgaacctttactttagaagatgaataacatatttaattctgatagtttgaacatacagaaataaagaaatgtgagacaaatctactattgctgtaatacttccattagtcaagcattgttctagtgtaacttcatataagttactgtggatagacctaactcacaaggtttctttttctcgtcctttctctctgtgtatccagttaacactacaatgtctgtacagatggataaaaaggctctgctctgctgcttttctagtccactgataaatgcagtattaatcacatggataataaaacacagacacctgccttcctgcacaatagcatacaacctagataaaaagaccaatgaaaccagctgcttgggcaggaacatcacctgggcctccacacctgaccacagtcctgaacttcagatcagtgcagtggccctccagcatgaggggacttacacatgtgagatagtaacacctgaagggaatttagaaaaagtctatgacctccaagtgctgggtaagtgacaatgtcacatattgtgctatttcacattaccaattttagttagaaaaaatgtccttgtgattgtgacaagactgaagctctatttccttcccatctctccagtgccccctgaggtaacctactttccagggaaaaacagaactgcagtctgtgaggcaatggcaggcaagcctgctgcacagatctcttggactccagatggggactgtgtcactaagagtgagtcacacagcaatggcactgtgactgtcaggagcacgtgccactgggagcagaacaatgtgtctgttgtgtcctgcttagtctctcattcgactggtaatcagtctctgtccatagaactgagtcaaggtgagtacttttgtaaaaagaaggaataattgatatttaccttattcttccatgaaagataaaggttttaccttcattctttgtgtgacaaatagagtagacaaatctgtttaggggaagaaggagtaaattcaggacaaagaatgaagcagaaaacatgaagctgttttctagctcagcagactcctgctaacctgtgtcacctggacagcggtggtgctgcccatactgtgttggcctctaaggtggctctaagctctgtgaagttgagagttaactaggaaaagaaacccacttcagcacttataacaagtttttgttatcacttgcacttcttatcaactagctataaatt

SEQ ID NO: 4673 - DNA, 1000 bp, mus musculus
gtttacatcatctaagaatatccctcttaattaaaaacttttgaaaatgtcatacacatatgccacatatattgatttgacttcccttccatacctcgctttaatttcccaccctactccaggacccttcaacctgtctttatcccaaattcacgtcttcactgtcatctttattattaataaccctgaatccagttagtactggccatacttgaatagatgtaggccaccctctggggcatgggcatcctgttaactggccataagaaatgtaaccgtctcacaccagtcagtaactgaatagctctgctgaaaggatcgaggccgtagaccttccctagcctcactcaagtttccactgacttgacattgtgcctgtcttgtgtaagcaaacatagaaattacgaggtgattttacgaggcgtcagccatgtcatatctaaaagacagcatttcacagctatacttagcatcttccaggttttaacattcttttcttccatgatgtctccagagccttggttgggggtggttggtatagatgactcacagctgagcattcagtctcttgttctctccattaacagctgcccagtgtaagaagtttctttgaccaaggttcaaagcagcatatatctatgggtctaaacataaatattagttaggaggcttgactacttaactatttactgaaagactgtcagtaagttaccttgcacacccaaggcctgtgatctttccccactcatgggcttttaaccaggtttagtgtatcagacctcaaacccagctagaaagcttgtttctccccctaatgccattgtcatgtcagtgagtacagtgctcctggcaggttagtagtgtagcaagtccatggatgccctttctctggcagtagcaagcctttccaatactatgaaacctagctagcggggagaaggtgtcctggtcagtttgagattagtttctcagtgtatggaaaccagagtgtgctgtcttc

SEQ ID NO: 4674 - DNA, 1000 bp, mus musculus
gaccttccaggcctgattgcactgatggtagagagaataagaaggggtggattctgtggaagccttgctggggaatgaggaatgagccacctggacctctagctgaggcctattgggtccagacaagagcagtcagcaggattgcctagatctggatgagagccatccttgtctaaggaagtgggatgtccctggagcagaagggctgaagggtctttgtaggggaagggcttggaagacatgttctttcagaggtcacagtagggacagacatgctgtaattattcctgttgactgaaggccaggaaatgatgaggactgtggagcacacagcagcattcttgatttctatccagggaatcatttgttctggtaaagaggtcaactttttggtgcttctgtccctgtgttttctgtctatagaggcgtcaattatcttgactcaaagagaccatgcatttgcatctctgaaccccattctagatatcatatttagataaaagcttttctttttcttttactgctgcagttctggtgtccttattctaggagaagtgaaacattgtggatcatcacattccttctagaagtagctgcaaagtgctggggcttagtcaaatgatatagagtgcctaaatcaccagtttagtgagaaccttactggttctggaccaatcaagatgaacactgaaggactctcatacactctcattcattgattgggtttaaaagtgagttcctggcctggggatatggctcagtagatgctgtgtaagcttgaggacccgagtttccaaagccaggctcagtaacatgtctgtacttccagtgttcctgctgaaagatggcagaccaatactcagagcctcatgagtagactagcctgacctatgcaatgacaaacagcataaaagaggggggaacttgaccaagaagatagtgaggactgactcttgtcagtcttcttctgatcatgaggcacagcaggttcaaacccaca

SEQ ID NO: 4675 - DNA, 1000 bp, mus musculus
atggatcagagattaagggaatgacctaccttgagactcattctatgggccagaaccaatcattattgatactctggtatacttgctgacaggagcatgtgctcctctgagaggctcaacctgttaactgagtcaagacagatccagacacccacagccaaacagagcacggagcttggctactcttatgaaagaataggaggaaggattacaggctctgtcggggataggaactccacaggaagaccagcagagtcaactaacctggacccttggggctttcagagactgatccaccaagcaaagaacatttacagactagatctgggcatccacacacatattagccattgtgcagcttggtctccatgtgggtcctgaaaaactataccaagggtgggaggctatcccaaaagctgttgcctgtctgagggatatgttcttctccctgggctgccttgtctagcctcagttggagaggaagtgccagcctagcaaagactttatgtgctaaagttaaaggatacccagggaggtccctaccccatcagaagagaagggaaggggggatggcagaaaaggattgtgggagggaaacgataggagagggcagtgaatgggatataaagtaaataaaaatatttaattaagtaagtaaaaacgtcaaacgctgtataaaagcatccaaagagaaccttctggaagtataatttagatggtgctgacacactctggctacaggccatgctagagtccactaatgtcagttaagccatccacaagccacatgctgactgagctatcacagtggaaatgtgtctagcttatgcactaaagaacaagctgaagctccatagcactgtcagcgcttgccagtcactactgtcctgaacaattatgtgacttgccttagaacagtgaaacatttgtaagtaataattaagggaaaataaatgtttaatctgtagcccttttaactttctgatgtttttagttttta

SEQ ID NO: 4676 - DNA, 1200 bp, mus musculus
ggagacaaagtgcagagcagagtctgaaggaaagaccattcaaagactgtcccacttggggattcatcccacatacagtcaccaaactctgacactattgtggatgctaagaaattcttgctgaaaggagcctgatatagctgtctcctgagaggccctgccacaacattacaaatacagaggcagatgctcacgactgaggacagagtccccaatggaggagttagagaaagcactgaaggagctgaagaagtttgcaacaccataggaagaacaacagtatcaaccaaccagacctcccagacctcccaggaactaagccaccaaacaaggagtatacatggctccagctgcatggcatccaggtagcagaggatggtcttgtcaggcatcaatgggaggagaggtcgttggtcctatgaatgctcaatagatgccccagtgtaggggattcaatgtgaggagccgccctcacatttgccattataagatggccctgacagctgtgttctaagtggtaaacataatctgcacacgtgcaggggcagttttcccgccatgtgttctgcctttcccgtgatgacaactgggccgatgggctgcagccaatcagggagtaacacgtcctaggtggaggataattctccttaaaagggacggggttctggcactccctctcttcgtctcttgctctcttgctcttgctcctgaagatgtaagcaataaagcttttgccgcagaagattctggtttgctgcgtctttcctggccggtcatgagaacgcgtgtaagagttggtgccggaaacccgggaagaaaaactcgggacgggagttaaccatcaccggcgcaaggaagattcctcattccggaaccagaactgcgggtcacggtaatgaaggttcccgtaaaacagactgttgagaaggattcaactgcgtgaattcagaactcttcagctggggaacagggtacccgtaagtatagctttacaaggtaagtctgatcttgaactttctaactaaattcaagacagtctatcagaagtaaagtgggaaatagctttacaaggtaagtctggtcttgaactttctaacgaaattcaagacagtctatcagaagtaaagtgggaaatagctttacaaggtatgtttggccttgaactttgtctagtgttagaagcccttttgttccttttca

SEQ ID NO: 4677 - DNA, 1400 bp, mus musculus
ggtctagtatgtttttgttcatttccatcacctgtttggatgtgttttcctgtttttctataaagacttctacctgtttggttgtgttttcctgtttttctttaaggacttgtaactctttagcagtgttctcctgtatttctttaagtgagttattaaagtccttcttgatgtcctctaccatcatcatgagatatgcttttaaatccaggtctagatttcaggtgtgttgaggtgccctggactgggcgaagtgggagtgctgggttctgatgatggtgagtggtcttggtttctgttagttagattcttacatttacctttcaccatctagcaatctctggcgttagttgttatagttgtctctgtttagagactgttcctctagtgattttgttaccctctatcagcagacctgaaagactagctctctcctctgcgtttcagtggtcagagcagtctctgcaggcaagctctcctctttcagggaaggtgcacagttatctggcgtttggacctcctcctgcccgaagataaatgcccaaaacagtatctttccaagaagctgtgttgctttggcctgtcacagaagctgttgtttcagtagtccacactctcacctctttagactactttccttggagtcctgaaaccaagacggctcccgcagatcctgaggcaaaggcctcccaggttgggtgtacacctgtcctctggccaggaagatggctggtgtctggagccgaaaatggcgccgcctcaggagctctgtggctcttgtctgtcccagaagctgctagcgtctgtagtccacactctcacttgcagactgcccgccgtggagtcccggaacaaaagtggctaccgcggaacctgaggcagaagcctcccaggccgggcagacacctgtcctctggccccgaaggtggctggttgtctggagccgaaaatggcgctgcctcagcctattttcttttaagataaatttatacagagtttgttcaaatcctatgggaaattttgctcacatttcagaactaaaataggtaaaatttactgactcctaagcacagagcgaaaataattgcctgctatgaacaagtattaaattaaagatgtctgtgtcttcaggtagagaatgtaactattagaccatattttaaagtctacaggaaactcttggtctttgttgttgggctccacaggaatattgggttaaaatcctggtttgactagctgcctgcttcatattaataagtagtaatagaagtgtaattaaattgttttcatatttataagaagagaatacagattttcaaaatattttttggggggtatgtgtgtgtatgtgttattattccactggaagagaggacagtatacaagcttttcacattgcc

SEQ ID NO: 4678 - DNA, 1200 bp, mus musculus
ctttattccttctacttccatttttagatcctggatggttttgttcaattctttcatctgtttgtttgttttttcctgtaattctttaagggatatttgtttcctctttaagggtgtctaccggtttagctgtggactcctctattttgttaagggagttatttatgtccttaaaatccgctatcagcaccatgagatgtgattttaaatattaaaaaccttacttttctggtgtgttggggtatccaggacttgtggtggtgggagaacggggttctgttgatgccacgtagccttggtttctgttggtaagattctaatgcttgcctttcaccatcttgttatctctggtgttagatggccttgctgtctctagctggaatttgtcctcctgtctgtctgtaagcctgtgtcaacactcctgggaaatcagctctcttctggctgtacagagggctgtggaagagcccaagctcctggtgcagatggtgtaccagaagaatctggtcccagctgttccacttttcctttggcccatgtgcttctttccagtcccgccttggacaggttgtttttggagagaaaaaggctatctcacctctgagcctgggagtaaaagcattcctgggagaatagatctctcctggtgggtctaatgcacagagggctatggaatagcctcagctcctgggtacacatctaaatttatattctttctttccatgtgactgtgtatgtgtgtgtatgtgtgtatgtgtgttgtatgtgtgtgcattcgcatgcagaggcatgattgctcttctctgtattcttgttgtgtggatacatatgtatgtgcaggtgcatgataacatgtgtggaggcccaaatttaatctggcgtgttgtccttgattgttttgtcattttttaaaattaattaattaattaattaaattacatttcaaatgttttctcccttcccagtttcccctccacaaatcccccttacctcccccctccagcttcattgtgtcaggattttgctcagtgcttctcaactctggctcgtctagctgcccatcttgttccaaggatcctctgccttttcctttcaaatactttgattacaaaattccacatctgactagattttgagtgatgtctaggcctctgaactctgtttgtgggacatggacttttatcagtgagccctctcacc

SEQ ID NO: 4679 - DNA, 1000 bp, mus musculus
aaacaggcaggagccttgaaaatgtaggtattatttcctaagaagagggcatgagatgagagctgtacccaagctgtatgaataggatttgggctgagcccagagcatttctttctctgttctaactctcctagggtgaagactgaaagtgtctacaactttcaagcctcaggctgctaacctaggcctagaatgtttcagcctgaaacttactgctgaatgaagtctctttctagctctttctgaactctggctggatgttttcactcagcagttctgactcaaactcctctccaagctgattgattcaatttagcttctcgctgaattgctctgcttggaaaaaccaactctgaactcgacacactcaactccactgcactgtgctcattacactgactcccaactgactgtctcaactgcccagaacttcactgaccttaataaagttgctgttctcctgagatataggtatcccatcctgtcaaatctttctctagtccatcactttgtctattcctcaattagatgtcatcatttggggttaaaggtgtatggcaagggccttctgtattccagccagatcacagagacctagaaggtctctggatgtgatcagagcagtcatgttgctggattaaaattcctcaacagaacctgaaggcaggaactgatacagaggccacagagcagtgctgctcacaggtttgcgtatcatgacttagccttctttcttatagaatccagtaccaatggtctgggtcctccctcatgaaccactaattaagaaaatgcccttacaaccaaatcttgtagaagcactttctcagttgaggttccctcttttcagataactagcttgtgtctaggtgaaataaaactagccagcacctacacatatataatagcatacaccctaagtttacatctaggtctcacatataaaagatgtggtatataggtctttattcatccatttatactactttacatagtgatt

SEQ ID NO: 4680 - DNA, 1000 bp, mus musculus
atatttgacacatttaataactatgcccttacatacaaaactttccaagtatactcataatactcaggtattatggccaatgtgtacagttaagtgttggcccactatatgaaagtaacaataaacaatcaacaaacaatttgttctcaggggctttaccaggaaataagaatttattgcatacattacaaaaggaagtttcttttataagcacaagtatttagaaagtaatttgagaggcatatcatatccttgacagaagaatagcaacagcttccctattgaggcctatgatctccccagatgcaggtttttgtcctggcttagtgtaaaagatttaaaaagatgtgaactcttctgtggaattgattgaacacactatagatgtgctagtatccacctcccttgctgccctctgacagttcatcatcccattcctccccctgtaaccaagaggatgtacccactccccaccctcaacccctgccaggccttctcactccctgttttccacacaaacacacaacatacatgaagaataacaaaatagaaaaatggttagccaaagtattgagagggcacagggacagtatcccaattaacaaaatcagaaatgaaaaaggagacataacaacagatcctgaggaaaacacatcaaaacgatcatccatcatgactaagtagactttatcccagggatgcaaggatggtttaatatacggaaatccatcaacataattcactatataaacaaactcaaagacaaaaaccacacgatcatctcgttagatgcggagaaagcatttgtcaaagtccaacacccattcatggtaaaagtcttggaaagatcaggaattcaaggcccataccataacataataaaagcaatctatagcaaagcagtagccaacatcaaactaaatagagagaaacttgaagcaatcccactaaaatccgggactagacaaggcagcccactttctccctacctattcaatat

SEQ ID NO: 4681 - DNA, 1000 bp, mus musculus
gagttatttttgtcctttttcaattcctctatcatcatcatgagatgtgattttaatgtagagtcttgcttttctggcaagttggggtgaccagggttcactgtggtaggagaactgggttctgatgatgccaagtcattttcatttttgttgcttctgttcttggcacttgccttttgccatctggttatctatggtgttagctggtcttgctgtctctgactttagcctgtccctcctgcaagcctgtgtgtcagtactcctggaagaccaattctctctgggaagaacttgggtaatgagagcttgcagtacagggtcagctctggggtgcagactgagaccagaaggatcctatctccagctgatcctgggttcctgtgtcctgatagctctggaaaggtctctcttgggccagggatttgaagagaagtggtagtcttacctgggctggcaggtgtattggccctcttgggagaacagctctctccttgcagtatttgggtatgtagctctgtggcacagaatctgctttgggttcagatggagactgtaagactcctgtcctaggcagcccctctgttcctgtgtccttagggttccggggccagtccctctgagcagcagtggtggtcctccctgcactcacaggcctgtccacagccctgagaagcttgctccctcccagcactatttgggtatggagcagatatggaaatttgcatttttttaaaaaaaaatgcagtagcaaacaagtgggatagggggaaaccacaggcagacaagcaatagcacctacttcttgacaacataattgcaaatttaaaaggcatcatagagactgcaacatggctcagcagggaagggcacttgctgccaagcctgaagacttgaattcggtccctgaaactcacatggtagaggtagagaatttactccagaaagctgttttttgacttccactcatgccccatggcaatgcgtggttgccccacaaaat

SEQ ID NO: 4682 - DNA, 1200 bp, mus musculus
gatgttttgagttaggatctgtttgcattttgtattttctttgattgttgtgcctacattttctatggaatcttctacacctgagtttctctcttccatctcttgtattctgttgctgatgctcgaaactatggttccagatttctttcctagggtttctatctccagcattgcctcactttgggttttctttattgtgtttacttcccttttttggtctagtatgattttgttcatttccatcatctgtttggatgtgttttcctgtttttctataaggacttgcaactgtttagcagtgttctcctgcatttctttaagtgagttattaaagaccttcttgatgtcttctaccataatcatgagatatgcctttaaatccgggtctaggttttcgggtgtgttggggtgccccggacaggctaaggtgggagtactgggttctgatgatggtgagttgtcttggtttctgttagtaagattcttatgtctgccttttgccatctggtaaactctggagtcagttgttatagttgtctctgattagagcttgttcctctcgtgattctgatattctctaccggcagaccggatcagagaactctctgccggttcagtggtcagagaactctctgcaggcaggctctcctctttcagggaaggtgcacagatatctggcattcagacttgcctcctggcagaagataaaggcccgaaacaggacctgtcccagaagctgttagcttctgtaatccacaatctcacctgtgcagagtagtctcggtggagtccgggagccaagatgtctccagcagatgtctcctcctgctggaggtaaagccctcccaggcccggtggacacctatcctctggcagggaaggtgcccggatgtctggagcccgaaaagggggctgcctcagaagctctgtggctcctgcctgtcccagatgttgttagcttctgtagtccacactctcacatgtgcagagtagtctcggtggagtctgcgatccaagatgtctcccgcagatgctcaggccattactcatctttttatgccatagcagagcatccctgaataaacagctgattcctaggcaaaatttcatttcttggagttctggagcaggaaatccaacatcaaggggatggagtatgttgaaacatcttatggtacatcttgacatgatgaagacaag

SEQ ID NO: 4683 - DNA, 1200 bp, mus musculus
cctccaaaatttgacagtaatagcctttctctcaaaacaccaaatattcaagtcacagaataaaaagaaatcaatctggtagtgatttaggagctctatccctactggctagcttttatattgctgggtggtgttatgcatgtttccagaagaaaaacataatcaccgtactcgggtatgccctctttagtcatagtggagactagctgattaacacatgcccactgctgcagcagtggcataataagattcagcaatgatttcctgattggatttaaatcctgatccgcatgatgacattcatacctggcatcattatagggcttggaacctaaggctacatagatgttaggctctatgttaatactaccactatccttgtgataaataggcatacttttaaactgattctttatggcttttttttttttttcgagatagggtttctctgtgtagccctggctgtcctggatctcactttgtagaccaggctggcctcgaactcaggaattcacctgtctctgcctcccgagtgctgggattaaaggcgtgcgccatcatgcctggctctttatggctcattttgatatccataagttagtgtatatatcagcactcttcagagaaaattcaggttagagttgtgatttactcagtaactgccaactgctgaagctgcaaagattaacatattgtgaaattctcgggtttaaatggggcatctatattatacctctttctcccaagaattatggaccattgtgcagtagcaggcagaaagaatatgagaacaagagctgctgtaagccgataaggaaactgtgtcttctgaacacaacagggtggctgggtagctccatgtcttagaaattatgggcaatgcaaattaattttgatgggattataaaaaaaagagagagagaaggcaaaggagagaagcaggagcagacctaggaggaggtggcacagaagaggaatatgaccaaaactcattgtacagaattccaaagaactaataaaagactgttactggtttgatgtaaaagtctataggaaatgttaatgaataaaggaaaataacagaagttaaagaaaatgtcatcaaaagtaccatgacctttggatcaacagaatcacaatcaataaaggcatcatctaataaatggcaataaaaagtgctagatcagccaacaaaaactg

SEQ ID NO: 4684 - DNA, 1000 bp, mus musculus
tcttgagagacatagaaaggaaagaccactctggctgacttagccctaatgctgaaagagcaggatgtaggagagaaacctgggagtcatcgacactttcatgtgcagagaagacacacatggtatgggaagaacactggtctggtacagagcacctggtctcccagccaagctctgctatttccaccttccagcaggtctgctatcaaggcacttatgttttcttttcacaatgcaaagtaaagaagcaaagcaagattttagtttcatctccctaagctcacccctgtgttttgttaaagccaatctattggtctcagtctttattttagaagatgctgagcagctcatggcttgatcctttcttacaggaagtcagataagctttgcgggacatctcaaaggcagcttttgtggcagaaactaccaggcagtttcaggttcttggcaggtttctgttggcatccttacagatctcccctcctttcttggcattgcactgcatttacagcaagtcttggtaggcgtttaattgcctatcatatcacttttatgtattcctgtgggcttactgagaggtgatatacactcagtgtgctgaaggtctctcccccatcatggtatacctactaacccgtaagtgcatgtcaatagtcactatgttcttatcacttggaccatatcagatttattatcttactggttagatgggcataataatgatcatgttgtgttccatataccggtgtgatacgagcactagatgggacaaattagacaattttgagtagcatataataaattttagtgacagagatagttctttgatcttacagtgcatgtcagtatttgtgaacttttctctttggaaaatgaccctaacaaaatgtctctaaataccttcaaatgcctagtgatggccaaggtgaatgccaggccttactggagacaccagcagtttcagcatacagatctcagtgagcagggcagatgtgctgcc

SEQ ID NO: 4685 - DNA, 1200 bp, mus musculus
cccacccactcccacattttggccctggcgttcccctgtactggggcatataaagtttccaagtccaatggacctctctccagtgatggccgactaggccatcttttgatacatatgcagctagagtcaagagctccggggtactggttagttcataaagttccacctatagagttgcagatccctttagctccttgggtattttctctagctcctccattgggggccctgtgatccatccaatagctgactgtgagcatccactcctgtgtttgctaggccccggcatagtctcacaagagacagctatatctgggtcctttccgtaaaatcttgctagtgtatgcaatggggtcagcgtttggaggctgattttttcatgaatcattttacataatggatatgaagtgaaggttctatgccccagtgtaggggagtaccagcctgggaagcagaagtgggtgagttagtgaacgagtgggggggggaggggatttttcagagcagaaaccaggaaagagaataacatttgaaatgtaaataaagaaaataaaaaactcttacacgcgttcacgactggccaggaagaacacagcaaaccagaatcttctgcagcaaaactttattgcttacatcttcaggagcaagagtgcaagagagcaagagcaagagagagcaagaaagcaagaaaaagaacaagaacaagaaagcaagagaaagaacaagaacaagaaagcaagagaaagaacaagaacaagaaagcaagagagagaatggcaaaaccccgtcccttttaaggagaattatcctctgcctaggacgtattactccctgattagctgcagcccatcggcccagttgtcattacgggaaaggcagaacacatggcgggaaaactgcccctgcatgtgtgcagatcatgtttaccacttagaacacagctgtcagcgccatcttgtaatggcaaatgtgagggcggctcccaacaaaaaacaacatcactttgttttctacaaaactaatctgtaaccggaaggaatatttatagagttataggaggagtaaatagaatagcaatgtacagaagagtaacaggttctacaaaagtggtacagaaaaagatgactcagtaattataagtatttgctgcaattgcagaatctgggttcagcccccaacatgcacacacaatccttacat

SEQ ID NO: 4686 - DNA, 1200 bp, mus musculus
gtttctattttgttttttgtttgtgtctttcttccttccttccttccttccttccttccttccttccttccttcctttctctttctttctttctttctttctttctttctttctttctttctttctttctttctttctttcttttctttttgtctaagaatacatatgtttttttattttagttaattaattaatgtcaaatgctataccttcatagttatcctctcacagaggatcttcccctacccatttcccttctcttctgaaaggttggcccctctctgggtatgcccggaccctggagcatcaaatgagtgccagagtaggcataccatctctctctcttttttttttcctttctctttgtttaattgggtattttctttatttacatttcaaatgctatcacctttcctggattcccccctcccagaaccccctatcccatccctctcaccctgcttctatgagggtgtaccagcaccatcccacctactcctacctccccaccctgacattgccctacactggggcatcaagccttcacagggccaaggcctctcctcccattgttgccccacagtgctattctctgctacatatgtggctggaatcatggggtcacttcatatgtactcgttggttggtggtttagtcgctgggagctctggggggtctggttggtgaatattattgttcttcctaaggggttgcaaacccctttggctccttcagtcctttcactaactcctcccttggggacccggtgctcagtccaatagttggctgtgagcatccacatctataatggtgaggctctggcagggcctctcacgacatagctatatcaggctcctgtcagtaagcacttgttggcatctgcaatagtgtctgggttttggtgactgtatatgggatggatccccaggtaggaccagacaaggtatccgtgtttgggaacagatactacactcaggctacagttttttgtttgtttgtttgtttgttttgttttgttttgttttgttttttgttttgttttttgtttttttcttattttttttttattttttaggtattttcctcatttacattttcaatgctatcccaaaggtcccccatacccacccccccataaccctacccacccactccccctttttggccctggcgttcccctgtactggggcatataaagtt

SEQ ID NO: 4687 - DNA, 1400 bp, mus musculus
aggtgtaaaagtgtatcctccaaggacctgcctccagtgatctacttattttgattagtccctgatccctgaggtttataacactttccaataatgttaacgttggagatgaaaattttatcaaatgacctttgaaggcaccttagatccaaacataaatactaatacatcattcatagttcttcttgttgtaatcaaatatgtgccaaaagcaacttaaagagaaataagggaaggttcattttgactaaaggtttattgttgttgttattgttttgttttgttttggttgggtttttttattattattttctttatctacatttcaaatgttattccctttccaagtctcttctccagaaaccctgcctatatgtgggtgctcaaccacccactcaccaactcccaccttccagccctggcattcccctacattggggcatcagacccccacaggcccatgcgctgtttctcccactgatgtccaacaagaccatcctctgccacatatgcggtcagagccataggtccctccatgtatactctttgcttggtggcccagtccccaataactccagggtgtctggccagatgacattgttgctttccccatgggcctgcaaacccctcaagagaatattggtcatcacagcagggaggacatgggggcagacaagtagagtgactggtcatattgtactgtagtgacaaaactaggggatgaatcctggttcgaatgttcccttttctcttttattcagtcctagatcccatttcaatgaatagtaccagtcgcttggtcatccttgctcacttgatccttgctttgatagacacgctgacagatacattgcacagtgattctaaatctagtcaaacagatggtgaagattaacatcatacttgctgcttggtcttgggctaaaatagtgcagtttaaaagtaaataagttaatttgaatgtgaaataacttttaataggcagagaaacttaacctgctttctttgtgttcccatgtcttattgtgtgtttgtgtgtgtgtgtgtgtgtgtgtgtgtgtgtgtgtgtgtgtgcgcgcgtgtgttttagagtctatttgaagtccaatgctagatgtagtaattccccaaataatggaatttctaaagatttgaaacaggcatttcagactaagctaaagtgagataaaacaaaacaaaagcaaaatagtaactcaaagaaacagaattatcaaggctccaaacagacgagcttcagttacagacatcacttataggtccactgcacattttatttcacatgataaggtctattcctcttatctgtctggagtgtttatgagaaatcaaactaaaacaacactaaatgaattttgaagcacctcatcttagctaacctt

SEQ ID NO: 4688 - DNA, 1200 bp, mus musculus
aagacacagtttccttagagttattcatcacctctgtctggtattctttctgactcctcttccacataggtcattgagccctgggagtgtttgatgaaactattccatttaggactcggtgctccaaatattctcactctctacatattgtctagctgttgggaacaaaataaatagggaggggagccctggggaagatcgggaaaggaaaaggggcctaatgtccagccagagttcctgtgctctgggcaggtggacacaggcattgaggggctgcagggacgcttcccacacagcccagagtgagcatctaagcctctgacccaccctgtaggggggtggagaaggggcagcccccgacccgggggggggggtgaggaccacaccctgtagccctgcaggtatgggagagaggggagagggaagaagttcccaacactgaccagagtgggcagcagaacttaaaggagcagagactgtttatgttttaagagctttattatagaaatgcaggggacagagagaaggtagaaaagagagaggtggggaggctagagagaaagagaaagagaaagaagagaggagaagacaaagagaaagggaagaggagagagaagtgagaggtaagagatccaaggagtaaaagggtaagagaacaaggtgggggctgagcacccctttttatgttcttcactgttgctaggtatctggggaggagtttagcctgaaggtcagaagcttgggccattgcttatatgactactgaccatgcttctcttgtgggggctgtgagaggtggtaccttaggcaggggccgcagttccaggagcatgagggaacacctactgtgtcatataggtgaattatgaccatcgaggttcagatctcagctcgactggagaccagcctacaattccccatatctagctatggtttctgagttagttcttacctattgcaagaaaatggttgagtgaggcattgatatattggtgatgaataatttgtttagaaatcattttatctctcttggtttaacagaataataatattcagtttttccctaggcctatggtctatctagcaatggtcttttagccattttaccagtgtcagataccaacacagagatgaatgaaaacactaagacaattcaggtattgaaaacctaattcagtaaggacatagaaattctcaaga

SEQ ID NO: 4689 - DNA, 1400 bp, mus musculus
tagctctctcttgacaacaacaaacaccagactgaagaggaccgtatcaagctgttcttgggcaacctctgcctgaccattcattgtacatggagtttccgaatttagttgtgtttgtttgtaagactgcattgttacaaatattttaggtaagtattttggttgctattcttcaaatgagctttaacaaaatatttactttattagattctgagacttgcatatgtcaatattatattacttcattttcatcctagcctcttccttttccaactccttccatatgcaccctgacccaatttcaattcataacctctttttaaattatgattgctataccaacacaaaacacacagatattatgcatatgtacatatataacattatgtatacatacatacatatatttatatgtgtaatatatatgactatatattacacttatataaaaattgatgaatccattttgtgtagtttatatgtacatgtgtttaagtttgactgtttggctaacatatcccagtattatccatagagaggactgattctccctctcttgccagtcattaattgcctgtagctcttcatctgttgaaggactactgtgaaatttctatgatcccattgacagttggcatgtcaactggtgttgttaatttacaggttgtgtttagcctaccatgttgttgagattttatggccatctgcctctcagaatattattgcccctgatccgcaatgttctctaaactttggatatagaggttacatagtagatgcatcaaatgaggatgcacctctcatggttctctgtatttttaccagttgtggatttttcatgatggtatctgtatctgtcaaaagatactgctttgatgaggggtgagaactatatttattgtggatataaggaatatttagaagagagtggaggattaaactcatttagaaatccagcaacattaggtccttctctagatctctagtcctcaatagcttcaaaccttagcataggtttgagaacaaggtatgaatgccatcctattgagaaagtcttcagtcaaagtaagtgtctgttctatatcccttaggtataagtgccagtattgcacccttgagtgtatcgctccattcagttaacttctatggtttgtaagcattagagttgggtaggacttctaattgtttttcttggttgtcaatttacatatacctgttgatattttgaaacctgggcatttgccttcacttcatagaatcctaatgaaaatacgtgtctgaatgccatagaatgaatgaaactagtggtagtgattactatatcaaaaggatgaatagctttcagaaagaatagagtgagactgtgaatcttgactttaaattgaaaaacaaaatagaac

SEQ ID NO: 4690 - DNA, 1000 bp, mus musculus
agatattaagaaaacaagaagcctatttaaaaatggggtacagatccaaatgaatgattctgtaagaagaaactcagatgacacttgaaaagctcagcattcatagtcatcagggaaatgtaaatcaaaactacatagagattgcaacttacacccactagaatggttaaaataaatcaagcgacagctcatgatgaagacgatacagagaaagacaaacattcatccattgctgttgagagtacaaacttgtttttattattattattttctttatttacatttcaaatgttattcccttccttattttcccctctgaaaatcccctatgctcttccactcctactgttccccaactcacaccctcctgcttcctggtcctggcattcccctacagtgggccatagaaccttcacaggaccaaggccccctcttcccattgatgagtgactaggccattctctgctacatatgcagccagagccataagtcccaccatgtgttttctttgattggtggtttagtccaagggaactctgggagtactagttagttcatattgttgttcctcctatagggctgcaaaccccttcagctccttgggtcctttctctagctccttcattggggactctgtgctttgtccatggatgcctctgagaatccacttctatttgccaggcactggcagagcatctcaggagacagaagccaatgtggaaatcagtgtggcagttcctcaggaaggtgagaattaatctaccattaattgtaccactattggacacacactcaaaatcttgccatagagccatagagacacatttgtaccatatctgttgctggtctattcataataggctgaaactggatacaaccttgattaccataaagagaagaattgataatatgtggtatatgtacacaatggtatattccttagccagggaaaaagcaaatcttgaaattggcaggtaaatatatgaaacaaacaaacaaa

SEQ ID NO: 4691 - DNA, 1400 bp, mus musculus
agacaaaaaaaaaaaaaaaaaaaaaaaaaaaaaaaaaaaaaaatacagaaaaatgaaaacctaaccagtgttatgaatcaactggacctaaaaacacatctatggaatattacacacagccagaaaaaaaagaaaaaaaccttcttcccagaacatcagaacattatgaatcattctcaaaaaattgaccatatagttggtcacaaagcaagcttaaaaatataaaatacagttgaaataatttcttgtattttatcacagcactatggattaaagcttgacatcaacaacagaaacatcagaaaacctacacactcatgaaaactgaacaactctctctactcaatgatctctgagtgaaggaagaaatagagaaatagactcgagccccgggctaccttgccagcagagtcttgcccaacacccgcaagggcccacacgggactccccacgggatcctaagacctctggtgagtggaacacagcgcctgccccaatccaatcacgcggaacctgagactgctgtacatagagaagcaggctacccgggcctgatctggggcacaagtcccttccgctcgactcgagcccctggctaccttgccagcagagtcttgcccaaaacccgcaagggtccacacgggactccccacgggaccctaagacctctagtgagtggatcacagtgcctgccccaatccaatcgcgcggaactcgagactgcggtacatagggaagcaggctacccgggcctgatctggggcacaagtcccttccgctcgactcgagactcgagccccgggctaccttgccagcagagtcttgcccaacacccgcaagggcccacacgggactccccacgggatcctaagacctctggtgagtgaaacacagcacctgccccaatccaatcgcgatgaaactgagactgcggtacatagggaagcaggctagccgggcttgatctggggcacaaaccccttccgctccactcgagccccgggctaccttgccagcggagtcgcctgacacccgcaagggcccacacaggattccacacaagatcctaagacctctagtgagtggaacacaacttctgccaggagtctggttcgaacaccagatatctgggtacctgccctgcaagaagagaggttgcctgcagagaatactctgcccactgaaactaaggagagtgctaccctccaggtctgcttatagaggctaacagtatcacctgaagaacaagctcttaacagtgacaactaaaacagctagtttcagagattaccagacagcgaaaggcaaacgtaagaatcctactaacagaaatcaagaccactcaccatcatcagaacgcagcactcccacccaacctagtcctgggcaccccaacacaa

SEQ ID NO: 4692 - DNA, 1200 bp, mus musculus
ttttctttcttcttatgcctattatatactcaaaatatgtacaatgctcaatgattgcaatttaaaaacataaagttaaatcaagaaaaagtgtcataacaaattgtgggactgtaaaaggtatggggtccccagttgaactaaggttagaagcctcagagactgtgaaggaatggttgcagttttacctggtcctgggtaccgggccccatcactagctgcagcacagcatagatttgtggccatcagacatgtaagagcagtgctccaagacccctaaaggtagaaaaggttgtaaactatggtcacttaggctcaagacagatctccaatttaatgcagtatctaaagacctggatggcttagccaataagctttccttcccagacactcctccctgcaaagggtatttaatctcaggccaccctgatatgtgaggtatggtttttcacatccactttctgccatgacaataaatgccttaaaaccatggactgcctcttttcataaagatctaccatggggagcaatggagaaggtctttgcctatagagctgctgtcttgtctcccatagaaggcctctctgcacttccagccatgaccaaggcaagccccaaattgtcaccaccaagccaaggactcatccctgcaggactagctggtgctcacctcctttttccctgtccccagctagagccattcctccagcccccactctgttctcagctcttctgcagcttccatcacctggattccaagatcttgagaaccaggcctggggatccctgaaccagctccagctgtctcatgcctcaaactgtgctttcccaccccctgaagggtgtcccagggctttactatggtttcaatacccacccagggacagcatgggaatgggtaagagcagtcaactctccagtactgcctccccaagcagccatgccatgtagtggagcagatacggaacatgtaaccctacaacaaatatcaatgactaacatctaggttttttttttttttgcatcaacaatacaaatgaattaataatgccattgtatgtatctttatagtattttattaattcacaggatataaagcatcatctaaagttgtttaacacatatagtatgcataagcaaagatcaaggtgctcatcttctacatgtgtgtgcagagattaaggtcagcctatgtgtgtt

SEQ ID NO: 4693 - DNA, 1000 bp, mus musculus
aggttaccaagacaaatatacataaacatggtttatattggtggacattattgataaagtaaaagataaccattttacaattcacagacccaaagaagggaagtaacaatgagggctcaaggaggggacatgtgaatctcaatgagatttggacatagaatagatactatgagggaatgggaaggcaactggatggtggtggggtaggaatgggaacaggagggatcaggtgggagatagacttgagggagcgaatactagggagtgacaactggaatcatggaaggtaaggtgaagtatctctgggaacccaagcacccaggacaatggaaataccatggaatctatgaggatgactgtatttgctttgactccaagcatgagaacatggagcctaaaccggctatctcctataaccagataagagtttcaatggaaggactgtgacatccacacaaccataagaacttccaactacagtttatcctgactaaaagatattcagagaataatgatggagcagaaactgatgaggtggctaatcaatgacttgtccagcttgccatgaaatgagctcacccttaacactgttaatgatactctgctatacttgcagataggaggctagcataactgtcatcagagaggcttcaccaagcaacttcagcaagcaaaattaggcaggacttcgagaatcctgtggaagaaggggataaagaattgtaggagcctgaggagttaaggaaaccacaagaaatcccacagaatcaacaaacctgggctcataggggctcacagaaacaaactgccaaccacgaagcatgtatgggactgacataggtcctctgcacatatgtaacagttgtgtagcttggtcttcatgtgaggctcctaaaagaaggagcaggggctgtctctgttgcctgtggtttgaatccctttgccctaactgggatgccttgtctggcctcagaagatgagagcctgacttacttcaaca

SEQ ID NO: 4694 - DNA, 1000 bp, mus musculus
caattttgaattcttaaaaactcaaagctggcttaaagtgttaaactttatgatcataaaaaagtacataggcaaacattattctgctaggtagaaataccaagggtttttacacacaggccagtcaaagtctggagaatagctatcaccaatggagctatcaccaaggaaaaggtctaccaatggtaactgccaaagttgaaccaacaaacatcttactgaaggttgaatccatggaggtatcataccacaggagaggtgtgaaatggaaaagaaaagtccacttccaaagaaaccaaaaatcattatttaatgttagaattgagacagaagaaaggggaagcaggctgtaggttgggaaaattaagaaatgtacgaaagcaaagagtggatactgtgaaaaatggaggtaaagatgagagtatcatctgcttaatgcctaagcttgccttatcaaggtgccaggcagcacaggcatggatggactcgtgcctaccaggtgccactctgcctaaatgtccatttactcaagtcacttggattctcagattcctaggttcactcctttcttttacattttttatcgctggggatcagggctgggaatgcctctaattcttctctggctagacctcagctcttgatcaaaggccctttcacagaatattcctttcatctaagcttttgattcaatctacttttgtactcagttattcatttttctgagacaaggtctcctgtagttcaggctattgtctttataggaacaggagattttgagcatctcatcctctcccctccaccccctgttttctgagattacaggtgtgtgcaatcatgtccatttctgcagtgttagagagcaaacgtagagctttgtggacactggaaaagcaatgtacccactgaactatagcctcagcattccaaggagaaaatctagaactaaaatctaaatttaatactggaagcattgtgaaatatgaaataagtttattat

SEQ ID NO: 4695 - DNA, 1000 bp, mus musculus
taactatgtaaattaggtttgtggagctagatgagtgtataattgaggtcaccctatgctaggttattctgtatttccttgtgataaaataagaaatagcttaaagtccaactcttttagtcagggtttctattcctgcacaaacatcatgaccaagaaacaagttgggaggaaagggtttattcagcttacattttccacattactgttgatcaccaaaggatgtcaggactggaactcaagcaggtcaagaagcaggagctgattcagaggccatggaggggtgttacttactggcttgctttccctaacttgctcagcctgctctcttatagaaccaagactaccagcccagagatggcaccacccacaaggggacctccccacttgatcactaattgagaaaatgccttacagttggatttcatggaggcacttccccaactgaagttcctttctctgtgataactacagcctgtgtcaagttgacacaaaactagccagtacaccaacaaacattacattttggactaacatattgagtgtgattttaaattgttttctttagtctttcactgaagagagtgattcttaaaatttgagaatagcaacttaaatttaaatactgatgctgatactgaataaccggaatgactaatgcattagttttctctttttgtcacaacatatttgacagaatcaaagtaaggaaggaaatgtttgttttggcctacagtttgaagtacatttcataatgacaggtaaggctcggtgacaagaatgggctgagctctggaaacaggagtgtgggttgctggtgccattgtgtcacagttgggaagcagaaatgttggaatgcaaacactgcttgcttccatgttcttatttagcctcagattccagtctgtggcatggtgctaaccaccttcaagatgtcttcacaccttagttgaactttctggaaatgccctcccagacatgctttctcagagattttaaa

SEQ ID NO: 4696 - DNA, 1400 bp, mus musculus
tttcaaacaagtataaacactgcaataaaaagtaggtttttaaaaacattctgaatagtttgccaatatgtaaatatacctttatcgccgtaaggaaaaatcataaaatgaagagctactgaacccatactgtatttatagtctaagtcaatcaaatttattatatgaatggaaatcaatttcattaattctgtaaaatgactattttctttatgtcttaaataattaggcaacaagaccacagttggattcaatcacctttattagcctatcaatgttacattttatacataatgtctagtcatcttctcagagggctctatttttagtacatcatgttaacagtaaatagccaagtgtgatggctataccttagcctagctttttaatattctctgggaaactagaaagccaatcattttacacgcatgtaagagtagtgttccaaaataactaggaagcggctacaattttaagcaggggaggaaacaatattcattttggtctttttgtgtctgtattctggtaaattatattttcaattaacagcaacaatgatatcataaaaaaatgctctgctttttaaatttttaaacttcaatacaatacaaattgaaacaaaatagtattgtatagtcttttgggaggcaatcagccattattattagtgtggctgaacctccttatcgataaccaggtccaggttgggcatacccctgaccaaaaggaggacggttacgagcataagggttagccccactagaaggaggggtcatggtacttgcaggagatggcgtaaaacctggtcttggttggtaagcaccaggttggcttggagccattccaggctgagagccagggggaacagtatagttggcaggctgagatggttgggtagtatacgtttgtggagggtaagtgctcgcctggtactgctgtggtggttgagcaggcagttgttgtggctggccagaaaaggcaggagccggtgcctgggaagttggttgttggccatatccctggaactgctgaggttgttggggtccagtctgctggctgtaactagctgaaaaaagcaaaatacataacaaatgttttgggttttttggtgaaagttttccagagacttagtcttattgctatggaccaaaaatgattaaaaaattaacaaatatattcataattatgtagtgagtccagcataaaacatctcaaaaccaaagagttacaaaatttttccagacactttttaaattctatagcctaaaattcaagtcactataagcatgtattttcattacaactgctttgaaactaataataacccttgagcaagttcccatttgcacaaaattcctagaatgaatgctcaaataggtgaaataattacactttctagg

SEQ ID NO: 4697 - DNA, 1400 bp, mus musculus; identical to SEQ ID NO: 4696

SEQ ID NO: 4698 - DNA, 1000 bp, mus musculus
aaaaacaattagggttaaacatcaggtagttccagggcacaggcagcatctgtatgtatgattctttcctgctttttctcactagctccaggaagtactttgctggccctagagaatcaagctttgtttcctctgagaaatgtctgctgagtgattaatcattgacttgatgcccaacttcgggttaccctggatatcaaagatggcttttgacaggtatgagaaacctgaatcctgcaggaagtgcaagacataggattggaataaataaaataggatgtatggagcaatttagatctagcatgaacatggaccagaaaaacaaaatcctaagtaacatactgatgagaggagagatcattgcaaagcagggaggaggcaatgtccctgagatagagaagataggctctggcattgttgctttgaataaactggtgtggagcacatgagtgcaggcctagcatgtggactgagtaggctctgaacatatggacttggtcatgatctgcatggactcatcgatggcatgggctttggcattaaccacataggcccactggacctggaccacatgacctccaatattgagcacatgggccagatcatggagttcattgggtctgacatctagcacatgggtgtctgcataggctttggcctggaatgcatggttggacctattgactctgtggagcaaaccattgagagtatgggctctagtatagagcacattgactctgccatttacagcatggatctgcacatgatacccacagacatggggctggcttggagtgtattactcctgtaatggatgctatgcttgcttgcctggagcacatgggtgccaccaacctaaagcacataggtcttgaggacttacaagccaataatcttgagcacatgagcctggagcaattgttgccaatagcctgacgcacatgggccctgccatgtgctcagcattgggcattggcattgagcaaatgagcctagcctt

SEQ ID NO: 4699 - DNA, 1800 bp, mus musculus
aggaggaggaggtaaaaggagtaagtcagacaggccaggagcaggagcaagaatgagtaagtagcccctggacaggatgacataacatcctcacacactgagagaccattcagtcttttccactctccctgccaaatacatagatggaggggggagaaataccactctaaaagtaagtggctcagcaagcgacctctggctaatgagcaagtttggcttttcccatgggccttgcaagcattcgccttaaaagaggaagggctttgcttcccttgggtcttaagcctgagtttgccatcttggtggggatggatgagggacaggtaaatgcaaatctctgggatatcccacaaggacaacagtacatggagctctcttcaaatattaagttacttctaaatttagtgtgtgtgtccgtctgtctgtcggttcatcccgcagcgccagttctgcttaccaaaagtggcccactaggcactcgcattccacgcccggctccacgccagcgagccgggcttcttacccatttaaagtttgagaataggttgagatcgtttcggccccaagacctctaatcattcgctttaccggataaaactgcgtacgtcgggaaaagagcgagagcgccagctatcctgagggaaacttcggagggaaccagctactagatggttcgattagtctttcgcccctatacccaggtcggacgaccgatttgcacgtcaggaccgctacggacctccaccagagtttcctctggcttcgctctgcccaggcatagttcaccatctttcgggtcctaacgcgtacgctcgtgctccacctccccggcgcggcgggcgagacgggccggtggtgcgccctcggcggactggagaggcctcgggatcccacctcgggcccccgggcggggcccttcaccttcattgcgccacggcggctttcggacgagcccctgactcgcgcacgcgttagactccttggtccgtctgccatggcgtgtgtgtggaggtcagaggacaactcttggagtggattttctctggtcacctggtgggatctggacactgaattctggtcatcagacctgtgccaaattgcctctacccataagtgccactaccctttgagccggtcttaaattgcaattaaatgcaaaataactagcagaacacagaagacccagtgccattcagtactcaaacatatctctttaacctttctctcccagacttattgtttcaacaacttgagaatagctggccagagttcttaaagatgtcaactcttttatattcctattccctacaattgttggacaactttaaaacattttgttgccgtttagtttctttgattcataacaaactctaatgtctgtcttctttagcatttaactatcagcattaactataaagcatccaaagaaagagagacttttaaaaggaagacctgaatacaatccccaggactagaaagaaaacgtctgggtctgtggggactgctcagccagaaaagctcacactgcatgagcaaggggacccgagagttgtgggtggaggtggacatggtggccccctctgcaatcctggcaatgggcagaggggagaccaagacaggtggatcctcgaagctccctggatagccagtctagtgtcaggttcagtgagagaccctgtctcaaaagacaaggtgtggtgcagtgatcacagaaaatattcaacacggacctcttgtcccaatacgtatgtatatgtgtggatgggtgacacacacacacacacacacacacacacacac

SEQ ID NO: 4700 - DNA, 1800 bp, mus musculus; identical to SEQ ID NO: 4699

SEQ ID NO: 4701 - DNA, 1200 bp, mus musculus
tctgagttgctgttggtcatggtttttatctcagtaatggaaaatcaaactagaacaagaaaactatgtagcattaaatacgtgattatatggaaggtactcattgccatgcgctcataactctccaaaagaagcattggagaatagctccctatgtactaagtgtatgtagaagtacactctcgtataatagggcgttattgaagcattcttggtcaggaagttgcaaaatgacaaattctactgtcttttcatttcacttcatttcatttctttttattcttgtggatgcagtgaactttattgatggtattcaagagagaagggagagctccctagacccctccagttattatggaggtctgggatggaaattgtgagggagatgcaaagtgtggggggctgagttgggatagggactcctcagcaaccgagggcttctctcttgctctcagtgtccttcctggagtgggtggctcagggtttctttctccttgtaggccatgtaggccatgaggtacaccaccctgttgctgtagccatatttattgtcataccagaaaatgagcttgatgaagtcattgagagctatgccagccccagcaccaaaggtggaagagtaggggttgctgtttaagttgtaggagacaacctggtcctcagtgtaggccaggatacccttcagtgggccctcagatgcctgcttcaccaccttcttgatgtcatcatacttgtcaggtttctccaggaggcatgtcagatccataatggatacattggagggtaggaacatggaaggccatgacagtgagcttcccattcagctcttggatgaccttgtccacaaccttgacagcaccagtagatgcagggatgatgttctgggcagccccccagccatcatgccacagctttccagaggggccatcaacagtcttctgagagccagtgatgacatttcactaatggttgaagaccctaaacatcagaaacacaaaagtttttgttgtgaaaaaaattttttgttgtgtttttatctggatgaaaaaaaagaaaagaaaaagaaaaaagaaaaacctataaaaataccactagagattaaaaaaaggggggggggatatgatagagattgcaaagaaattcaaaaaatcattagtaaaacaaaaacattaaaaatcttctagaatcaaataaaaatca

SEQ ID NO: 4702 - DNA, 1200 bp, mus musculus
ttttggaagtttaacaacccatgcacaaatataatattttgttttcatgaactccagccttcgacacaagaatcaaattgtacccttgcaaggtttccatagaggagaatgtattagagaatgagaattcccatttggcttaactgttctctggagaagaaaggaaggatgctctgctgggcaccattgatttggaccccaatgaaatgtccaaattggtcccactgagtatcacaaactttaacattataaatttctaatgctttaagagtctcaaatattaacgattgacatttcagacacaatccacttccttcttaagagcctaggccagtaagactgattcgttctttcctcccttcccaagcttctggccagcccacaaattcatcctggatcccatatccagtggccccaattgctctggcctctccccctgcaccccacaggttctgacatggacctgccctatataccataactcactggtttcttcttctctgtaacccacatcaccacccagccataaatctcacaaccttatttagtgtctagactggacctagagtatctgcaatgacaaacgggtcacttctctatatccaacagctacatctagccatacactccataactttctccagtgtctatcccagacccactatatctgccaccatcctctagtcccttttgttactaatatgatattgatcctttattttatgtaagcacttagtgctataaacttacctcttagaaccactgtcttagtgtttctattgctgtgaagagataccatgaccacagcaactcttataaaggaaaggatttaattaggaatggcttacagtttcagaggtttaatccattattatcatagtgagacatggtggtgtgcaggcagatcctgggggaagagctgagagttctgcaacttgatatacaagcagcagcaggagactgtgtgcctcactgtacatagctttaacatatatgacctaaaaggcacttccattgtgacatacttcctccaacaaggccacatctcctaatagtgctactctctttgaccaagcaatcaaacacattcatctttggggaaccacacctattcaaatgatcacaactacattcattgtgcctaatacgtttgggtatgttgtgttttccttttcattcaattttttttccattttttat

SEQ ID NO: 4703 - DNA, 1000 bp, mus musculus
tatatggtctgtgttttgatgagcccttctccattatgtttgcagtacctttctaaaactcattttcactgtttgtcttctcgcttttatctaacggctaccagcatctatagggagccgaagccctgagtaaatgcccaagtaactgtgtgttgtcgacatgagcccagagcggcagacccacagagtgatggcaaagtcttctccctgggagttggggtcagaaggaaattgcagaccttctcttctggcccatgtgtgaaatattaatagtatgcgtggaaaatgtcgagcacagccttacccctcggccaacattttcagcctgaagactgctcccctacagagaaggctcttagctaaacctgtcccttggcccagatctatactacacactccgcctcctcattcatctgcacagaataactgtcttccctgctcagctctctgctataaccgctgctccgttcaagtccacacaacaagcaagctgagggtcccacatgaaaaggcttctcctgcagagtgcccagatcagctgaccctcagagttctgcctctccgtgtgtttctctcattgtcatttcctctgaaacaccagtcaggtttgtccctggaggcaggctagatgagtggccaccctccttgccccaccaccaccctccctgccccaccaccaccccatcttgttgtctcttctgccttccttacaggggtttccttcgtttcgattatgtgtgtatgtaaataacaaatatccttaacagatacccatcatcaagtaaagtgcagcttttgggtatactttgtatcttagtgccccctgtattaatttaattctgagtggcctcctgatcagagtgagcatatgattccaagtatatgcccgttaggccggtccacccagtaacctgcacaattccctgtgaagaattcttatgctgaggaaggaatggttctgtttactggccctcacctgaatgcatagccaaacatagcc

SEQ ID NO: 4704 - DNA, 1000 bp, mus musculus
gcaacctttttaaaacatacacagtggaattctctttcagttaaaaatgaataatgtcgccttctgataggcgccagcaccgggtcacctcaggcgcagagtcgttggacacccccaaagtcccctagaggactctccacgcgatcttaggaccattggtgaatggaacacaacttctgtttcaatccaatcacgtgggacctgagacagcattagggaagcagaaaagctggccttaccaggatcacaaatcccttctggttggcaccagcacagggtcacctgagcgctgagtcagtggacacccacaaggtccctagaggacagcttctgaggcagaccccgtttccagttccagacatccgggcaccttccctgccagaggacaggtgtgtgccccgtccaggagagctttgccggagcacctgagggtgccatcttggttcctggatccctctgagactagtctgcgcatgtgagagtgtggaatacagaagctaacagcttctgggacaggccgaagcgacacagctactgggacaggccctgtttcgggccttcatcttcagtcaagaggcaggtgtgaatgccagatatctgtgcaccttccctgtaaaaggagagcttgcctgcagagagtgctctgaccactgaaactcagaggagagagctagtctctgaggtctgctgatagaggctaacagaatcaggagagaaacaagttctaaccagagacaactataacaactaactccagatattaccagtaggcaaaaggcaaatgcaagaatcttactaacagaacacaagaccactcaccatcatcagaatgcagcactcccacctcgcccagacctgggcaccccaacacacccgaatagctagaaccagattaaaagcatatctcatgatgatggtagaggacatcaagaaggactttaataactcacttaaagaaatacaggagaacacagctaaagagttacaaggccttaaagaa

SEQ ID NO: 4705 - DNA, 1200 bp, mus musculus
gcattttatttattttatctgtgcatgttctaactttgccttaattagtgtatggtttgttttggtcctgtactttggtcctacagagagcagatgaattaggacttagccttcctaagaatccattcatgttagaatcatcttggttgactaagttgttctgttgatgtcccttctttcattccacattttttgcatcttctctgcaagcattctctcttacattcttacattcacattttaccagatttatcgtcaatcattccccacaacaacagtgaaaagattctgttttattttatcttcagctaatgatcaaaatttcaatacaacctatagttacctaaccaaaaatcagatattcggcataactgtcctttaaaatgttaataacttatcaatggaaaagtatcttttatcatgtgatacaagatttataaaaatcattttaatgtcattaaaattagtaggcattttaaaatatactagatcatgtaagtgagttttattttcaaaatatgacagttataatctagatacattttgactaggtaatgtctacttgtacagtcacataaatatgtcatttatttggcatctccacatctttgttgggaaatcttatgtcaacaacacgttaatgaattttctgaagggaggaaacctcaactctgacaatgttttaataagatccagcatcatatggcattttcttaattagtgattgatagagaaaggcacagcccactgtgtatggttctatccctgtgctggtagtcctgggttctgtaagaaagcagactgagcaagctaggggaagcacaccagtaaaagtaagccagtaaccagcattctttgaaggcctctgtgtcagctcctacctctaggtcttaccctggtttgaattcctgtcctgacttccatcagtgatgaatagcaacagttgaatgcaatccaaataaatcctttcctcttcaacttgttctttgattatggtatttcatcacagtattagaaaccccaaataagacattgtcatatattatataaagtaaggtctggatatttggaacaaaaccaaaaatgttcatcagaaagatggtctcatttgaaacaatgagacctaagaaagacaagatggaacaagatgcttacattgttttatccactcatagatcaatcagagcaaatttaagtgca

SEQ ID NO: 4706 - DNA, 1000 bp, mus musculus
ttagcccacatcatccaaacaatggctcacaactgcctatataactcgagggccaggagatccaatggcctacattggcctctgtgggcaactgattggaaatggcaacatacaattattcatgtacagatacacccatgcacattcacatacatgtgcacaaccccatatgcatgcacatgcatatgcacatacccacatataaatgcagacacatacacacacacacacacacactcacacacacactcacacaatatattaagtaagtgaaaaaatactatttcctagtacaataacaaaaaggttttaggatataaagaataataaaacagatatatcctccagttattctgtttttatttacaggagcccctcatctggggatacctgttttggatgaaacatatgaaggaaaacaaaagagaaagtgaaagctgccatgtccccacagcaagagtggataatatgtattaatgttatattagtccttaaattcaattaaggttgacacctcaaggccacaattgtgtcataataaaacatttcatagtaaattcactgatagaatggcattgtcttagtcagggtttctattcctgcacaaacatcatgaccaagaagcaagttggggaggaaagggtttattcaacttacacttccatactgctgttcatcaatgaaggaagtcaggactggaactcaagcaggtcagaaagtaggagctgatgcaaaagctggcttgcttcccctagcttgctcagcctgctctcttatagaacccaagactgccagtccagagatggccccacccacaaggggcctttcccccttgatcactaattgagaaaataccccacatctggatctcatggaggtacttccccaactgaagctcctttctctgtgataatcccagcctgggtcaagttgacacataaaaccagccagtacagtcatgttgataaacagatatgtctgatcagaagacatccaaaca

SEQ ID NO: 4707 - DNA, 1200 bp, mus musculus
ttatccccatggataattatagtcttcacccctcactaaggaaacttgtgcaacaagttttcaacagagaccaccacaggaaactacaagtagtcaaaatttagacgtgtagaacctaattttaatagatatagctacaaaacattaccataactgaagttctagaagcagtatggaaaattgggcaaaaggatttaagagccagacgatactagaatttttatgtttagaataatgtcagcagctacacctttaaactctcaccaataagatggcacaaccatgtgctgagcaagaacaaccaatatacatagaaaagtgtgtgaggaaactcccacaaggtctgaactctacacagagacgtactggaaactgaggaaagctggggctggccttccccagggaagatcatacatcaattgatttttccagtgcctgaactgaaaatatacatagaagtaacattatatggactgaatgtgttatatttaggaatatttgtatatgttacatacatttacatatatatatatgcattcaataacaattaataaaaaagaggatatgaatttgaaagatagcagggagggttacaggaagatgtgaagggagaaaggggaagagagaagaattgtaattaaattgtaatcgcaattataaaagaggaagtaaaaagtattttgagttgagattttgaatcccaacatatttaaaaggaaacattaggttcagtatttggaatattgtggaacataaaatatggcttttgcaatttactgccaataagttgctatgtaaagtcatagaatttaacttctttaaaagcccacaagtataaaacatatggtaatttaagaatggactcgcagggtaggcataccttacatgttctgttatcagggaatggtattaatttagaaaaaaattaagagacatggccttgtggtgttacttgttgtagcaaatgtgtcactggtgtatagggctttaagggtttagaaggacaagccaggcccagagtcaatttctttatctgttgcaggtaaatccagattaatagctctcagctcattcaccaccaccctgtctacgtgcataatgttatattctctgccataataatcatgaactaaacttctggagctacaagtaaaccccagttcctttcttgcataggagttacagtggtcatgatgtctc

SEQ ID NO: 4708 - DNA, 1400 bp, mus musculus
ttattaattgtctttaacaggtggaggaaaacaatacaacttactattggtccttacctattaaccttgatactgcccactattcacagtacagaaccacaaaggaagtttatcaataattatttaattcccttacatactacatactctacttttccacagcttacattttcagaatgagaaattatcatctgaagaattcatgactcattcatactcaccacaatggttattggtcaacctaattttaacagcatatctttaacaaatagttatttttatcacctagacagaggcctctgagaataaaagataaatcttttgtgtatttttatagctaatgatttctatgtatatttaaagttaactgtgtaatataaaaacctgggtattataaaattaatagacattacctaaagttcagaaaaaaaagcagttcaattatagatcattatctaatataagaaaacaccttagcaaattaaaataggatccgaaatctctgtcattacagaaatagaaaggcattgggaatatgtcagtttgtaagtatagagcgctcacaaaaagggacctatcatgactgccctccggaagacccaacaagcagctgaaagaggcagatgcagatatttgcacccaaccattggacagaagctgctgacccttgtggttgaattaggggaaagctggaagaaactgaggaggagtgtgaccctgtaggagtatcagcagtctcaattaacctggacccctttgatctctcagatactggaacacgaatcaggcagcaaacaccaactgatatgagatgcccaacacacacacacacacacatacacacacacacacacacacacacacacacacacacacacacacacacatatatatcagaggactgctgggtctgggtttagtcaatgaagatgcatctaacccttcagtgactggagatctcagggagtttagaggtcaggtggaggtatatatgaatattaaacaaacaaaaagactatcctccagtgtcatgacccctcagcctatgcttcaagtccactctggagagctcagggatttgtttaaattgcagaacccacaaacagtcacatgcatatatttcttctagtaatcactaaaattcttcattagttttccttaatctctgataccctaaagaaagtttcttatgactttcacttatcaaaagaacattcaacaaatgacacattaattttgagaaattctaaaactctgagttcaacatgtcttcatgtattttattatatttgttaaaatgttttgttctcttcccctctttaaattgtaaaaaaaaaaagtacaaacattcatattactttgttcaaaatgtatgggttgatattcaatattaatgttta

SEQ ID NO: 4709 - DNA, 1200 bp, mus musculus
attcagaaatcagatttctgtgtatttgggcaacagttttgtactttgttttttcattaaaaacatgggtgattttttttttttatcaagtctaactctaggaaactgaaatttcttacttccatattttttttctgacttttgttcttataaaaggatttgaacctgtggctcaagctaaaccaatactctgtcaccaaaatgagtacctagccctgttttgagcttattttgagactgtccctctctaacctgcaatggcttgtggttagagaggttcctcagtggctagtttaagagtgtgatgctcttacagagaccaaattgcatcctctgtggaaataaggaaaggaataagaaggaaggaagggaaagaggaaagaagggagggagggaaggaggaagaaatagcaaaacaagaaatatccaataacaaaattagcagcacccaaaggtacaaacagggaaaaggtgagtaaaagaaactagactggaaaatttattttattatgctgagttcagatttctatatatttgctcaacagttttgaactactgagtctcttttttaaaaataagggtgatttttttttctcccaagtctaactctaggaaactgcaaatgctttacctggcaaaacttaacatgacagtttgccatcactacatagatgaatcccattgctgacctaagcagtgatgtttgtcagctagaatcttcagtctgtctctgttcttctataagcttgaattctgactcctggaacttccagttagggaccctctcacacacctctctgtctatgagtactgcctttccacttccttcttcctactcaccattctcctggctccaggaccaagaaatgtataagatcttcctgcttgacacctgctatatatagaatcttcttgatattctgcatattgactagaaccaagctacaataggaaaaatggaatatttgtgtagtagattgccatgataagacagaaaaaaaaccagcattatccctactttgccttcttacttataacactgtttttgttttctgtgttatatgaataaaataatataacggatgatggttcatctatctccagttcaactgagctccaaacaaccaatctgaaaaacaaacaaacagacaaaacaaaaacaaaacaaaaatggttcaaaaatgattagaactggttttc

SEQ ID NO: 4710 - DNA, 1600 bp, mus musculus
tgagtgtattctatgcaaatatatgtatatacatgaaagtcaaaagacaacatgtaagactattccctcctattaccatgtagattaactggatcaaattcaggtagtcagagtttataaatttttaagtgatttcataatctttataaattccacatattgcctagaattgaattaatactttttaaacagtaaatatatttaatattataattatatagtcatatctgaatttattaatactctacatatttattgcattattaaatcattcatgaacaaattgtatttcacatttccaagaatctatttacttcttacaatgaaattctctctgtactaatcggaaaagaatgctgaattcaaagtatttattttatttgtcacctagtttagtttgctaaatatgaaaatgttattcccctccatgtaatgaaacaaaatgatatctaaaagaaatattaacacagtatcctcaagaaaacccaactctaaagtttgggtcaagtccagattgatgtgaagaactgattaaacgctaaagatgttcctcatggtacattaaagtgaaggaaaatgctttgaacaaaagttctttagtttaccggtatattaaaaggcattttgtcttggatcatgacattaacatggcttgaggatgaagcactcacagacaacagacatccacataacctttcacagtaacatgggccatgctggccaattaccataaaagaccatggacacattcctgaatcctggaggccacacaacccactgaaggtcataaaaaagtctttgatctgtacctccacctgagaccatgtggatatcatacccctggctatttgttggtgtctataatccatactgacaatggagacggttctgagatctgtggcatgtactgatgctggaggccaggtctatgtctgtgtcctgagctgatgaggggtactaagtaaaagttcatgattgtaaatgacaaaagagcttcttctgcagaaggattgatgactgcagactcacagtgaaccgagtgagacatagaagacttttgtgacaacaccacaccaccattaatatatatacacatacatatgaaacaatttaaaagagtcttaaaagttgtgatgctgaagaataactctccacaatagagctctgctggtgggagtcaaggtgggtgagacccacttgtctttcaatagctggtgaccagaagttggatcatgttccagtgactatatggatgacatacattttttgggagcaggctacagtgggtaaatccaggaagactaaggagattagtgattatgtgaacatttcaaataatcaaaaaattatatatttaaaaagaaaggtatcttctgaaacaaagataggatggattcacgtcagtgaaaaaaggaaaagtgtttagatttcctgaaacctaaagataatacagcagcctactagatgtaaatgaaaataaagcttttattcaggtcctcacccatgggggcatccctatttacaccatatgcaaaaggtgagaaaaaaaaaactcatgaaaaactcaacgattttctgaagaatcctcttcaaatatttt

SEQ ID NO: 4711 - DNA, 1000 bp, mus musculus
ttatctattatattcttcctcagtctcattgattctaagacattttttgtacagcacaaaagcattgccaaaaatggaacaccgagttcaggaagaagaaagctgtgagtgtaactctgttttcactggaatctccagatgatggtgtaaactttgcctggcattcaaaaactactctaggagaggaagtggctacattttggtcgtccttcaagttctaattcatttgtcactataagagatctacaaatactttagtatgaataattcttccaaggtcaggatatgtgactccctccactagtcaatcttaagctgaagtgctgaacagctgtaagttgtagtagaaacatttcctacttcattgggtttggaattgtctttttctgatgtatggaatagaaaatcggggactcaaagaatactcctcactcacatgcttcccctagcctgtagtagatgagtctccgagtctgaattaaagctagtctggggcctgaagccctccatttacatttctggatcaaagtgtcagtctgatggcctgaagagatgacttaatgcttaagaccacttattgctctctttcagggcacctgggtttggtttccatcacttacatgtggctcacaactgtctataactatagatctagaggttctcctatctcttcatattttagtgggctcaaacatacaatcagccacacacacacatacacgcatacagaaaaatatataaaaaagcattatataatttttattgttggtttcctttttaagtagcagtctgagattgcccaagaatgtgtgactgatgcctgctaagccatccctctataatcagaggcttagtgccatagactatttgtaagcatgaggcactcagcgagttcttgcttgactcatgtcacaaaaagcaatacctaattagaacacattaaatcagtaaagagtagagtacatgtgcactatatgtgccagttattaatgtggctccc

SEQ ID NO: 4712 - DNA, 1000 bp, mus musculus
tataatgtgatttcaaatcagagtcttacacttctggtgtgttggtatatccaatgctagctgtggtgctagaactgggttctgatgatgccatgtagccttgttttctgtcacttatgttcttgctcttgcctcttgccatatgtttatttctggtgttagctggtcttgctgtctctgactgtgcgttatccttcctgcaagcctgtatgtcagtactcctggaataccaggtctctccaggagtaatttgggtatggagagctttggtacattatcagctccagggtgtcaaggtaaactggaaggatcctgtctcctgtttttgtttggttcctgtgccctaatggctctgggcaggttcctctagggtcaggaatttgagcagatgtggtggtcttatctgtgctcacaggtgtgtaggcactcctggaattcccggtttcttcccatggtatttgggtatggatcactgtggcacaggatatgcaaatggaaaccagaaagcaaaatgacagattttcaattttcaacttggcacactcagctgtaagaccatgcccccttctttgatgagacacaacaaatagtctcacacttcaacaaaacattttctttgtttagtaagtttgagtcttttctgaaaagtataaactgaaattcccacatagttaaagtgtgattgacataagaatgggcgaacccacccagggatccatcccataaccaccttccaaacgctgacaccattgcatacgccagcaagattttgctgaaaggaccctgatatactgtctcttgtgaggctatgccagtgcctcacatccacagaagtggatgcttacagtcagctattggatggaacacagggcccccaatggaggagctagagaaagtacccaaggagctaaaggggtctgcaaccctgtaggtgcaacaacaatatgaactaaccagtaccccgaagctcatgtctctagctgcatatgtatcagaagat

SEQ ID NO: 4713 - DNA, 1000 bp, mus musculus
ttgttttgttttgttttgatttttgttttggtttggtttggttttggttttttggttttttgtttgtttgtttgtttttctttaaggacttgtaactctttagcagtgttctcttttatttctttaagtaagttattaaattccttcttcatgtcctccctctaccatcatcatgagatgtgcttttaaatccgggtctagcttttccggtgtgttggggtgcccaggactgggtgagatgggagtgctgcattctgatgatggtgagtggtcttggtttctgtttataagattcttaagtttgcctctcaccatctggtagtctctggagtcagttgttatagttgtctctggttagggcttgttccttttatgattctgttagtctctatcagctgacctggaagactagatctctcctgagtttcagtagtcagagcactctctgcaggcaagctcttctcatgcaggaaaagtgcccagatatgtgatgtttgaacctgcctcctggcagaagttgtgttctactcaccagatacctaagatcccatggagactgctttggggaccttggggttgtccactgactctgtgcccaaggtgacatggtgctggggccgactggaacggacttgtgaccctggtcagtcctggttttctgcttccctaattaatgctgtctcaggtcccgcaagtttggattggaacagaagttgtgttccaatcaccagaggtcctaagatcctgtggagagtgctctggggacctgggggtgtctgctgactccgtgcccaaggtggcctagtgctggggctgagtggaagggcaattcttattatttctaaactactttttgaaaactgtttcacaaatgacttcaaactgttttcagtagaaatcaatgaacacaacatgtatttggtttgcttgttaactctttgtaaattttgtgcccggtcagccttattcatttagtgtcttttcatatatgacttctcaa

SEQ ID NO: 4714 - DNA, 1200 bp, mus musculus
ttagtgtggcggttactcagggagatgggaattgatctaactttaaggtctagctatatgactcttgggtatatacccaaagaatgcttcatcttatcatagagacacttgctcaaccaggttcattgctgctctattcattttttattagatattttctttatttacacttcaaattttatcccctttcctcatttcccctctgaaaatcccactatttcatcctccctccccctgcttactaacccacccaccactactcccctgtcccgagattcccctacactagggcatcatgccttcacaagaccaagggcttctcctctcattgatgtccctctgctacatatgtggctggagccatgagtcctttcatgtgtactctttggttgatggttttgtccctgggagctctgggagtactggttgtgtattatagttaaaatagtactattgtgtgatgttactgggtgaaatctcattattagaaaagttcctgctataactatagtacttgactgtcatagggctgaaactggggtagggccttctatggcagatggaagttatgaatggaagagaagaaaggtaattagctctcaagctaccatctgcatggatatttcagctaatgtcatccccactgggacctgggagcatcttccatccctgtagtctggtactttcgagtggtcccccccgccttgttcctcatccctactacttatttctattccctctcctggccctctggacttctctcctgtctctttgcacaactggtcttgcttacctttttcccctacccctccactctcccaaccaagtcccatcttccctctgtttcccatggttatttttcccccttctaagtgggactaaagcatccactctttggccttccatcttgttaagctctgtcagcagtaccatggctattctgagcttttgaattaatatccacttatcagtatgtacataccatgtatgttctttgcggtctgggttacctcactcaggatattttctagttccattcttttgcctaaaaatttcataaagtcaccacatgttctgtatccattcttctgttgagggacatctgagttgtttccagattctggctattataaataagggtcctatgagcatagtggagcatgtgtccttgttatgtgctgaagcatcttttgggcatat

SEQ ID NO: 4715 - DNA, 1200 bp, mus musculus
tggatgggacaagaaaatatcctgagtgaggtaacccagacacaaaagaacacacatggtatgtattcactaataagtgtatattaaaaaagtgatatacacttatactaataagtgtatatcaaaagctcacaatgctcatgctacaaggaatgataatcagggtgtggaagctttagtcctgcattgaacgggagcaggaaaattgtgggaggtggaggaagagggggactggggagggagaaatggggggaaagaaataaatgtggcagtatcaagaaccagaggagatgggagagagggacagagggtcaggctatcaaacaaaataggtagcaggggggatgaggaactgcgggtcccagacaccagggaaatgtgacattccaggacccacctgggatgattttagctgaaatgcacagagaagggggagatagaccctgttgacacaacctttagtagattcgcatggcccctgctcgagggatggggccacccacccatttcaaagtttttaatccagcaatgttcctgtccaaaggaagaacaggaacaaaaatggaacggagactaaaggaagggccagctagggactgccacacctggggatccatcctgtctgcagacatcaaactcaaactgttgtcgtcaagaggctcttgctgacaggaacccgaggaagtctagccagcaactgaccaatgcagatgtggatgcttggagctaaccatgaggctgaactcagggaacctggtggtggagctggcagaaggactggaggagcactgaggggttgcaacctcactggaagaacaatatagactagcctgaccacccagttatcccagagtctagaccatcaaccaaggagtgtacctggagagatcgctggctccaaatacgtatgtagcaaaggatggccttgcctgaagcccttggtcctggggacgttggatgccccagtgtaggttgatgctggagaggtagtgtgggagagtgtgggtgggtggggggagcactctcatacagaaaaagaggagtgtggagggtggatgtgggatggggagcttggtggaggaggtaactgggatatcatttgagatgtaaacaaatggaatcattaatacaaataagtaagtaagtaagtaaataaataaataaataaggaccaaaaaaaaaaaaaagaagaatggatat

SEQ ID NO: 4716 - DNA, 1400 bp, mus musculus
ttcctcctttgtcttcacagacatctagatctttaactagatctggtgaaattatccctggatactttgtgaactaccattagcatcctagcattagtgaatgaggtacaggcatagtcatcttttcatataagagaggctgtttgggttagcctctcagagcaagtggtaagacatgtgtaccttctttgacaagagaattttttttttttaaaaaaaggaacaccgtcttaaagcctggcaggtcttcaaattctttatttgctttttaaattagaaagattgtggatagtatggataatttctaaggaatatttgagattttacagctgtggtctaaagaagtcacaggagaggccattacatgtccagagtcaagaaaggtacaaagctttgtttgcagtatgctgtgaggaagaatcacacaattattaaactgcagctgctcttcttttttttcccaaagagactcaatagaaatgtgatttgttctcacaatagtcttcaacctgtccatccattcaccttaaaggtgtttaccatacctcaggaaaaaaaaaaatcagccaacagtgtactgtacctctgaggagtcaggtcttcagcgaagtcccatgcatgtctcacgtgagtaagaaggaactcggctctttccagacctgacacagtagcatgggaacagtgggctgtggttttgtttggctcagcacaaggagcatgtctcatgaggagagtgtctccactttccttctgagaaaccaagtcgtgttgctcgaactgatatcatgacaaagctctggcaaatgacatggggactcagtgtagttttgtgtcaattatgttataaattatgcagctgttgagtgttgtttttcttcccggaagaaagtgaaaattacccagggagagcaaatgggaagaaacagcccagtgtagtgatgcctttccctcatgtcttctgaaactcatttattgcaaaaaacacttgaagccaagggaaaatgattttgtttctcagaagtagcaaacctaaaaacagtaccaaaacttggtttcttgggccacatttctacctttttcccctttttgttagatgtgtcattttggatttatggagatcacagggatatgccaacaatataaaacaatttttaaactaagagttcaagaaggaaggtaggctgactccttgctgagtctcaatcttcaaacagattcctgcttatagaagttgattaatgtagatgttcaagatgtgacactagccaatactcggcatattacacctttgagatattcttagatattctttctctgatgttttcttttacaaatactgaatttaaaaaaactatacaaaataatgtttttctctgagagatctgttaatatagtgaatg

SEQ ID NO: 4717 - DNA, 1400 bp, mus musculus
gccagtagaaaagaaagaaagctatgacagaagttttggagtttgtcagtaactaaaaccagtgagatactattcttctagttatctgtggtacaggaagcgagaacttattactcctttgtaaatgtatacacaacacatttgcataaacagtcttgataggcagtattttgcattctcaattagtgatacaattatttaataatatgagtggtttctcctttaaaggagtttgcatgaaaactacattgtagggtttgtctttatgggcattatggcatattttttgggaattatgggcatattgttgtttcagaagaaaattccttattcaaataagcagcatttgtctttcacatctttccctgtcaatgtgattctaaccagaagagctgatgggtcttatacctaagaggacaagagtaacccgagcaatgagaacagggagaactcagctgaaatggactcttagggtgggaacaatgggtgggagcagaaccctccaacccaaccatctggcagccaacacacacctggacttctttatgtttcatcctttgactgacccttttacctttctcaatgttgctattcaagttaaaaacaagtgctgtcagggaacagatggacttcactccaggctggggagagcaagtaagacataatgcaaggtgttcccttatgacctggaggtgacagcaaacctgatcaaaagggagctttctctctagggaggagaggtagtgcaggctcttgttggctcaaaactccttgctaaaggcagccagttcagcggcagttttaaaggaaagtcctccagaggatgtcctgaagccatcaaatccagatcccgtggaatgcctcctgggatccaggcactggccaaaaaacagaactgaagtagctgtttccagcaatttgcagttctcttaaatatgaggagaaaaatacatggagacattttagctcagcgggctcttcagcccaagaccttagagaagtttccattgctgccaagtgcattgtatgactctgcatgtaaataggtgctccaccatctgaaacatttcaggactactcaacccagtccgagagaataaatccatcctgggctaaacggtaacatgtaatatttattgaaaactttaaactgtctttccaaattaatatctgattcaaaaaggagccaaacgtggaaccagccatcaggatatacatgcacatatattctattcataaatctctcaaatagaagggattaaacagccttcacctctattagagaagtttgaggggtctataaaagctgaaatgtattaaccgtctctatgaaaatttatatataaacatagctatgggttaaatcaagctctgggcctaatgtggaatataaagtactc

SEQ ID NO: 4718 - DNA, 1000 bp, mus musculus
caaaagccaaattcaactacatgaattaaaataataaaacaagcatatttttattactaattattcgtttacatttcaaatgatatcttacttcccagttaccactaacaccatccccccactccatgatatcaaacttcctggttacccctctgccattcccccccccatcccacatctgcccttctccttcccttttgcctgtatgatagtgctctcccacttatcatcaccctcccgccccatctctcgagcatagcattcccttactctgggacatcaaacctccccaggaccaaggaactcccctccaattgctgtcaggcaaggccatcctgtgctacatatgtatctggatccagagatccctttagggtacactcctttgttagtagtctagtcttagtgagaactgggtggtcaggctattctatgctgttcttccaatggagttgcaatacccctctcctcctccaatccttcttccagttcccccagcaggtttcctgagctcagcctgatggttggctccaagcatccacacctgcattggtcaattgcttgccagacctccccaggaactgccacacttggttcctatcagcaagcgcctcttattcactgcaacagtgttgggtttggtgtctgcagacatgatgtatgtctaggtggggccgttccctggttggctcttctttcagtttctgttccatttttgtccctcttctttctttggacaggaacatttctagcttaaaaaaacctttgagaatggtgggtagttccatccctcaaccaggggtcatgccaatctactggagggtgtctccagaggttctatctctcccttctctgagcattatggctaatgtcaataccattgggtcaagggagaattacgttgctctggtatccacagcacatctgaaatttctagaactagaagaagcaaatacacccaagaggaggagacagcaggaaataattaatctcgggctga

SEQ ID NO: 4719 - DNA, 1000 bp, mus musculus
ttctctgtatagctctggctgtcctggaactcactttgtagaccaggttggcctcgaactcagaaatccacctgcctcttcctcccaagtgctgggattaaaggcgatcgccactatgcccggctgacagtgtgattcttaacataagggcacaaatacaaaggcacccaagtcaatagaggaagcacagctcaaatcacagattgaccctcacacactgataaagtatgacttcattccaattcttaccaatagttaggccatcagacaaaaattaaacagaaatgcaggagctaactgatgtcataaaaacaaatgtacctaaccaatatttacagaacttttgactcaaacataaaatggttcactttcttctaaacagcatttagaagtttctccacaattgaccacatactcagacacaaagcaagtctcaacagatacaaggaaactgaaataacatcccacatcccatctaatcaccatggataaagctaaatagcatcaaaaacagggacaacaaagagcttatggaaactggaaaaaacctctctactgaatgaaaaataagtcaagaaaaattatttaacgagaggcaacccaccctaacactgtcaatgatattctgctatacttgcccattggagcctagcataactgtcattggagaggcttcacccagccactgatgaaagctgtcattgacccacagccaaacattaggtggagcttgagaaattctatagaagaatgggaggaattattgaaacatcaagagaggtcaagaaaaaacacaagaaaacctactcaattttaactaaccttagtccatagggactcgctgagactaaactaccaaccagagagtattcatgggatagacctaagccctttgcacatgtgtaaggtttgtgcagctgggacttcatgtgggactcctaaagtgggagcagaggctgtctctgattacattgcctacctttggatccctttcccttaa

SEQ ID NO: 4720 - DNA, 1000 bp, mus musculus
tacattgctacaactactcagacatgtatcttctttcaaccgtgtggacgtttgaaagtaatgaaaaataactgaaaaattttaagagttcagttaaaacacgaatgggagacagacgcaaacaaaatataaatggcagagcaatatgatgcaaaagtaaatctcagacaattttcaagattttcagagattggggagacgatggtagtgatagggagatgaaaaccaaaacagcagcagcaacgcacaacaaactggggtcataaacagcgaccagactacaaggaatgggggtcatgggcaaagttaaccaacatggtgatttttaaaacagagtacagatacagcgttcccaagacactaggtagatatttgtttatattaaatttttaaaataatttaacaagaggaacagcaagatggtggaagagttcctctaatgttttccccattttgagcaactacgttcaaaataacttgctttcttgggaaagtggatcaaagcaattcaaggtagcagttaaagacagaacagcaaagaaacactgctttctggctcaattcatctagttggcccatacatatagagagagtgtgtctacatgcatagggatggcaccttgcatgcgctgaacccttccatgccaatcaatcaataaaatgccccatagtggtattgatttgctagctcagcaattaagagcactttctgctcttgcagaggacctcagtttatttgccagcagacaaatggcagcacacagccatctgtaactcatttcagccaatccggattcatcatctggtcatttcaggtcccagacacgcatttggtacacttccatacatgcatgcaagaaagaaagaataaaagaaaacactaagacacataaaatttaaaatatgttttaaaaagaagaaagggccccatagacattctctcacaggacaacctaatgaatgtaattgaggcttcctattgctgggagactctatactg

SEQ ID NO: 4721 - DNA, 1400 bp, mus musculus
atggggggcttttccctggagcaaaaaccaatccttccatcaatgcttattgtaattgggtataggcttgcagcaaagaatcttcatttttgtcagctaacaatatatcacccatataacaaactatataaacttgtagatatctttgaaaatcttgaggcttttgttgccaaagccaaaagtttttatatagttttccccttcaaggaagtagccatagccaattcttgagtacaggatagtcctatatctgtgcataaatggatatattcagaaatacctacattctttctatgtggtcaaattgctgcttgacagccagagtttgcattttcatatgctagatggtttactagtaaaaagccagcatcagaattatgaaaaattctgccagcagctatcagaagttcagagcctagaggctcatatggcccttgtctcatttttggtatgtcttgatgaagcatttcttttgtagatactgcacttcaagcattatgtgcagcagtgttaatctatgcctagatttccaagcttatataccaggtgctgggatatctttgcttattgtcctttggtcagcatttcataatttaccccagcattattagcatgggcattcacttcagcaattctctgacaatgctcaaaaaatttcttttttccaaagcaggctcccctgctggctgtttccaatcatcaggaggtaaggcatctgcagctaaatcctcaagtatagccataatgaaaggcccatattgggcacatgcagctttaattccttcaattatttaataagtataggttgattgattttaacatgattgccctgtgcatacttctcaaatacaggacattgtaaattaaatccttatatatcctctaattgatttacattactctgcaattcttcctgcgatggggacataattttcttattgaggaaaatagcaaccccccccattaatcttagggcacatcaatgccactgaaggatcctgtctcttcataggtggatctagacctgctctaatattaggattgatactatcctcttcctcctcctccttttcttcagtctataacttccctaaatatattttttttctgttaaatgggtaagactttgtatggatttttgaagttgctctttctgttcatccttatctttatgtctgcaagttactgcaaaaacctattttgcagcttctttctctaagtcttcttcctgaggatcaagaggctcctctttcagtcttgttatatagcccttttagcatcctcacaaagaggagggggagtaggcttggtagtgctatctttgtttaattttggcctatcagtaatcactgctagagaatctaacattgcttggatattttcttctcatgcctagggtc

SEQ ID NO: 4722 - DNA, 1600 bp, mus musculus
gctaaagggatctgaaaccctataggtggaacaacattatgaactaaccagtaccccggagctcttgactctagctgcatatatatcagaagatggcctagtcggccatcactggaaagagaggcccattggacttgcaaactttatatgccccagtacaggggaacaccagggccaaaaagggggagtgggtgggcaggggagtgggggtgggtggatatggggtacttttggtatagcattggaaatataaaagagctaaatacctaataaaaaatggaaaaaaaaaaggaaaaaggatgatttaggctttgaattagaatacagaaaacaagacagacttagcagtgaagatctgtaagcaactttacatagggagggactttccaggatggataaggacattgccttgtgaatggggataattatccttcccatcttcttagcctgccttctgtaagccagcatttcctgagtggtagtctcttgatcatgtaattgacaggcctggatttctatatttcaacccagggacagaagtaaaactcatatctcatccttttgtcagaaggtagtaacttcctcctaaagagcctggataaagccttgatacctccatctgtaaaagttttggctctgagaggaaaggcttccccaatggaagttttgctgctgtgagagaggtttcctcagtgtgttatacctctgaaggcacaggtatcctggcattgggagctaaggaaaagaacaaagccacactgcacaacagagcacacacagatgagagagacacaggtggtttgcctctacttaggcaagaagcagcaggagccctaagcaggcaggctttcatagagttctttgagggaggagttttctagggtggagatttgcacggtgaggattggcaaaatttcaagccaagcccagggattggtggggttttgttcttacagactggtgtgttttggggtgccaagattggtgggttttggttggttttcaagtctggaagtaggcttggacattttaccctataccacctttacataaggtaagtgagatgttgagcttaccccagctatgaaagcccatcctcaaaggccatcaagcctgtttagctgtcaactctcacagttggtaagatggtcaagcttctgcatataatttgtcatctctgctcctacaagcagccctattaaaaactgttgttcttgccaaaagcaatctacagattcaatgctatccccatcaaaattccaacacaattcttcaacgaattagaaggagcaatttgcaaattcatctggaataacaaaaaacctaggatagcaaaaactcttctcaaggataaaagaacctctggtggaatcaccatgcctgacctaaagctttactatagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtttagaag

SEQ ID NO: 4723 - DNA, 1000 bp, mus musculus
catggccaaatttaagtctaaattaagaatataaaaaagtggactggtaagatgggtcagtgggtaagagcactgacagctcttacgaaggtcctgagttcaaatcccagcaaccatatgatggctcacaaccaccggtaatgagatctgataccctcttctggtgcttctgaaatcagctaaaatgtacttaagtataataacaaatctttgggccagagcaagcccggcctaccagagcccactagagagagcagaggttctaaaaagaaaaaaaaaaggaagaagaagatgaaaagtatcaaccttaataaaattcacagaaaatattcatttgtttatgtagaaataaattatgaatagtgtcttagttaaggaacagacaccatgaccaaggcaagtcttataaaggccaacattgaattggagctggcttaaacggttcagaggttcagtccattatcatcaaggcaggagcatggcagcatccaggcaggcatggtggaggaggagctgagaattctacatcttcatctgaagactgctagcagaatactggcttccaggcagctaggatgaggctcttaaacccatgcccacaggaacacacctactccaacagggccacacctcctaattgtgccactccgtgagcagagcatataccaaccatcacaaatagtccttttcaaggttcctgtaaatagtgaaatcaaagggtgtgacttttgcaatattacatgtagataggtcatttacaattttagtgtatccctcaaaaattgaaggaaatactattgcttataaactctttttttaaaagtttgttagtattttaatgaggattttttaattaggtattttcttcatttacatttcaaatgctatcccaaaagtcccccataccctccgcccgccgactcccctacccacccactcccacttgttggccctggcgttcccctgtactgaggcatataaagtttgcaagaccaagggg

SEQ ID NO: 4724 - DNA, 1000 bp, mus musculus
acccacacacacatacacacacacacacacacacacacacacacacacacacacagcaggacagaggaaggtggatgctgtccttgctgagcagtgtctagccataggtggtccccaaagtcatgtgcatcttggccctctattcttttaagctgacagattctctaaagcagggctgtttggcttattggtcttcctgcctccagggctgtcctctgggtggcctacatttattactggctagagtcctggacagagtcccagaaaggactcaggcaacctcttcctcttgcaggtgggtgcagctgttgattgccacagccagaactttcttctgtgttgaacagaaagttccacgatgtacccagaaggggactgtgggacagttcagttcctgtgacagtaggtatatgtacgtatgtgtgaatgaatatatattcttcttcaacttgttcttctaaggctgacaaaaatcagaacaagacagaaagtgacccacataaagtatttatatggactggagtggagcacaatgacctactttctctagacaggctaggctaagtaacatttccaaaacttccccaaattgtactaccagatcaaaaataagaagaaaaaacatgagtctataatgatacttcattctgttttcaatagattttttatgatttttatttatatgcatccatgtgcacctatgtaaatttgtccaggaacacatgaaacacaaaggatatcaagtcccctggagctagagttagaggcaactgcttgctctgtgtgggtgctgtgcgacacacacacacaaagttaattaacagtagtgtttacagagactttgaaaatgtactctcatatttcttttcagaaattcaggttgaaaacctaaggaaaaaatttctaattgtcttttgtcattgttagttttccttgtcaattcatcacaatctcaaatcacctagaaaattttcacaatctagaattattgaggcaattg

SEQ ID NO: 4725 - DNA, 1000 bp, mus musculus
tgtatttgtcaggctctggaagagccttgcatgacttgtgtgtgtgtgtgtgtgtgtgtgtgtgtgtgtgtgtgtgtgtgcatgtgtgttttcgagacagggtttctctgtaaagccctgtctgtcctggaagtcactttgtagaccaggctggcctcgaactcagaaatctgcccgcctctgcctcccaagtgctgggattaaaggcatgtgccaccacacccatttgttttgtttgattttttttccccttccttaaatttttatagaactcaccaaggaagatatttgtgtctgaaattctctttgtgtgatttatttttatgtacaaaaagtaagtagagtaaaaagactatgtcagtcaggagcatgttgccctctgagagtctccacccagcagctgactcagtcagatgctgacacccagagccaaacagtgaatggagcctgaggacatttatggaagaataggagaaaagatttccggctcaaggggataggaactccacaggaagaccaactagtcaactagccggacccttagggctctcagaatctaaagcaccaggtgaaaaacatacacaggctggaactagcaacacctcgccccgacccccttcacttatgtagcagatatgcagctcggtcttcgtgtgggtccggaacaattggagcagagctggactatctcaaaagctattgcttctcccagtgtgatacattcctccagctgggctgtctggtctcagtgggagaagaagcaactaactttgcagagccttgaagtgccagggttgggggataaccagagggtctccatttgctcagaggagaaggggaaggagggatagaggaaggattgtgggaggggtgactgggaggggccagggggcaggatgtaaagtgagtaaggaaaataaataaatactattatttaaaatgtcttgttccttgcttcatagtctgtaatttataagaaatatactatatcccctaagtt

SEQ ID NO: 4726 - DNA, 1000 bp, mus musculus
ttttcagggaccctctgagtcagccactcagagctgggaatcgatgcaaaagcaagaggaatttattgctccagcatgctggggttgtcccagacccgaaggagaggcagagaccctgggtgagtttttatacagttttcaggggtagaatagagcaacagtaattaggcaaaatgtgattggcagaacagtggaacttttaaactgattggtccttagggaatgaagcagccaggggtttccttttctgtgggtagccaatggtcagtctgccctgaggatgtgagttttcctcatctgcaggtggctgagggtctgtccccactgtggtctgaggaatgtagtcagcctctcctctctggagggtaggggtgcctatgtgctctatgacctttcttttccaggaaggtagcggtcttgtggaattttccaaagttcctgagctgacctattcacatactaaagaatatggtcagtcctaaggcatcaacaaagtagtcaaggaacacccaggacatacacagagttgttaatggacagacaaagcataactgtacatagaattttgactgactggtggaataaaatattcttgttgttcttaccagttatgttttgtgaccttttagttagccagcagaagggagaagataaaatataaattcttaccctaatataaggtaagaaataatatattctaacctaaaagatagtaattgaaaaagcaaatctattatattcttctttaaaaaaaaaaccttgtaaagtaataaaattgatccagaaattgctgaaatatggcaatttgtaatacacctttgttagcaagtccttcagactttagctacttctggcattagacactttttatagcttttgattttattttatgtaataagattgaaaatttggatatctctgttttgagaaacttaaatacacatgcttattgttagtagaatatctatgaaaatcattttattctttattttccagtgaa

SEQ ID NO: 4727 - DNA, 1600 bp, mus musculus
gtgtgatgccgtcagaaagcatccaggtcaactctgattatgtaagataaattaatatccctgtattttctaataaatgtagaatgttggaataaaggaatccattcatataatgaaataattatatgctggacactatgctatgtctgcagatgtaaaatttagtcagaattttaagaataatgctgccttttgggatagattgaaaaacatttcctgtccttgtattcagcattttacatttaagaaaattgtggttcatattcaggtaagagctatgtgatatgttttctatctgaacaaattagcattgaccttgcatagatctacacatatctttaaaatatatcgggtatttttttttttttggatatcaaagtctattttcaggatatttaaaattaattgttacaatatgctttcttaaataaaaaggcctttcaataggctctagaaaacatactaatggaataaaatttcttacaaaattaatcatttttttctaattgtaagataaaatatggtatcataatcaaatagggaaattcattacaatttcacttgtgttaattcattcaagtaacatcctaatttgagatcatagttctaacagaaagtggtgagacacacacagacagtgcttggctttcctgactgacttggatatttcagtaatcaacagtcatgacattgtcaaagaggccagaggaggacattggacaccatgcagctggagttctaggcagttgtgagtcacccagtgtgagtgctggaaacagaatccaggttgtgtgttcataactgcggagctgagccatctttccagcctcctagaacaggaatatttctatcaaagacaaatacataagaaatgactcatggagtcaggaagactgtctccgtactatgcatcatctgttcagttttgtcaatggagaggacaaaaccatgataccaaggagaataatacagtgttcaaagggatccacagctctgtccagtccttcttttattctcagtgaagaagtaaccctaagagcagtgtccggtgcccctaaagctactttgaatacttcacatccggtcgaaatgagtttcccaacacagctatacgatagatgaacactttaggcatatggaaactttttagaaagaaatactaattctatgcttgcactgtagcataaataactagagtggagatgagcacataaagtctggtaaacaacaaggctgggatataaaggtgctgcttcccctaatggattatgtggctctgaatcttcaaacacctctaatgttagctctggggctatggctttctgtacaacagttaaaatagtcagaatatctctttagaatttttttttagaaggaagtagtttggggatggtgaaaagagattaagcaaagaattgtaaagaagtgggcttttctgttgtttcttgttgttgttgctgctgttgttctttctttagtgaaggtcagaatagcagagtaaactgatgtgtcaacatagaaatgaaataagttcatgaagagggttaactatgacagctatctgggagttttaactatttacttaattttttatttgtat

SEQ ID NO: 4728 - DNA, 1200 bp, mus musculus
aaaaagtggctattagtcaaaaaaataaaaaaagtacagaatacacaaaatacagtccaaggaattcaaaaaggtcaacaagctgaaggatccaagtgaggatgcctcagtaccatttggaaggaagaagaaagcagccacaaaggggggggggtgtctaggaggaaaagagggtggggtggggagaggggaacatgatctggcattgggtatgggaaaaggactgaagccaaaagggccacagaaagaatggaaacaggcaatcttgagaggtaggaagtttgggggaccctccagaatgtaccagagacctgggaggtgagagactctcaggacacaatgggaagtaccttagatgaaatgccctacagtggggagagaaaacttatagagcctacctccagcagaaaaacagcatcaagtgaaggatgggggtcccctcccagagtcacaactctgacccataattgtcactgtctaaaagaactgcagggtcaaaggtggagaagagcctgaggaaaaggaggtccagtgacaggccaaaattgtgatccagctcagggggaggcttcaaggtctgacactgttactgaaactatgatgtactttcagacaggagcctagcatggctgccctccaagaggcccaacaagcagctcaaagagtcagatgcagatacttatacccaaccaacggagagcagctgctgaccgctgtggttgaattagggaaaagctggaagagacttcggcagagggtgaccctgtaggagaaccagcaatctcaattaacctggacccccaagatctctcagacactggaccaccaaccaggcagcacacaccagctaatacgaggtccccaacacatatacagcagaggacttccaggtctgggttcagtcagagaagatgcacctaaccctcaagagaccagagaccccagggagtttagaagtctggtggggtggaggatgggagagtggaaacatcctcatgcagacagggggttgggaggaggtatgggatggggaacagtcaaagagtgtgtgctgggggtgggggggagtgatgaataaaatcttgaatgttaaaaaaaaaagaatacctacttggatgatgaaatgcagttgaatatctgagtgtaaagagccaattttacatgattcagtaacaggaagcaagaagaagatgcacagcc

SEQ ID NO: 4729 - DNA, 1000 bp, mus musculus
tggtatgtactcactgataaatggatattagccaaaaagtacagaatgcccattatataccctccagggacccaaagaagtaaaacaagaaggaagacccaagtaaggatgcttaaatcccacttagaagggggaacaaaatagtcatgagaagcagttacagagagagatcaagatgatagtggggaaagtgagggttggaggtggggcaggatcaagcatggggagagacaggacagaggctcggagggtcagaagaatgaatggaaatattcacctgtagggggtttggagtagggggaatctctaagaagtcccagagacataggatggtaagagactcccaagactcaatgtgggtgatattaaccaaaaatcacaacagtggggtgatggaacctgaagacacagaacccccagtggatggatggggacactaactcaactaaaatatattagaccacaatatattgctcccatctaagagaaatgcagggacaaaaaaatggagcaaagactgaaggaatgacctaccaatgaccagcccaacactgggatccttcccacaaatggggcaccaaaccctgatactattactgatgctatgttgggcttgcagactggagcctagcatggctatcttctgagaggctctacctaccagctgactgagactgatgcaggtacccacagtgaaacatgggatggaggtcagggactcctatagaagagttaggtcaaggatggaaggaactgaaggggattacaaccccataggaagaccaacagtatcaactaacctgtatctctgggagctcccacagactgagccaccaaccaaagagcacgtatgggctggtcctagacctcctgcacatgtggtggagagggctgccatgtctgatatcagtgggaaaggatatgcctaatcctgtagagacttggtggagggataaggtaggagccctcttaaactttaaggggaggaggagggagcaaa

SEQ ID NO: 4730 - DNA, 1200 bp, mus musculus
aactttcacaaggcatttagatcaaagggagacgaaaactatatgccaatgctaaagttaaatgcatataaaatggtggtttggaaaggaatctatccactttgattgaacaagaaaatcagctagtagaatttgttatcatgaaactttgcatcacccacattttctgaaagccttcaaccagtgtttgtacatttggaaggaaaatttactgtagacttctgtcctatagacaacaatccccaacttgtacttcctagaacttgaatttttaaaaatattttagttctgtgcttgttatgaagaaatcaaaattatgagttgagagaaattttacagctcacacaaacttatatgaagactggaaatctaggaacatgttatagagtcaaaaggtttttctcaccatagcatcagtaacagtgtcaggccttggggcctcccgctgagctggattccaacttgagcctgtcactgggcctccttttcctaagtaatttttttcctgttgtatttttttttgtcctgtctggcctttgttgcttgcaagcctgctcttttctaaagaggaaatgggtcgggggaggcagtggatgtgaggttaaaaggaggtgggtgcagctggaagcagtggagggaggggaaactcaggtttggatatattgtatgagagaagaatctatttttcaataaaataacaaataaaacaagaaaagatgaaaatatacatcaaattaaatatatgacatggaaggtaaagtacaaaagtatattgcatttcattgctaagtataacaattcagttgtgaccttcaattattactctgtatcttggttgaagtgaaacatatggaaaagaggagttctgaaacccagagggaaagctctgaactcatacttctcttactaattctcaagaggaaaaatccatactgtgatgcaggtactgcttcaaagactcgtgtacttgctgactccatggctttcacttgagctttgagattggacttgcaggctttgagctctgcttgcctttggatatatcaggagcttagcagttatctatcctgcactacggaatagatcctaactctcccatggagtgtttcccctaaggtaataaaggccacatgaaagggaggaaggaacaatacccttctgattcagaaaagacttaagacagatgtgaggcatatctca

SEQ ID NO: 4731 - DNA, 1400 bp, mus musculus
attctgctttgactaaaggctttgactaaagccaataaatatttatcagatttctgagacatttctaagtttaaaatagctgagttacatgaattcagtttgggatcaacatttgagtcacaagtatgttttgagaattttggaaagagaagcaaaaaatattacagaagttgtaggtgttgttagaagtattatttttttatttgtaaaaatgactttaaaaaaccttccaatttaggatatttttatttaaattttagtgactaacaaaggaccaatttataccatctgcttcatttacactcaaatgtagatttttctctctcattttctccttaaatagacattctatttggcacattttacttaactacatgtctttgagtgaaaagtgtagtttgtctgactttctatcagaccaatatttattcacaaatatctgtttttgttgctttctcgcatgaagtcatataccacgtccccctgtggagagctggctcaggggcagtatgcggtgccagctggaacgctgacagttgggtgtgccaaaagtggcatgatggacaattggtcgcttgcctttagatttaatttcatgatgatgggtgttactggtacaataactctgagtacttcctcttccagtctacatgcacatatgctgagtgtttagttaccagtgaccaaccaatactttgtagccattaccttgttgacttatataccagaatcagagacaaattgacaaccaacctctatccatttgtaagctgagactcccatgtttgagaagagcttgccataaggtactgggcacacagtacatttggagaagaaaatgtcaggctgaggtcttttatttctaaatatgctgtatgggaaactgttgctgcacaatcccagtgtgtttgtctctgtctgtgctttagaattctgtgcattagagcatcaccactgcctctcctgactctgctacaggataccttggcaatttacaaaattatcacaaagttcttttttctatgtttggtcaaattcctgatgaaaaacttaaagcttcaagagtgggtagtaacactgacaattagtgatttccattaatgttattatcttcacaaccaatcttcagcttatatgacaattggaaaacaaactaattttggctttgattgtttgaataattcacaatctgaaaaaaatcacaaatcacagcacaagagaagattagaattgtatctgttcataagattacttctgtttactgacaagtaaatcaaaacaaaacaaacaaataaaaatcacctctaatcaacagcaaaatataaatgaaataacttatgtgcacagactaaggatttgatacaaaattatttactgaataacaaaggaatctttaaaaa

SEQ ID NO: 4732 - DNA, 1400 bp, mus musculus
atatttggtcattaggtagtggtactacttgagagagatgcattaaatggtatgtccctgctgaagaaagtatatcaccacatttgctctctgtgatttcaatcttctcatcaaaaaaaagaaagaaagaaagaaagagagagagagagagagagagagagagctcagcttccatggtgagttggatggaagctgatgtgtgtcatggtgtgtcacgcagtataaccttttgcccaaacagctttacttggaaatgttcagtgcaatgagtcattgatgtggtttgaggtctttggctcctgctacactatcaaactatcaataatggctctttgccaacacttctctcagacaacctgccttcttcacacactccagcagtttacagatgaagtagatgttagaatgggccaaatcggtgtcccgacagaggtggtggtcaggaggccgcatctcttctatgcccatgcttcctcatttcagacaagtggctgggccagttctctgtagctccctggggtctggctccctcatgcccctgccatcaatgttagatcaactcttctggctagagaaggtgcaacagagtactctctggagagagtgttgcagtctgtgaggggtaggaccagctctgctcaacatgctcccaggaggcaggccacgccagggacatctgaatgagctttgatggtaacatgagtgagaaacattgccacagtcccttgctgctacaggaccactaacccagacatggccctcagtacgtcttcaccgtggcctccggtggcaaggcaggtattcacatctgtctattcttctccatccttgcatctccagttctgcctcttttcagaatgttcaaacccttttttgtctctttctcctccatctctcctcaaccacatacttgcatattgtggtgggtagctccttctgcatgtggctgggtgacaggcaggcctctattctcatccacctacccttatcacatggcaggtggttgtcagatctctgggtgtcttttgatttttatttttaaataaataggatacactaaattgagtctatatggagaaggggttagatgtgagagaagttgtggttgctagtaagcactgtgtgaaaagttcagctggaagaacatgtagaggggtcatactatggatgtttggacaaagtgcaaatatgaagagtattgtgctctaagaaacactataggcagaacagcaagaagacaatgtctaaaacactgttgtgtataaactgtttttaatttcccctccaagcactccctatagtgagtattgttaaaggatggaaatttctaatgtagccataggaggtaaagcatcaaaaccagaatttttctgagattaatatatatattaaggcaatat

SEQ ID NO: 4733 - DNA, 1000 bp, mus musculus
attgttgtttggtctccatattctttctctgtccctgtttcttattgggatttaaagttatggtttagtgattcgaactggaggatacttggtatggtggcttgaatgagaatggcccccaaaggcacttctatttgcacacttagtccccagatagtagaactgtttgggaagaattaggaggtatggctattttgaagctggtatgtccttatactagggggtgtgtctcgagtgagctttgcaatttctaaaacctattccaggtcctgattatttctctctatctctttctgctacctgctgatccatgtggaaatttctcagctataattccagtgccatgcagttctgcttcttggttatggtgatgattaagagcaataaacagtaactaaacacaagcgatattagattagataatttttatatttcttagtaaattctattaattgcttgttttgtgctacaaataacaaattaaaactacagtaaacaacccaaaccccagcctacttggtcccctgcaagtccaatagccttatagtctgccctgtcctatctgcactccagcttctgatccaatcctctaaccacaatcccagacatcttcagacatcagcaaatacaagaagagaccccctacccaaattctctgcctacctgtcactctggaaaaacacagcagcagcaagctccacccagcctcctctgcacttaattttcctgggatcaactatgaatatatctatggaatcttgctgctgtccaggaaaaatggaagactaccaacaacagggaccatgagtactacctacatccctgaggcctgctaccaccttggaaaaccaaaattctgaaaccaccaaggcctaccagctcagcctggtaatagtagcatccctgacaaactactgccaccagggacaaaaaagctctacctacattcccagaggactgctgacataagggactagcagctctgtatacaacagcagag

SEQ ID NO: 4734 - DNA, 1400 bp, mus musculus
aagcatggtaactttgccaaagaaaatataagaaatatttccacaccagtagaatcaaaagaagagaaacacacacacacacacacacacacacacacacacacacacacacacacacacacacagtaccatcaccaatatcaaaatatcaggaactaacaataattggtccttaatatctctcaatgtcaatggattcaattcacccacaaaaagggacaggctaacagaggagagctttagcaggatccaacattctattacatataagaaatatacttcagcagcaaagatacaaattatctcatagtaaaaatcagggaaaagcttttctaagcaaatggacccaagaagcaagctggaatagcaattctaaaatctaaaaaaatcttgttgccatatgcaatagtgtctgggtttggtggttgtttatgggatggatccctgggtggggcagtctctggatggtcattccttttgtctcagctctgatctttgtctctgtaactccttccatgggtattttgttccccattctaagaaggaacaaagtatccacactttggtcttccttcttcttgagtttcatgtgttttgggaccctgatatagctatctcttgtgaggctatgccaatgcctagcaaataaagaagtggatgctcacagtcatctattggatggaacacaggactcctgatgaaggagctagagaaagtacccaaggagctgaaggggtctgcaaacctatagcaggaacaacaatatgaacttgccagtacccctagagcttgtgtctctagctgcatatgtagcagaggatggcctagttggccatcaatgggaagagaggcccttggtcatgagattatgtgtcccagtacagaggaatgccagggccaggaagcaggaatgggtgggttagggagcagggcaaggtgagggtataggggcctttggggatagcatttgaaatgtaaatgaagaaaatatctaattaaaaataaaataaaaaataaaatctaataaaatagaatttcaaccaaaattaataaaaagagatggggaaggagacttcatattcagcagaggaaaatctactgatatgacctctcaattctgaacatatatggcccaaataaaagggtaaccacattggtcatggaaacattactaaaacttctaaaacttaatcacacattgaaacacacacctttagagcagaagacttcaacatcccactctcaacagttgacaggtcatcaagacagaaactaacaagagaaatgacaaaattaacagtgggaatgaatgaatctgccctaacagatatcaacagaatatttcacccaaacacaaaagattgtaacttctcctcaggatctcttggaaccttttccaa

SEQ ID NO: 4735 - DNA, 1600 bp, mus musculus
actttgtttactcttgtggatgttatcctttcttaggatgtacaacacattgataattaataaaaaaataaacttctaaagttggtagatgaatttatttggagtaaagtgtgccccactgaaaaactatgaaacaagtgtttgtatttgagatttctgaagtgtagtagcatttctctgttaagatgtaacttttgtttttttttttttgaaaagaaataacttataagttagtcggtagtcaaaaaacaaaagcaaggctgttgaacacctaagccaacagtaacaatgttggataatggaatcctgtgtttatacttatttactactaagggtgatggagattctgagaacattctagaaatcttaaattgattattaaaagacattcatcctcttagttagcaaagaaatgtttaagataaatgttcaacaatgtcctatgtagcatttttttaaagaaccaattgaagtgattttattgttcatatagatagtttaggccattggagaagaggctgtggatgactcatatttccaattggttgggatgtcctgctcactcttacagtaacaagccgactggtgtattctgctctctattagaagcaggccgagttaatctccttatcacttatattcctctcaagatgcgtaatgacactgagcactttcataatcaaatgctggagatcttcagagagatcagggcaaggcctctttgtacttaaggattctcaaggttttattactgatcgcaaggccactgctaccctatgtgagcccctccgatctactaggtagcacctcaggcctttcttggtcagtttgtgcatcagttccttcacagtatcagaagtcaaccttagccacgtgggggcgctacaacgatagggcagcaccaaacggaaaaaaaaaatccttctcaggagcttgcatgcaactaatgatggtggaggtctggcagcaaagagagaaacttccgagaaaaaacccactgtctaaacggacgacaacactgtaggccctaaacaactaaaatgtttgtggtgatttaaaaaaaaaaaaaaaatgtaaccactgcaatatgacagacttcaacaatcatgtcaataagctcttttgcaacccttacttaatgtgaattggtaccactcaggaagcaattttgacttcgaagtgtgtattgagaagtcttcatatgtacaataaaaatatgcacaacgactcttgagctttatcatttgtttcaaatgtcaaatgatttgaatgcacatcaagtgcattgtaaacacagtaaagaatggatcactctctcaaaaggaaggaggaactcataggaactactggatgacaaaaaatgacagcgaacacattcacatttccatttatgtaaaactgaaaaaaaaacaacaacaacaacaacaaaaacctaacatattaaaagtcatattattttacattatgaggaaaagtagtgtataagatgacatttctgatgtgattatccatggttacacattttttaaatgtgaaaagccttaaaataatgtaacttttatcttgagagtcattaagtattgactgattggctgtttca

SEQ ID NO: 4736 - DNA, 1000 bp, mus musculus
gaaaatattgaatttcaacttaacaaatagatcccattcatcaaacttggtgaaccatgaaaccataaagttcctacattatgagcattcaaaggcacatgtgtgtctcttcccttcactggtacagtgagtcaattatgctccttccttctgtgattccaaggacacctgtatccattgcacactccgatgtccttgttgtgtattgcagaacaatttcacattggctttgcatagacagtgtcagggatcatgaacctatgatagataggttgtaaggtgcttaaattaaattgctcatatcatttaattggtcctttgattcctttctcaccaaaactatcaaaaaacagcctgacttttgttagaagattaactacaggaaccttcaaaggattaagtgtatcacctagctgtgcctctaactgggctagattttgcaaaatctggctcgttgtttggccatccataaattcttgtcctattattcttgttgtactccttaaattctctcataaaacttcctgtgccacatgagataatattggtacactttgtgtggcaaatggcacctgaagtcttgtgtttgaaaattttgccatgctaaatattcttcaaattgttcagtgcaattataaatttcatagaacattaattatatttgtatttgataaaagaaacctgttaactcttcaaattatcttagaagattaatttgttcaattgatttagaaatctctgacaaatcccactcttaatacagtagtagtattctgcagtctctacttcacatagcattaaaacaatataaagtttatattcccaaagattacttttaaatgactttaacaggactctgaaagaaaaagtgacagatggtcaaggtcatgggataggatggtttttgtttgtttgtttgattttttttataagaaaagatatcctatcaaataacaggactttcattctgattattatatacagttacaccaatgtagga

SEQ ID NO: 4737 - DNA, 1000 bp, mus musculus
agaagtaaacacagatcatatatacgttaagcctgtgttaatatgtataaaggaaagacatggtatactggctggttttgtattagcttgacacaatctggagaaaggagcttcaattgacgaaatgccttaatgagatccagctggaaggccttttctcaattagtgatcaagggggtaggttactttgtgggtggtgccatccctgggctggtagtcctgggttctataggataagaagctgagcaagccaggggaagcaagtcaataacaaacatccctccatggcctctgcatcagctcctgctttctgacctgcttgtgttccagtcctgatttcctttggtgatgagcaaaaacataggagtgtaagctaaataaaccctttcctccccaacttacttctaggttatgatgtttgtgcaggaatggaaaccctgattaagacacatgaactttatctcagaagagagggggtttctcaaatttgagtacaaaggaaaatagtaaaaataaatttgcatcctcaaaattatctaaatgttgctgagacttttatcttccttttgtactttatcatcttcctaagttttaaatattcaatatttaaatcactgaatctctctgtacatgttcatcaagatttctctatcattttcttatttccccaggaaaattctgatgtgacagtgtgattttttttcttagctattctacagagatatagtaaaagttgcttcccttccaatagtaagaaaaagatgaattactttttgaaaactatgatcaatataactccagaagttaagtgtcaaatagaaactggacaggaagaggatcaaagagattgtataaattgcaaagagtaagagatcagatatagttataataaaaccacctcagagtcacaatatatgtagctggtagtgtggatggagttagggtaatagcattccacctgaaattcctgatgctctctcatattcacagtataagaata

SEQ ID NO: 4738 - DNA, 1000 bp, mus musculus
aagtacaggtttctgtacaaggtgatctgataagattcaagggtctgggccaggcagtggtggcacatgcctttaattccagcagttgagaggcagaggcaggtggatttttgagtttgaggccagcctggtcgacaaagtgagttccaggacagccagggatacacagagaaaaactgtcttgaaaacaacaacaacaacaacaacaataacaatacaataaaaatgcaagggttttttttttttcaatcttcttgcctttgttgaatcttgcttagtttccaagaatacagtcaattttggagaaggttctgaatggtgctgaaaatgagttacttttgtgtgtatgttgtgtttctgtgatatttttataaagctatacaatgcatcaattttattcataacctctgttagtttcattatttctctgtttaatttgtgtttcaatgacctatccatttatgagtggggtattaaagtctaacatttttaatgtgtgacttatggcttagtaatgtttcttttacaaatgtgggtgcccttgaattaggactatgatctgaattggtatatatgttcaggctctggtgataaatcttcttgctggttattgtagtctgggctagcatctgtattgtcttagggtcagcaagatatttatctagactcttcaggattttacagtctctcatgagaactcaagtgtaattctgatagttctaccttaatatgttacttgcactttataattatttttattttgtcctgtacatttagtggtttaattattatgtagcagagaattattttatggtccattctatttgctgttcaggaagcttattttacatttatagatatctcttcctctaggttagggaaattttcttcaatgactttgttgattaattcttccagatctttgagttaagaatcttctccttcactgggcagtagtggtgcacgcctttaatcccagcacttgggaggtagaggcagg

SEQ ID NO: 4739 - DNA, 1400 bp, mus musculus
cacccctgctctatgagggtgttcacacacacacacacacacacacacacacacacacacacacacagagacacacacaaacacacacacacacagacacacacacaaacacacacacacacacacacacaaacacacacacacacacagacacacacacaaacacagacacacacacacacacacacagaaacacacacacacacacacacacacagaaacacacacacacacaaacacacatacacacacacacagacacacatacacacagacacacacacagacacacacacacacacacacatgcacacacacacacagacacacacacacacacacacacatgcacacccacacacagacacacacacacagacacacacacagacacacacacacacacacaaacacacacacacacaaacacacacacacacaaacacacaaacacacacacacacaaacacacacacacacacacacaccccaccctcgaattcccctacactggtgcattgagtcttcaaaggatcaaaagcctctcctcacattgatgccaaacaagggcctcctctgctacatgtgctcctagagccatgggtctctccatatgtaatccttggttgatggtttagtctctgagacttctgggtttctggttggttgatattgttgttcttcctatggggttacaaacctcttaagcttctttatttctttctctaactcctctattggggaccccatgcttagtccaatggtgactgcaagcattggcctctgtatttgtcaggttctggctaagcctctcaagagacagccatatcagggtcctgtcagcaagcacttcatggaatccacaacagtatttgggtttggtgactgtatatgtgatggatccccaggtggggcagtctccggatgccctttcttcagtctctgctccacattttgtctctgtaattttagaacagccatcattgggaagagaggcccctaggtcttgcaaactttttatgccctagtacaggggaatgccaaggccaagaagcaagagtggatgggtaggggagcagggcagggggagggtatagggaagttttggatagcatttgaaatgtaaataaagaaaatatcttataaaaaaaagaatttaaaaaagataatgtttgcttttgtttcaaattctctttaattgatatggatttctgtcttgataaggatcttgtagtttgaagtatcgttttgaggaaaggggataacatggatgatagaacacatgtgacaggaaatcaggaatggatctacttgggatcaagagtacaacagggagataagggtgacagaatgggcagagaagaagcaatgaaccagattatgtatgaaaatcacctcat

SEQ ID NO: 4740 - DNA, 1400 bp, mus musculus
caatattttttgctacagatattaaaatctctaccacaattagcatatgatacgtaatatctgttatatatttcacagataaaaatgtcaatttattagtctagaactattttgagaacaatatttaatatatctatataaatttattattccagtcttaaaactgtgtgtttcatcctgaggcagagaactatatgcatccattgactctcccaatgatgagcacatttgttggttgtctaatgcagcatggtcagccttataagcatacatatgcatagcaaaatcataatgaggagattatatattacatacaaagatgtatataattaaggaaaaatgagagctgttcaatggagtgactggctgggtgaaagagaaaagtgacgtaattctatttctattaaaacattttcaagataaaaaggcaactttttaaattttaatctgttatttatttatttattttacacttcagattttatgaccccacccattcaccctcaaatggtttcacatcccatacctccttcctactcccccatatcaaggaggatttcctggcaccctataacccaccccacctgacctctaaactccctggggccaccttgagggttaggtgcatcttctctgattgaacccaccagcagtcctctgctgtatgagtgttggggtcttcatatcagctggtgcatgctccctggttggtggtccagtgtctgagagatctcagggattcaagttaattgagactgctggtcctcctacagagtggcactcctcctcggcttcttccagcctttccctaagtctaccacaggggtcagcagtttctgtctattgtttgggtgaaaatatctgcatctgactctttctgctgcttgttaggtcttttggagggcagtcatgaaaggtccctttttgtgagcgttcaatagcctcaggaatagtgccaggccttggaacctccccttgagctggatcccacttagagtctgttgttggaagggtcaggaaacaatttttaacattataaattcactttgggaaatagatattagaagtagaaattattttcttaacattttacaacattcagtattatatttctctaaacacattaatgttttaccttattacatatttactgggcttaaagtcaaagactactcaagtaaagttaaaattctgccctatcttttagaagccatatgataatttgtagctttggctgcattaaacattgccactatgcttcgtgatatactgttttctaataatctgattgaatgtctgaattactaagccacgtctgaaatgtgagataccacctcctcaaactgaacatggcacgatgatacatggatataaaaagaaatcacttcttaaaataattg

SEQ ID NO: 4741 - DNA, 1200 bp, mus musculus
tgtgtgtgtgtgtgtgtgtgtttaatttattaattattccattcgattacatctcacatgatataccacttcctggttacccctccaccagcccctcaaaccatatctgccctcgcctcctcccctttgcctggatgagggtgctccttcacccacccaccctttccttccctactgttttaacaaccctgtacactagggcgtcaaatctctccaggaccaagggcctaccctcgcactgctttcaacaaggccatcctctgttacaatgtatctgaagctatagatccctctttataaactcctgggttgtggtctagtctccggaagcactgggtgatcctgccagcagatgctgttcttccaatagagttgcaatccccctctgcacttccagcttttccccaagctcccccaaggagttccgtgagctcagttggttccaactgtcagttgctggccggacctcccaaagaaccgtcacttgagattcctgtctgcaagtgcctcttgaccacaggaacagtgtctgtttggtttctgcagacaggatggatccccaggtagggcagtccttggatggcccttccttgagtctctgctccatttcttgtccctgttcttcctttgttcaggaacatttctgggttaaaaactttgagataggtgggtgacaccaacctttgacagagggcgattgcggggataggggtggggtgggggtgggcagaggcacatctctccactggaggtggtccctacaggttttatcctccccttctctgcacatttcaactaaagtcatcccctttgggtcttgggagcctcatgtttccctgatgtctgaaaccctcaagaggctatcctttgttcctccctccccaacccctgcatatttttgtttgatttcctgaccctctgtacctctctcccatccgttccagtaccttatgctgcctcccttatttcctccccctcctctctccatcgaggtcccactctacctccacctaccatgatcatcctgttctccccttaatgcaggactgaagcatccacaccctgatcttccttctaagcaccataggttgtgtgggttgtatcataggcattatgagcttttgggttgatatccacttatcagtaaatacatgcatgtctgttcttttgtgtctgggttccttactcaggataatattt

SEQ ID NO: 4742 - DNA, 1400 bp, mus musculus
ggtaactgtatgtagaagaatccaaatagatctatacatatcacccacacaaagctcaactccaaatagatgaaaaatctcatcatgaaaccagatacactgttttcaattgagaaaaaaagtagagaataatagtcttgaattgtttggcacaggaaaaggctttctgaacaaaattaaaatagctcaggcactaggaacaattaataaaaggaattcatgaaactgaaacttttctgtatggcagaggatatcattatttgtacaaagtatcaaactagagaatggaaaaagttttgttttgttttattttttattggatattttctttttctacatttcaaatgttatcccctttcctgtaatcccatccagaaacccccatatcccatccccccttcacctgcttctatgaggatgctcccccacccactcacccactctgacttccctaccctagcattcccctacactggggaattaagccttcacaggaccaagggccgctcttcccattgatgccccacaaagccatcctttgtgacatatgcagctggagtcatgggtccctccatttgcactctttggttgaagatatagtccctgggagctctggggagtctgactgattgacattgttgttcttcctatggatggcccttaaggacagcgccctatgtccagcagtgggtgatggatagccaacacgaaaagaactttacatcttggaggttctttgtctcaatggtttgccagggattttgttttttcttttataattccccttcatgtatctaccatggcttctgattttctactttaatgggatacctgtctgttcgtacataggtatctctgtctctgtacagagatgtataaagatatacatgtttttctggaaggctttctcttttgttaatctttttctgtttgttttgtcacagtccagttggtttttgttttatcctaattcttttggctattatgttcatgcctgtttgttttctaagtagtgaaagagacatagagaggtttggattgagatggggagggagggaaggagaacctgggaatatgtgtgggaggggaaactataatcagaatatatcctatgaaaaatatgttttcagtaaaagaatgaaaaatatcatgaatgctaatatttatattactcactatcatattaaagcaatgtaaattcaatgaacatttattatagctgctttttatttctatgcggaaaattacttcacacactagaaagaatctctagatatcattaaacatcttagaattttgatctttaaagagatgtggtttcagattttaacgtgtaattgcttaatccctaatgcagacaggtcactgagatggtgcagggcttattagcatatgtgttt

SEQ ID NO: 4743 - DNA, 1000 bp, mus musculus
tctcaaggctcagagatgactggagaagaggaagcatagagtgtataagagccagaggtgctagttgactgtaagcaaaagtgtctactgggcacactggggaagctgcacatagaaactcacagcagtgtgacaatgaccaccagacctatgcaagcacaagtcagaaaaaaaaatcccagcaaggagagaggtgtgagcatgaagtctcacccctagctgagatgctattggcaactgatagcttctgagagagaaaggtgtggtttggataaagaatagacttctggtaagtcatcctctctagtgggaatcgacacactcaatagtatgtgaacagtacaaatacaacttggtagaatagagaggggaaggaaaaaaaaagacagagagagtacagagtttggtaagtaggcaactttggaaagctagatctgaaaggacttagaaagggtgtgtatggtcaaaatatattgcatgcaaagttctccaagaactattataaagaatggcaagggaaagacagcatttaattctctttccttgcaacctgcatgactttctgatagaatccaaatctaggttttaagaagcttttgcacttcttcctggaccagtcaataaatttcctcttgtggtacatctcggaagacaaagaataactgtgagaattgcaaaaccagtatcgcactgagagcttgcaacttgggctgttagaaagttcaagacaagaggtggtcctttcatttgagactgtttgcatcccgttaatgatgtagccatttttcctccctcagagagaggacaaaaactcagaatctcagctttgccaaccaatcttgtgagtgagctaccatggaaattcagccattcgaatggttagttgacggcactccccgtcaatatctgaccacacatctaagaaagacagtatgagacctgagagctcagataactcagaagttagccatagcaaaaagaaagaacaaaatgtttcccc

SEQ ID NO: 4744 - DNA, 1400 bp, mus musculus
attttgtggaataatttgagaagtactgtcattaactcttgtttgaaagtctgataggattctgtgataaaattacttttgccctggccttttggttggaagagttttagagacagctcctgtttcactagggcttatggatttaaattgtttgtttggggccagtatgtgaactggagatgatcaccagtctggcatcactgacctggatggggagctggtctaagatgagagaagaagaaggtgggcccaagatgaccaccagtatagctctgagtaagctagggaggagagaatacacctgagattacctttgcctggtccatactgccacgctgtacaggtggggcaaaacatccctaagaccactcctaagatgagcccagacacccagaaaccctgggcaccattaagaagagcaagtaagtcatggagaaatggaagaaaaagagaagcagggtgtgtgcacaatgaagacaggcagacctccatacttgatggtagggaggagcactcttatgtgactaactggtgatgccacctaaggtcatggtgagatcctggcttgtgctgcctcatatggccatatctgagtctatagcactgtatcaacaagggtctgtcaccacaaaaggccatgcagaagtccctgatatgggctatagccccaggccatgttgatggatgaaggtgctacagagctggccctgaagacatgagagtagaagggctgtccccaccccttgcaagctacagcattcatgggagggaccctggacatcaatcaggaagcacagtagagttggccatggttagagttgggagtgagctatcctcgagggtgtgagtgtgccagagctggccctgtcacaaggctaacttgcagagtcatataagaggaagagatgcttttgccccttaccacttgtgacaaatgggaaagctgccctagtgtcatgagagagggagaaccgtccctgcccctccccagctagtactagagaaaaagaggttctagtatttatagggtagcagaagccagaggcctcaaaccaggccagtgattcattgcaatgaatatttataagtaaagaagtgtaaacaaaaggacttgtgaaatactagagcttcctcagagagagatttccccctttcttttggagggtaggttacaaggatgaagggtaggtatgtggggatggggaggtagtgggattggggtacataatatgaaattcacaaagaaccaataaagagtttttttttttttaaaaaaaaatacaaaaaccagaacagtgcttatctaatgtttatttaactttgataggtgatatgtattgagaaaattatctcatttacataacattttatagtttgttgaagtgttgtgcatctctgga

SEQ ID NO: 4745 - DNA, 1400 bp, mus musculus
acatgtttctcataggatcattttcaatccagtccagaaccaacatacacaagaagactatgatacccaagctttctcaaaaacatatcatcaacattgctaatatggaaaacactgatttctaaagacgagaggacaaaatgtgtccaaggttttcaatatgctaggtgagggtaaaagaattttttaaatgtgactgtcataatgaaaggactgtagaaggaataataaatttatcatatctaaattaaatataagaactgggacaaagaccccaatgagatatttactgaaaatatatgaaaatgacagtttggatggtatgagcttatgttcctagggaaagtagggtttcctctttgttatctcaggctcataaatgaaagactttaacagcagcctctgaaggaagtttgaggatacttttattaaagttaagagataaattacagggaaggcaagctataaatcttagcagttgtctgcagaagagagaagaagaagagacagagacgagatggaaagagagacagatacagagagaccaagataaagtcagagatgaaaagaaagtcttaccatgtagaaaaaggtgttagcatcagagaagaaaaagcccaaaatgccaaagaaagaatgacatcttcctagaagagacataagcagaaaagttataccatcctgagttagaacacaaaaaggtgaccatcctcacagggccttatgctacaaccacagtgagtacccagagggtagggttttgtgttgagggcaggggaatgcattgttccaaaaatggtgagatttgtggctctagctatatatgtagcagaggatggcctagtctgtcatcaatggggggagaggcccttggtcctgtgaaggttctatgccccagtataggggaacaccggggccaggaatgggagtgggtgggttggggagcagggggagggggaggggatatggtattttcagaaggaaaactaggaagggggataacatttgaaatgtaaatacataaaatatctaataaaaataaataaatagaaaacaaaagcaaaaaaatattccactgaaataggatgatttttctaataagactttatttcagctgaattatatttggttagctcattctttttctgttttcaaagataagacactgaggaaattttccattatctaaagtattttgcataaataaaaaccttacttagcttaatattattttaaagtagacacatttaaaatcgttgtcagataatgattgtcttggcagtagctaggccgttttcccatttttctggaatgtggggtcattgtaaagggttatatgatgtatctataatgtggtgttcttgcttttagaacaaaaaaaatgatgggttgaaatttta

SEQ ID NO: 4746 - DNA, 1000 bp, mus musculus
ggaattagaaatgaagaagtacttattttggctcatggtttcaggggtatccatccatcacagcaaggaatgtcaggtatgacagagcaactgccattgtggcggtcagcaagacaagggacctgttgcacctgcatgtttccttcctctctcattcatctgcgttccattctgtgagttggtcacactgtcttttagtgtgggcctttccacacttgctatgtatctccgcttattaccctaacagggatactatcttagtcagtgttctatagctgtgaagcgacaccatgaccatgacaactctcatacaagaaaacatttcactggggctagcttacagtttcagagctatagtcagtccatagcagggggcatggtgccagcaggcagatgtggtactggaaaagaagctgagagttctactgatgaatctgcagttcaaagggtggagtccatgaccatcatggcagcagacaggcagggatggcccctatctatctaatctttaaacaagttaaacaggcaaaggctggaagcaggaataaggagttggcatcagaggtcagggggcagaagcagaggcagactggttttggcacaggcaacttgaaacctcaacgctggttcccagtgacactctttctcccataaggtcacacttcctattccctccacagttccaccatttggggactgtgtattcaaatatctaagcatatggaaaccattccccttcagaccaccatggtgatttcgtggcttcagagcactcaagtctacagagtgctagagaaaatgtcattctgttgttctagaagtcccactgtgctctgtggaaagcagttggcccaggaaaaactgatgttaatggttccatcactagagtattaaagttctggaatgcagactccaaatcctcagtcctctagtatgaagtactccattattgaaaacttgagcaccaatgtctacaaggagaaaatttcacagtaggaaa

SEQ ID NO: 4747 - DNA, 1000 bp, mus musculus
atgtcatgagggccatgtctgagtctgtggctatgcacagcagagaacagtgttgatgtctgtgagttcatagtaccactagataagatggaaatgtccctggttgaggcagctgccaaggaacacgaggatgtccagggaatgtgcataactggcattgcttctcattaaatgtagcatcctggcgagctggccccatctctcactggtggcagcatttaggagagtgggttcttctacattgagcagcatagtagacctggtagcaggagtgtgggtgagctagaatcaagtgtatgagtgaaagctgaccctttaactcctctgccgtgaagtggtacagctacagccgtgatgccctgcccccctccagactctcaccccctctgacagtcaggagctgaccaccccaccaggttatgagcttgggggagctagccctgccccttaccagctgtagcacttaggagagtgggaccttcaccttgcctggacatcacagcagacctgaccctgctggtgttggcataggtgagccagccccagggtaagagaatgggagagctggacctgcctcacactcatcatcttctgtgaagtggcatgtgagaaggagtgatagcttgaccccacacttgtgccaatacagagagctgaccctgctccttgctggctgcaccatgtaggagatctggtcctgtaccttgcctgagcaacacagtattatttgaccttgttgggggcgtagaggtttgccatccatgagggtgagagcatgggggagcaggtgagacagcccaagaccagaaatatgtagagctggccctggcattcctctgccatgaggtgacgcaaagggcagtgatgtcccatactcctatgacctcaccatctgaggtagcctatagagctgttgtcatggtcatgagagtgagttagttgtccatacctactgctggctgcagcacttaagagagcagccctgcactgtgtctgggca

SEQ ID NO: 4748 - DNA, 1000 bp, mus musculus
ttttagttgagagagtcctgcttggaaattgctgaaagaaaacagttcagagaacaaccacaatcttgggtccgtttgttcaggtttccctccttacctggattacttgtgcacttctcagaactggtttgggctcctctgacagtggctgattttgtctggtcagttctcctaataccagcttgattgctcccggtgagtgttcaggtcagcctaaagtcttgtaaactgggaatatgggatgattaaactgtagctattcaaacaagtctttcttacagcaatgggagaagcacaggggtgctaactttttccacacaaataatctactcgaacatgtttggtgagcctgatgttgggaatgccaaaacttaggacgtagcatgtactttttccatcaggatgcctcctgtaggttttaaacttcttgtcttcctggctctgtttcccattctcccctcccactctgtctttgcttactgttatttttaaggcagtctcactgtaatgtttaggatgagtttgaactcttagtttccaattatactcaaccatctagccttgggtccccacaaagctaggtctagctactcaggtcaatagaatttcagtatgaggttttaaaaacacatctctgaaattttactcttcacttatcctctttatttataggcattcaattctcttccatgtgcaagtttcacttacagaattccacagtttccagtagtttcagttgcagttgaaaaccaaagttcagagttagttagtggaagagaactcaggactggaccatcttaatatttgatgatttcatggagtgcttaagggttttaagtttttaatgccatgacccatggaaaagaatgatttcattcaggttaggggggatgaaaaataaagtacatatttaatatgtattataaatgattgtgatttttgcaacccctagttagctctctctgtctctctgtctctgtctctgtctctgtctctgtct

SEQ ID NO: 4749 - DNA, 1000 bp, mus musculus
taaataaaaaaagaaggcacaagtgaggatgattgaatcttacttggaagtggaaataaaatagtcataggatgcagagagagggaggaaactgtctgagagagtggatgtggaggggaatggtggtagttagtatcagatgtgaggagagtcaggagagagagccagagggccagaggactgaatggaaaactgtagctggcagtggtagggggtgagggcaatctctaggacatgccagagacatggggtgcgtgtaactcccaagagtcaatatgggtgaccttacctgagatgaatagcaaaggtaatatggaaactgaagaaggtgctgtatttaggtaggccacaccccacccccctccagtggaagcgttaggacaccaaaacacctacaaaattttaagtcctaatttgtcctgtctcaaaaaagttcagggacaaagatggaacagagactcagacattggccacctaaaaactgacccaacttgaaacccatcacatgggcaagcaccaatttctgacactatgaataatactctgttatgtttgcaaataggagcctagtataactgtcctctgagtggttccactcagcagctgactgaaacacatgcatacaccaatagccaaacagtggatggagctcagggactcttatggaagatctaatgaaaggctctgaaggggataggaagaccagcagattcaattaacctggactcttggggactctcagaaactgagccacctaccaagaaacattcacaagctgcacggaggtctctggcacatatgtaggcaatgtgcacctcagtctccatgtggtttctccaacaactgaagcagaagctgtcccttagatgttgcttgtctggaattattttcctacctcggctgccttgattgcccacagtgggagacgatgcttttaatgctgcaaagacttgatgccccgagtgaggagatatgggtggggcaccctctcagagacaaa

SEQ ID NO: 4750 - DNA, 1000 bp, mus musculus
ttttatttatttatatttcaaatgttatcccctttcctagtttcccttctggaaatttaatatcccattcctcctttccctgcttctatcagagtgctcccacatccacccacccacacttgcctccccaccctggcattcctctacattgatacatcaagcctttacaggaccaagggcctcttctcccatttatgtccaacaaggccattctctgctgcatatgcagctggagccatgtgatctagtatcataagtggcaatccaagtctagagatattatgaaaagtaaattgacatgttaatttatgatgatcttagcaaaactcaaaaagtaattgagctatatacatttccctaatttttaaagttatttttattagatattttctttatttacatttcaaacgttataccctttcctagtttcccctccaaaaatcccctaacccctctcccattcccttgctccccaacctgcccactcccattcccagcactggcattctcctatattggggcatagaaacttcacaggacctagggcctctcctgtcattgataaccaactaggccatcctctgctacatatataactagaaccacaagtactaccatgtgttttctttaattggtggtttagtcccagggagctctgggggtactggttagttcacattgattttcctcctatggggttgcaaactccttcagctccttgggtactttctctagctccttcattggggacctgtgctccatccaatggatgactgtgagcacccacttctgtatttgacaggtactagcaaagcctctcaggagacaactataccaggctcctgtcagcaggctcttggcttctgccatagtgtctgtgtttggtggttgtttatggaatggattcccaagtggggcagtctctggatggttattccttcagtttctgctctgaaatttgtctctgtaactcttttcattggtgttttgttccctcttc

SEQ ID NO: 4751 - DNA, 1400 bp, mus musculus
cacaggcctgaagcttttgatttgatattaagcatcatataaaacctatgtgataacacaaacctgtaatcctatcatatagttgattagaagaacagaaatttaagttatttttagtgtttgaggctagctcagtacttgtctaaaacaaagaacaacaacttaactgatgcccattcttacaatatgcatgagataggacaatattggaagtttcaggaagatacactctaactaaaactagaaaaaaaataagccatgtaatacactattcattaaggatcaaaataagaatacaactctctatccattaatagtttaaatttgagaatgccattacaggatatcatcctaagtgaggtaacccaatcacaggagaacacacaggttatgcactcactgataagtggatattagcccagaaacttagaatacccatgatacaacttgcaaaacacatgaaactcaagaaggaagacctaagtatggataattcattccttagaatggggaacaaaataaccatggaaggagttaaatagataaaattctgagctaagacagaggatggaccatccatagactgccccacctggggatccatcccataaacaaccacgaagcccaaacactattgcatatgccaacaagattttgctgacagaaccctgatatttcttatgaggctatggcagtgcctggcaaatacagaagtagatgctcacagtcacccattggatggaacacagggcccccaatggaggaactagagaaagtatccaaggatctgaaggggtctgcaaccctataggaggaacaaacagtatgaactaaccagagctcgtgtctctagttgcatatgttgcagagaatggcctagttggccattaatgggaggagagacccttggtcttgcaaatattatatgcttcagtactggggaatgccagggccaggaaatgggagtgggtgggttggggagcagggcagggggagggtatagggaacttttggagaggaaactgggaaaggggatagcatttgaaatgtaaatgaggaaaatatctaataaaatgagttattaattgatctagaaaaaagaatgccattacatatacaatgtgtaacaaattatagggttatagatatttgtccttacctataagaattgatagatgcctgaacactgtgtttctaaagaattttttctccttttgtgtggtttatgtatcagagtaattgtggcttcaaattgtgtagagtaccttctgcttctattttgtggaatagtttgaggagtattagtattaggtcatctttgaaggtctgatagaactctgaactaaatccatctcatcctgggctttttttttttttttttttttttttttttttttgcg

SEQ ID NO: 4752 - DNA, 1000 bp, mus musculus
tttggcagttactcagaaaattggacatagtactatcaggggatgcagcaataccactcctgggcatataccaagaagatactctaacatgtaataaggacacatgctccactttgttcatagcagccttatttataatagccaggaactggaaagaatccagatgcccctcaacagatgcatggatacagaaattgtggcacatttacacaatggagtgatatgaagctattaaaaacaatgaatttgcgaaagttgtaggcaaatggattgatctggaatatatcatcctgagtgaggtaatgcattcacaaaagaacacatatgatatgcactcactgataagtgtatattagcccagaagctcagaatacccaagatacaatttgcaaaacatatgaaactcaagaagaaggaagaccaaagtgtgcatacttcaatccttcctaaaaggtggaacaaaatacacatggaaggagttacagagacaaaggtcagagcagagcctgaatggatgaccatgcagagactgccccacctggggatccatcccataaacaaccaccaaaaacacacactattgtggaggccaacaggagattgctgacaggagcctgatatagctgtcacctgagaggatctgccagtgcctgacaaatacagagtggatgttcacagccatccattggatggagcacagggacctaatgaaggagctagagaaagtacccaaggagctgaaagaggtttgcagtcccgtaggaggaacaacttgaactaactgggatctccagagctccctgggactaaaccaccaaccaaagaaaacacatggtgggactcatggctctagctgcatatgtagtagagaatggcctagttggtcatcaatgcgaggagagacccttgttcctttcaagactctatgccccagtataggggactgccagggccaggaagaagaactgggtgtggttttgagcaggagaatggataggaa

SEQ ID NO: 4753 - DNA, 1400 bp, mus musculus
acagcttgtgaaaatttcaaggaggttttacattttattattggaatatgtatcacttgctaagtataaaaagtacataaaatatattttcctaagtgctaggaataatttaatggaaaatagaattacaactgtgggcaattgaggaataatgagagtttagtttctgaaaactcaccataagcaaccagctgtacaaaactcatgcaagaacaagacggtagagatttccacctttatttatcccgcattagcctaagaaggaggttgacatagataagataaattaaacaatttattgtgctcttatgatcactgtcttctaactttgacctgagtcagtaatcactataacattcagagagcttaaataatcaagagcagcagaagatgcatgtagggtttaaagggtctctaggtctccagtctgtctgctccaccatagggcatgaccgctctgggatgcaggaaagagagttgactgtgcttaccccacgttgttgggctgtagggaagccccaggacaccagaggtagggagtcactgactgaggtgcgggacagccagagcagactggagggtgggcgtccctgagcctgtgacaaggccggggccatctggttctcaagctcttggacacccaggcgccactggaccagagagtccttggctttccagccgttggcttgggtttgggcttgggcttggtggcagcagtggctggaaacacagagaggctttctactggagattacatggcggctctataggcaaaggccttctccatggctccccacggtggatcccagtgaaaagaggcagtccatggatttaagatattggcatggctggaaatggatgagtaaaaccgtaccccatttctcagggtgggcctgagtttaaatactttttgcagagaggagtgtctggaaaggggtacacttactggctaagccctccaggcctttaggtgcctcattaaaatggagatctgtcttgatcctatgtgaccacagatcatgtcctctccctgtgaaggggcttggggagttgcccttatgtgactgatggccgcaaatctatggggcactgcctctagtgacaggggcctggtggcccggaacaggcaaagtatctacagtcccttcagaatttctggagtttcaaaccttagatcaactagggaccaagctacctttcccggtcccacagatgcatagtaatataattgttgcaatcaaacaattgtggaagccgtttagcgatgtctgaagtctgtcatggcatcaggaggaatcggctgaaaccagaaccctgtgatcaagtggaaagtttttgtgaaaggatgaaccagaacagcttccatagaggtttcatccctgcttatcagatcttgaaac

SEQ ID NO: 4754 - DNA, 1200 bp, mus musculus
agacgctttattgatttaagggttagagacatgtattttcatgggaaattccaggtagtcacggtcagtttctatgtagtgtgaacaatggactccgaaactatcaaaactagtgtaacttaaatgaaagttagtttttaggaatgaaatggtgtgatgactcatgagacgctctgccagtgcctggccaatacaaatacagatgctcacagccaaccatcgggctgagcacagggacgccagtgaaggaattaggcgaaggactgaaggagctgaaggggtttgcaaacccataagaagaacaacaataacaaccaaccagaccccccctcacatacacacacacacacacacacacacacacacacacacacacacacacacacacatacacacatcccagagctcccagggactaaaccaccaaccgaagagtatacatggctccagctgcatatgtagcagaggatggccttgtccagcaccaatgggatgcttgatcctgtggaggctcagatgccccagctaaggagatgctagagtggtgaggtagggatgggattgggtgggggagcacgctcgtggaggcaaaagagcggggggggggggggggatgggatgggacttttacggggggaggggggacagggaagggagagaacttctggaatatcaataaataagatgtaacataaaagaaaacattcttccaaaaatcaaatgataaaaaataaagaaagaaaaatgtgatgaatgcttttattttccacaatcgttaaaggaaagaacgttgaaactccgtggtagttctaatgatgcatttcttagttaggatggcaactgttgggataaaagagcatgaccaaagctacgtggaaaggaaagggtttatttggctttagagttccacgtatagtccatccctgagggaagtcagtggagaaactcagtagggcaggaacctggaggcagccgctgatgcggagaccatggaggagcgctgttgagcggcttgttcattatggcttgctcttttataacactcggtagcccaggcctgctcctacccacacagaagggggcactcacatataattcacccatcaaaaaaaaaaaaaaaaagaaccaccctaggccaatcaggtaggagtatttcaccaactgaagttccatcccccaacatgactaccttgtgccaac

SEQ ID NO: 4755 - DNA, 1000 bp, mus musculus
catacagaaaaacattagttgtatttgcttagtgatggcaatgacacaaaaaagcttatttggactcaaaattccaggttacagtccatcatagcagggcagtcacagaggcagtaggtgagagaacttgtcacattctacccagcaccaggtgtcagcaatagatagatgtgtgcacaccagtcagtttgattttactctgtgtatggtaatttggtaggttttcctacctcagttaatgtaaaatcaaacaatgcctggctgagactcctagcagcttagtggtggggaagggtatatattgaggctgatgtagtcaggcaggacttccagtggaggagtttgggataccaacccacccaccaaacctttgacccaaaatttgtcctgcctacaagttgtacatggataaagatggagaatagactgagggaatgaccaaccagtgactggcctttcttgagacccatcccacaggagagagccaagctctgacactatgaatgatactctgttatgcttgcagatagaagtctaacataattgtcttttgacaggtttcatcaagcagtgaatggaaacagatgcagagacccacagccaaacattaggtgggtctctgggagccttgtggaagaatgggaggaagaattgagggagccaagaggggtcaaggacactacaacagacctagagagttaacatttctttttagaaatagaatccatctttctatttgatgtgtttaatatttttcacatatgttttttgggtaaaggcgaattaattgtgtaggttactctgtcagagttttgaaatctctcaaaactaatagaatctgtattctctaaacaatcataactttaagagcttcataataattggtcaatctatatattttattacatttctctcatcaatcaaagatacttaaatttgtttttttttaactgtctttaactagtctagaataaattataaatgagtagagtatgttttg

SEQ ID NO: 4756 - DNA, 1200 bp, mus musculus
cttaaatgtattcatcattgtaatatgtttacatgagatatgctggatttacaatctagttacgctatcaatatttgctgatagaataggcagagagattataggttttctgtgtgggctttctcctttgatttagataagtaggcataaatcttgatatattttccagacagcattgagcaaatcatctgttctacaccaaatgggttgctggtaattaaagaagggaaagtattggatgcaagttctactaataagccagccaccatagtggaaacccacgggcaaagacagagtaaggagtgctgccaagttcacattaggtaaaccagggagcctgctaaaacaccccctagtgctgggaaattcattaccaaaatgtagtaatcatcttgcagaagtaccagcagattgcacacattacctcctgcagactggagtgggaataagtaaaagaaaagaggtaatgatggtcgagggaaattgaattttcatggcacttatcttctgtgtcattctatttgcatgagaacaatgttagctggagacattataggaccctaatgagaacaggagcttctcccaatgggcgagagccaggatgggtgttgatgaaatcaatctatcaatgagattttaaaacgcaccatagccccagtcttgctctatgcccatgtgggtgggccttccatcaaagaagagaagaaattaagaatgatggctagagagagttcaaagcacacccgcctctctgtcagctggcccttaatgataacatactactgctttccttaaagagcttcatgtcttattcagggtaaatgcccaaagtgtggcattttagaacccatgatgtgtttttctattgatgctgtcagtgtgaccagccacggcaggaagtgctgtgtgtcgcctcccattctcctcagtgatccatcagacgtggcagttcatgcatgcagcatcagacgaggagtaaataaggtatcggctccatgctgaacactcacagattttattaagctgccaatcacccatgggcaattcagcacgtcagaagacaaactcttatagggagtctcttagtacctactttagttgtcagctaatacctggcacaactatgtattatctcatatgtaaaacattccccgagttgcaaagcacaaagaggcattttatcccttggtcttgttcttt

SEQ ID NO: 4757 - DNA, 1400 bp, mus musculus
taaaatattgtaaacgaagaagaaacatctccttaaaactaaaaaaaaaaaaaattagaaaaaatagagtaaatatatattactctgtttaataactaaagtatgccatcccctctataaaatataaataaattaataatttaatatttctctaattattgtatgttgagttcctgctacaagcctatggacttaaaatagaataaagctttttaaaattctttcccttgaggcatttttaagtttgtttttaacaaaaaaataaacaagaaaaaaagtatagaaaatgtcttagtcaatatattctgtagttaaaataagctaggtaaataaattattaaactgtaggagaattgccactgaatttagcgtgggaaggagaaacccataggtacacactgatgctcagacgagagcctgttgtcattatgtagttgctgctgggcaagtcatatttagcccaggctttcattaaagtgagaagcttcccttgggtttgttttatttatgtttggattctgttcttattctgtatttaatttgttcctaagccgtactttggcttcgatggcttagcctaaacatcacaagactgtggcttttttttttttttttttttgccatcctatttccctttaaagtgaactgtgagctgaaatgctgtaaaacaccagatgggaaggaagctgccaccttcttccatgcatctgcaaggctatggctcccagtgtctcattgtgtgcaggaactcaaaaattccaagcctcagatgtggtcacatagatcctctgctgactactacagatttgccttcaaatgaaccacaggaatgtttagtagttaatgatggccagaggcttcccttgtcatggggtttttaggctcttgcaagcaggctagcaaagctggtcccaaattcttgtctcagctggcagacagggttccccaccccctgccccccaatcactaacaattgcttcttacatttttgcagggctgtagggaaacaaagataccatccagattcgtggggctagagggataattccaggacttactcatattgaaaacaagttcagtgatttggcccagcttcctcattctgcagtttatcacatcataaagtcatccaaaattataaaattttgtaacagaggggaattctccaactaatttacaattagaatacaatttaaggcaagtttggaaagcaagctaagccattcttcacagaatatgaaaaaaaaaaaagtcttccattaatagtgctccaaaataataagccttctgtttcaaaattatatgctcatgaatatagtgcttaaatatatactcataagattactacttaataatcaataatcgtatcatttttaggagcttcgtgtatgaaattgaac

SEQ ID NO: 4758 - DNA, 1000 bp, mus musculus
accaccagtttagagagcagcacagtattaacgcaggataactagccttgaggcatcaccctgacaacgagcagtgagaggcgtggactcagagtcttggacttggttttggagaatggcgaagcaaggagtctcagcaactgttgggaaatcacccctgctttgactatgtcctttctgccaatgtatgattatttttaaaacattttatagttctttacattgcctgatatttgtgaagctatatgaatctgatgacagcctctggtgaccagctatgtttttgttggggtttttgttgttgttgttgttgtgtattctggcttgataattaagaggaaaatgatggagataaagaataacattctcaagattttgtacctggagggtgacagatctgagcctcatacacttttgtgtgaacaacacctgagatactttctatttatttatttatttttttatattttatttttttccccagtgaaaggttaggaaactgggtgtgaacaatcagagggaaaaaacaaaatgaatttattttcattgtccataataagtaactcttatttttaaaacttacacctatagttttgtttaacaatggtaatcataacacagcagaagacaattttgtcactaagaaaataagaagaaggttcttagagccatgtcattgggccagcggcgttgctctgcaagcatgaagaccacaaatcaatcccagcatatacaccccaactgtgtatataaccgggcatggctgttgctgtgcgcaatcctagagtaggggaatccagacaggctgaccttacatgctttctaggcagcgaggctagctgaaacaatgttctagtcactcacagactctgattgtagagtaatagaaaaaaaaaaccctcatatactgttcatgtgtgatacactctcatatttatgtaaatctaaagtagttagcataaatacagactacgacacatatgcattcatggcaacataa

SEQ ID NO: 4759 - DNA, 1600 bp, mus musculus
attgaacaaatttagagattccaaaactttagagaaaccttgacttttgcatttctaagcgattttttcttttttcattcttatgaaataaaaatatgcctacttaagttctcaccaagatctatccatatgttgattatgtgataccagtgtccctttcatgttagctaaattatgtttgattttttaattaaaatggggacatccacataagaacaattaaacactttgtcccccaatttcttttctgttttatgttgtataagcacaggctgcttttgatattctatttgaatgattaattcaggataactgagacctctagaagctgtttgcaggaggcctttattgtgtgaaagcaatttctgattttggaatatgcaaagtttattgtgtatttaaaatgctaaatctcaattttttaatctcctgctgaatgtccagaaaatagtcctttaaagaacacaggataattaacattcagtttaatgggctctaattgtgagctaatatctgattgaatggataacatttctgcatgtggttttcttccagggaagtattagaataatgggccatcagagtggctcagattcttgccaaagtttcctccctgtaaggaagaaatattagtcccagagcaaattatttcgaagtcatcattaatgcataaggagacagacatgttgaatgtctgattttgaagacggggtgaagagctgctgtcctttctttgatatactttttcttggagtctatgtaacacgcctgcattcattttcccaggaatgactcgtcacactttggccatctaagttgagaacctgctttgtgcaagggagcacatccatgtttgcaagggttcaactcttcccctgagtcctatttctcctccagggtatacaaggatccaggcactgttatcagtgaaggcaacatgtttctgacaaatgatgagggcagattgggagacttgggaggacagggcgggcatcccattgctctgttccaggaactgatgtatctcctatcacacgggtcctttttatagacgtgcttgttgtgaatgtttgattttattctgaatgagacaagtatgacttctgtacagaaaaatgattgaaaatcatttgctctaaatacacaaaatctgattcatatattttaatttcatacttctagtctatacaaaatggaaagcttgggtattaatgaatgtaatgaaactatttctgaacattttgatatacaaaacaaataagattttggcttccttttgttcactgcttaaatattgagtacaaatcattatgttactgtgtaagtgagatataattgaatgcatcacattcttatatatctggtgtagctttgctctattcaagtaatgttctaatatacaatacactttccaatatttaagcgtaatttttacacagttaattttcgaataagcatgatgtttaaataattagatatttgtgttgtttgagaggcagaaagcaattggcagaaataagcaaatgaggcatataggcaaaaaaacctaaaggttatgagtgttcatatatgtcttccagaaataacatatatgaaagtc

SEQ ID NO: 4760 - DNA, 1200 bp, mus musculus
ctgcatcttagatttatgacaaatagttccttatagtgacaagcttctttttgccgaaaatgaatgttggctttcttcccaatttgtggccccaaaagactgcttctttagttctaggtagatacaaaatgaaactcaaaactgaaaacttcaggttccttgtctggcaagagttggcgaaagactaattaactacaaaggcattgactaaacttggcaaaagctgctttctaattgaagcattgagctttaatcagaataaagccagttgctcagaacatagctgctgatatcactaagccatgcactggagtagcactagcccctgcagagagggatgactggaaacaggtggcttaaatgaagggaatgtgatgcccacatggtactactttttggttctttctgaattttctctatattttcactatcttaagtgtttttccacctatacttgagttcttttttctttccctcctgtacatatttataggcatatacataagtatacatatatgcacacacacacacacctcatagttaggacgtcccatattccagaaccaagtgttctcttaccctgccttcaagagttgtcattagtattggccaagttgatatgtcatttctaaagaccaatgtgataaaagacatatttctgtccttcattctgtgttatggtttgtatacgcttggcccagagagtggcactattagaaggcgtggccttattggagtagctgtggtcttgttgaaggaagtgtgtcactgtgggtgtaggctttaagaccctagtcctagctgcctcgaagtctgtcttccactagcaaccttcagatgaagatgtagaactctcaactctgcctgtaccatgcctgcctagatgctcctaccttggtgataatggactgaacctctgaacctgtaaaccagccccaattaaatgttgttcttataagagttgctttagtcatggggtctgttcacagcagtaaaacccaaagacatatatataacatctccctcctctgtctctatctctccccatctctctatactcttctcccctcagatgtggccttttatgtcctcctccacacctaataaatctcttgtgtgaggtctgttgctgtggcgtcatcttttctgtattccttggccttctgatcaccacaaacatgtccatgtatatcacccttt

SEQ ID NO: 4761 - DNA, 1000 bp, mus musculus
tttattctaatcacattcttcttttcttttccaccagaccacaacatcctgcttgttttaatagtgaaacacaaatcttcctaactgccttttaaactgctgtgagaaaagacaaagtcaactgagctaaagttagcaattacctgtcagttgacagggcctcctgaggtgggaatcaggcaccgccttgctgggttcctgccaggtggtgtcactcacagttgttccttctgcaataagtggaagactggttagcggcagtcacagtaataactgccgagtacataaagattctgaaatcaagcaatctcagcacacagttgtagcttggtagtcatcagccccttgtatgcaattctagtcagtgaatagttgccgcaggctccccatttatgtagaaaaactcctaagtctttcacgtagatgtgataaaacagtggtcctcggatgcttcctaggagcttatgatgctattgttcctttagtgctttcttgaatttcctatcgtcatcatgtatcagtaatagtgaccctaccttcaatatgcaccaacattttaacaaaggagtcaccttgttaaagcatgtaagtagaatgtatagttatgaagtttcatgagccatcaaatatccttggctagaaagactcgctctgtggactctgtacactggagtaagccttgactggtgaggagcagctcccatgggtagacaagcaccccctccaggccactcagcaaagacttcccattctacagtctctctcataggctgacataaacaaattggaaaccgtgcaactatgatggagcccagacacaaatcaacgtactgggttctatctaaagtcactagtactctgtgggctctgacaaataagacatggtctgtatcgatcaaggcaggaaggacatgaaaagtccagatgtcctgggtagattagggtcatcacctaagtcaggagaaccttctaggtcatgacaggagatcagttttgaaga

SEQ ID NO: 4762 - DNA, 1400 bp, mus musculus
aagaagtccactgagaagttcctacagtttatatatacaccttcagcaagatacaaggttatctcacaaaaaatcagaacgcctatatacaaatgagaaatggagaaaataagtcagggaaatgacaactttccaatatcctcaaataatctaaaatatcttgggagtaactctaaccaagcacgtttaagacttgtataaaaaatgatttgaagaaaggcattgaaaaagttatcagaagatggaaagatctccaaagctcatggattgttaggattaacatagtaaaaattaccatcctaacaaaagcaatctacagattcaatttaattccatcaaaatatcaatacaattcttcatgtaccttgtgttggtttgaaaaggtttggccctctcatgtgtttgaatgcttggctcaaagggagtggaccactattaggaggtatggcattgataaagtaggtgtggcattgttgaaggaagtgtcattgttggagtgggatttgagatttcctgtgttcaagctctgccctgtgaaggatcagagcctcatcctggccgcctgagacagtttcctcatggctgcctttggatcaagatgtcgaattcttggcttctccagcaaccagtctgtctgcgtgatgctgtacttcccgccgtgactcctaattgcaaatagaatatcatcaatactgtcagagattggtgcttgcccatgggaaaattagcagtttttaagaatcaactagcgtcaccgaggtgaaatctttgggaagtgttttctgagagcacaaagtagctaaagctccagagatagacattatgctggcagccagactcagtaatgtggaagaatcaactaagtggtgctggttttgaaggcatgaaaagatcatggaagtcagctgaggcttggcactgtgagaggccaggaaagccattggtgatggtacagtctcagtggcagatgaagtcccaggattgtaggggtcatacaaagaagttgagccttggcaccatgaagggagcttatgagaggctattggtgaaagtgcagcctaatttcagaggaagatgctagcatattggacatgccagtaccatgggataaccactaagaacagcaacagaagtgggacagagtcacccagaacctagagtgctacagagggcagagctggagaagtgacccaagctctgaagaccatgtgtggatgtcagacattggaacaagaagctgtcacagtaaagttgtcttggagaccccaaaagagtagagatgccgagtgttggaagacctgctaaagaaagctgctaacagcatgtggaaccagcctaaaagaaagaaatgtgttgcagtcaacaaaactgaaaggagttggacatcagacatagagata

SEQ ID NO: 4763 - DNA, 1000 bp, mus musculus
gtgtgctgcattctgatgatggtgagtggtcttggtttctgttagtaagattcttacatttgcctttcgccatctggtaatctcagctgtcctaagaattcattgagagtcctctaaggggaccttagggtgtctgccaactctgtgcccaagatgacccagtgctggcaccaaccggaaggtgacattttatgtttttaactggaagaaaacagtctttctgaaaaacaagaggcaatgtcctaccagcctgatacattagaggaacctggattaggaaactaacatggataagaactcaacttagaaatttcttttaagtgctgaaggcacatgttcttctcatttgcatgtgatgttatgaaaagccatatcaacccaaaactggctagtgtacagcaaagttagagagaggcacacatggtaacatagggcagactgtaacctgcatagctaatgttggtgttgcttttattttgacatggacatatttgtcattgcattaaaatatatcctgggatccattccatctactggcaccaaacccagacactattcctgatcttaagatatgcttactgacaggagcctggtatagctgtccccctgacagtcttttacagagctggaccaatgtagatgcagatgtacacagccaaacattggattgagcacagggactccaatgggaaagttagggcaaggactataggagccgaaggggtttgcaaccccatagaaagaacaacaatatcaaccaaccagaccccccaaagctcccatggactaaaccaccaaccaaagagtacccatggctccagcaggatatgtagcagaggattgccttatctggcatcactgggaggggagcttcttggtcctgtggaggctcgaagacccaggatatggaacgctaggctgctgagacagaagtgggtgggtgggtgggggagcaccctcatagaagcagggggagggaagataggatagggggcttgtg

SEQ ID NO: 4764 - DNA, 1000 bp, mus musculus
gttagaggttttgctgggttagtaaattagttggtatggactcccctccaatgaccttgacgtcattggaactgaatagttggcttggtttccaggactaagcattgtttccctcttgtttaatggttcttaagtccaattagagaactgtttgttactgtcactgtatgcagtgcatgaccctactgtacccttaggattatagtgccacactggtcgatgagatgtggttcctaagtgttatgtctgggtatgagtgttgactgtctctctcctttgaaagcttgcatggtaccatgaaagctagccctcagaaaagaggcatttgggtcagtttcagtacaggagcctctggactctcagtggtgtctccagcacaaaggacttactagtcacatctggggaagtgaccaagggcagcagctacagcctgtatggtttaggtgtctcctaaacatttcatattattcctaaacatctttctctttagacattgtcaacaaatcacagcaaagtgcttttcagatataaatggcaaatatccacctgcttattcctgcaatgatatgaagatgaccaccctcaccttgtctctgataccctcaggaccaatctcacaacctcgctgttcctctttcccttcagtcattgctctaaaccacaacacacatttgttgcctaactgcattcacttcagaaacaccttcaatctctgttggagctcctgagctgctacaggacaggtttctgtcactttctaagccatagtgatccagacacaaacctaaggtgggccaatgcaggaaaggctgaaggagagcatgactgcccgactctggcatggctcagctggacagttcttaatctcatcacgcacagcttttcaaggatgcctggcagcttgagctcacgcagcacacagtaaggattcatacaatcgggtgcattgtgaatagccagcctcccgtcactctctggttcatcctttcctgttcctttt

SEQ ID NO: 4765 - DNA, 1600 bp, mus musculus
tagaaatgtgtcatggaaggaagcaccaagaaatgacttatatagtgaaataaaggtttggattctcaagccttgaagctcagctcatcattgtagtgactgaggcttctcaaatctttatatgaattaggtatacatataatatattgtattctatatttactgcaattgttgcaaattatcagtgtgtcaaagaaaaagttttatgtgggtttatttctaggtctttcatttgattccattaatcaacctgttgtttctttaccaaacccatgtagttttgttttgttttgttttgttttgttatcactattgctctgtaatacagcttgagaacaacttcctttagaagttcttttattgttcatgattttttatcaatgtaaaaaatctttattattataaaagtaggtcagtcattaatttaacaaagtttttttattagatattttctttatttacatttcaaatgttatccccttttctggtttcccctcccacctccccctgctcaccagtgtacccactcctgcttcctggccctgacattcccctacactggggaatagagtcttcacaggacccagggcctctcttcccactgatgaccaataaggccatcctctgctacatatgcagctggagccatgagtttctccatgtgtactctttggctggtggtttagtccttgggagctctgtggggtctggttatttcatattgttgttcctcctatggggctgctaaacacttcagctccttgggtcctttctccatttgggaccctgtgctcagtccagtggttggctgtgagcatctacttctgtatttgtcaggctctggcagatcctctcaggagacagctataagaggcttctgtcagcaagcacttgttggcatccacagttcaggattgttttagctctccggggttttgttttgttatgtttttatatatgaagtcaagacttgctctttctacatctttaaagaattgtgttagaattttaatcacaatttcattgaatctaaagatagctttgggtaagatggccatttttgctatgttaatccaaataatccatgagcatgggaagatctttccatcttctgatatcttcagtttctttcttcaaagacttgatcatcttgtcatacagatctttcacttgcttggttaagaattacaacaagatattttatactatttgtggctattgtgaaggatgttatttgcctaatttctttctcagcccatttatcatttatgtcaaggaaggctactgatttctttgagttgattttatatccagccactacactgaagttgttgatcagctggaggagttctctgtagaattttgagaactgctcatgtatactatcaaatcatctgagaatagtggtaccttgacttctacctttcaaatttgtatctctttgatctccttttgttgtctaattgctccagctagcacttcaagtactatgtcaagtaggtaggggaaaagtgagcagacttctctttcttgtccctgattttagtggtattgcttctaatttctctccatttaatttgattttggctattggcttgct

SEQ ID NO: 4766 - DNA, 1200 bp, mus musculus
gtataccaaacagtttattaatgtcatattattaaaatcgaaaataaaacattaccaaaggccaaactcattttttaggacataattataccagagtagcatgtataattttttattggatattttcttctttgtttacatttcaattgttatcccctctctgagttccctgcctggaaccctcctattccatgtccctccccctgtttctatgagggtgttctcccacccatccacccattctttcctccccgacctcgggttcccctatactgggccttagaacctccacaggaccaagggcctctcctccaacaaggaggatagtataatgccctacaagtagtataatgcccaacaaggtcatcttctgctatatatgcgcctggagccatgggttcctctatccttctgtgtgtactctttggttggtggtttagtccctgggatctgggggggtgggatgggagggggttggttggtaggtattgtgctctttctatggggttgcaaacccctttagctctttcagtcctttctctaactcctgcattgggggccccatgctcagtccagtggctggctgagggcatcacctgtatttgtcagactctggcagagcctctcaggagacagctatatcagtctcctatcagcaagcacttctttgcatccacaatagcatctgggtttggtggctgtatatgggatggatctccagttagagcagactctgaatggtctttcattcaggctctggtccacacttagtctccatgtttcctcccatgaatattttgttcccccttctaagaaggactgaagcatccacactttggtcttcctttttcttgagcttcacgtgttctatgaattgtactttgagtattctgagcttttgggctaatatccacttatcagtgaatgcataccgtgtgtaatttttttccacataattcattcttagtataagtggcttttgaaaatcagaggaaatttttagtatgatctaccttctttgaaaatgtttgtgcttataaaaactaataaggactctaatgctgccaaatgagatactcattctcattatctgtttcattaggtctttgccattacatttaacttattttctgaaaatggggaaatgcagtggcatatgatgaacagtagaagtgcaaaggattctatgtcaagggtttc

SEQ ID NO: 4767 - DNA, 1000 bp, mus musculus
aagaaagacagcattttcaacaattggtgctggcacaactggttgttattgtgtagaagaatgtgaatcaatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacccaaaaaataccgaatggcagagaagcacctgaaaaaatgttcaacatccttaatcatcagggaaatgcaaatcaaaacaaccctgagattccacctcacaccagtcagaatgtctaagatcaaaaattcaggtgacagcagacgctggcgaggatgtggagaaagaggaacactcctccattgttggtgggattgcaggcttgtacaaccactctggaaatccgtctggcggttcctcagaaaattgaatatggctcttcttaagaacatgatatgcttgtttgtttggttgttcggttgtttggttggttttgcaagacaaggtttctctgcatagccctggctgtcctggaactcactttgtagaccacgctggcctcgaactcagaaatctgcctgtctctgcctcccaagtgctgggattaaaggcatgtaccaccaccgcccggcatgatatgcatttttgaagagggcactcaagtttcttcatatgggaaaagtatacttttgtgaatttgaaaagggaggactat

SEQ ID NO: 4768 - DNA, 1000 bp, mus musculus
caaaacccgcttggattgtcagctacacttcaaaaccataattgtgataaatgaattttgatgtcctctaccatcatcatgagatatgcctttaaatccgggtctggcttttccggtgtgttggactacccaggactggctgaggtgggagtgctggattctgatgatgactagtggtcttggtttctgttagtaagattcttatgtctgccttttgccatctggtaatctctggagtcagttgttatagttgtctctggttagagcttgttcctcccatgattctgttagcctctaacagcagacctgggaaagtagctctctcctgagtttcagtgatcagagcactctctgtaggcaagctctcctctttcagggaaagtgcacagatatctggtgttcggacttgcctcctggcagaagatgaaggcccgaaacagggcctgtccaagaagctgttagcttctgttgtccacactctcacctgtgcagactagtcttggtgggatctgggaatgaagatggctcctgcagaagctcctgcaaaaccctcccggggagggtggacacctctcctctggcagggaaggtgcctgaatgtcgagccaaaatgggggctgccttagaagctctgtggctcctgcctgactcagaagctgttagcttctgtagtccacactctcacctgtgcagactagtcttggtgggacctgggaaccagagagttagttcttcaaactaaccttacctacattgtttggaattaaagtatgcactacaggtgtgtctgtattctatccacagcagccatgttgctggattaaaattcctctacatccgggcagtggtggtgcatgcctttaagcccagcatttgggaggcagaggcaggtggatttctgagttcaagtccagcctgggctacagagtgagttccaggacagccagggctctacagagaaaccctgtctcgaaaaaccaaaaaaaaaaaaaaaaaaaaa

SEQ ID NO: 4769 - DNA, 1000 bp, mus musculus
acttcgaggcagaggaaggtggatttatgagtttgagacctgcccggtctacagaatgagttctaggacagacagggctatacagtgaaaccctgtctcaaacaacaacaagaaaaaaaaaaaaaaaaaaaaaaagaaaaaaaaagaaaatgaaactcctaaagccaagctaatcatacaatccaacctgttacactacactatttttagtaaactgtatagttagaatttccccaacagccacctcccacccaggccagaccagtggcccagctgatacctatgcaaactctgcagcctgtgtgcttcccaggaggtctgccatgaccaaggacatagatgaaaatttcactcaaatacccatgccagctgagatactcacacagcccagttgaagcaggacctatccacaccaccccctcccctcccacccccaatgcattccgttgagctcaacctcacttctgtcctacttcccaacctcagccacaccagtggtcaactactggcccaaactctatagcctacaagcctcccaggaggtctgaaataaccaagggcacaggaagtctgcaattaccaggggcagaggaggtctgcagtatccaagggcacaggaggcctgtcctaagcagaaacacaagaggatcacactaaccagagacaatactgcctgcctccaaagatagaagctctaactcaggtcactaagctctacaggcctataaggatgctggttacattcagagacatccaggacagttaacaacagagagaaccagatatcagaggcaagcacaagatcttaagctacagacctaacacaatttggaaccattagaacttagttccccaagcacagaaagccctgactaccctatcatgcatgaaaaacaaaacaatgacctgaaaattccatttaataaagaggatagagttctttaaggaggatataaagaactcctttgtgaaattcctaggcaaatggttggacctggag

SEQ ID NO: 4770 - DNA, 1200 bp, mus musculus
ctatcatatcttctatgcctgagattctcttccatcatttgtattctattggtgatgtttgagtctgtagtttctcttctcttacctagatattctatcttcaggattccttctgtttgtggttttttttttttaactaattgattgactgcttaattgattgattaatatcccaaattaatatcccctctaagtgccccctcacacagtccctctccatatcccgctctcattctcctctgagagggtgacccgtgccagtattccccaaccatggggcaccgtctcccaatgagtccagatggcctctatttctattttcaggttttgaacagtcgtattcatttctttcacctgtttgattgtaatttcatgtattttccttaatggatctattcatttcatctttaaaggcctctattatctccaagagattggatttaaggtcattttcttgtgcttctgctatgttagtatatccagtgcttgcgcagtaagacagctgagttatggtggtaccatattgccctggagcttgttgattttgtttttctactggactttggtcacctggttgtccttggtgttggtaggcctggtagtacctgatagcaacaggcctatgatagtcccagaggagagtaggcatttggaaatgcaggtagagctggtagtcccatatagaagcaggtctctggtagaacctgatggcagaaaacctaagagaatgcaggacgaactgagagctgagaaatggagggcacaaggaacaggaaggagatcaccattgctgcgcttacctatacccagagaaaaccccgaaggcaaggaatgggggagaaaggtctctcctggtagtacctgatggcagcaggcttttagaaagctagaatagttgtggagttgtcaacagagggcacatggggcagggcagagctcacagctgctgggcttacctagagaggtcttgacaggcagatatcttctctaaatttttatgtgccaaccactatacagaaactgtccttcattgtagttgatttaccaataatgcacaattgaagttttatttcatagctatccattttgttggcttacttatgacagagattggcccacacaatcatatgtaatattaaaattggtgaaataaagataagaaaatcctgaagtaaattagataaaaagtagttaataaag

SEQ ID NO: 4771 - DNA, 1000 bp, mus musculus
ttaataagaagagcctagatgcctggatatttttagttcataatatttaagaacttgtatagaaaaaaacaacaacaaagacaacccagtttttgttttgttttcaaatgttacaaactattctagtgtgtctgccatgttttctccaaacatgtcagccactggaaaacatattcctgttgagagtattcatctggggggtaaactgtactttattaaggggtccccaggtatccctaatcgatggacctgtccaaagtgattgtggtgcctatattggagaatccagtctggggtgaaagaaaaatctggggtgaaagaaaaaaatgtggcggtgaaggctgaggctgtgtccctgaccatgatctgaaatgtggaggctgagactggaattatgaagactggacaaggacacctagttaccacacctagttactaagggatatggtgatctgttggagcagatgctaggcctatggctgtctttgaacatgtgctactagggacatatttgattctgttgtcctgtgatccaattattgctccacctcttgctcctgcagaatccactgctaaagggcgggatagatgttcaggtactgtctcctcggaggtcaggctttcccagctggacaacctattccatctgagtagccatctgggatatggagttgccctaggtggagaaatactgtagcctgcattgttgctagagaagacatagctgttacagtggcattagtaacaacaacaacaacaacaggaacaacaacaggaacaacaaaataactaataagcagtgctatcatgccaggaacatggcagaacacagccagttccagaagctgcagggaccgacctgaaggccaacgtgaatgtacattatattttgaaaaatacatttgtactttgttattttttttcataggtatagttttatcacagataaaaacacatctttgttaataatacatatctacaatatgggactcaataaccc

SEQ ID NO: 4772 - DNA, 1000 bp, mus musculus
catcattggtttttattgaatacttggtttttttgatgattagtaagtagaaattatttctaaaattttaaattaatatgggttccttttggtaagagattgaattaaacacacttttctacttatttttgctttttaaaaattttaatctttttttttccaatccagattttatccctcgagttggtccaccctctgactgttccacatcccatacctcctcttcccatatccacaaggatatcctcatctcccattcccatcccagcagacctacccactccatggagcctccagtctcttgagagttaggtgcatcttctctgactgaacccagacctggaagtccactgctgtatatgcgttgggggcctcatatcagctggtgtgtgctgcctggttggtggcccaatgtctgagatttcggtggtctaggttaattgagtctgctcatcctcctatagcgtctccctcttcctcagcttcttccagcttttccctaattcaaccgtagaggtcagcagcttctgtcgattggttgggtgtaaatatctgtatatgatactttcaggtgcttgttgggcctttcagattttcctggcatctggtgcccttggttaactttctcattccaactgcttatacataacttataaaaatttcaataaaaattatgtgacctttaataaagcatattttaatttttcctccaataatttaacttttatttgttttatagtgtgaacactagtacaatttggaaagtgataataacagtatgtaatgtcaaatttccaaggattttttataatatttttaattacttctgtattattctccaacaattgagcactctaaaatttcaaggcattaaattcaaatatttgacgaatttgtcatgaacttttctgtattgattaaggtaaattatgattttttccataatttttctgtgaggatataatcctaaactatcaaatcatgaaaaagccctatatca

SEQ ID NO: 4773 - DNA, 1000 bp, mus musculus
catgtgctccagcagggggtggtataactccattttaagcaagaaatgcttgtttctgctcttgcacccactgtccttctatcatccctcagtagggcttggcattttggatgtaaagacttcctttctctgtctttctctgaaactacagtgaaatgatgaaccacgattggatgtagatttttatgttctgaagtacaaattcacatgctagatattgctctcatttataaagtgcctctttctgccatcctaacagaggatgggtaatatttcagtctcagaaaaaattgcagatagatccatcggaagctcatattagtcttgttcattaatccagtcacctctcttgcaaagatcagcatacacttgttcactacaagatacagagctgtcattttgtgggtgggttgggttggtagttgtgtttaactgttcatttgtaacatggagaggcagttctgaattcaaacaaggcagtctgaaaaatctaacttagatgcaattgcaattaggagagtgtagtgtgaagtaatatgggggcaagtttgtgccgattgatgcgctgtctggaggaaatcatcccagttgtagagtctgtgcatttatcatcgctgatgccaagtgtgctggaattcagggaaaggggagaggttggaatgcttaagtagctaggcataaacagtgcacaaaggcagatacactttgggtctctagatgtagcctgtatttgaaattgtgatttagctgatttataatcagcacgcagggtggttagagaggagaactgtggcaaggaagcctgcctgcaggggaacccatattcctcgtcaatgaaacaggacagacggatggcatctttgtaaagaagatctctctgtctcgtgcagtggcatgccatgcagacacccttagtggagtatccgggggaaccagcttttctgtgaacaagcatgtagtatcgctgtgccatgtgctgtaaggaagtcaaagacgcctg

SEQ ID NO: 4774 - DNA, 1000 bp, mus musculus; identical to SEQ ID NO: 4773

SEQ ID NO: 4775 - DNA, 1000 bp, mus musculus
aactttttctcttcatggaacacttagctccagaactacatggcattgtatgcagtcaatctcaaatggaaaggaatgagctttcagaggtatgaacagctatgcatgctctgctgtgaattcacctcacttctcattggtagaaccacttcatatgattagccacaggtgaatcagaattgaggagaaatacattactataatagctcctgattgaaattaatatttcctgttaatgacaaggaatcttgccttacttgaagctgaaaaatgaccaggtcaaataagtgtgaaattggttgtcaaatatgttgtctaacatgttgttttagagggtattttgttaaaaaaaaaataaaaacagtttcttttaaaaattattgtatgttttattgatttacatttcaaatgttattccttttcccagtttcccctccagaaactccctatcccatcccccctcctcctgtttctatgagggtgttcccccacccttcacaggaccaagggactctcctcccatggatgccagataaggccatcctctgctacatatgcagctgaagccatgggtccctcagtttctaaaaccaacatttataaagtacttgctgtgtttatgagctctgagtgtgtgaccttatattattctccaaatatagtttggatgtgtactctgctttacacatgagtaaacaaagattttgaagccaatcaactcaacaactcctgaaggtgcttgctgtccacgctggaattgagccttagatgattggcagaatgttgccctcttggtgctgagttgccaggggaatagatggctgatgctgcaaatgggttttaccttgctgagtttcagtctgaagcaaggaattgtcttctatgtaagtcagccagttctcacttaatcaagctattagcacgaacttattgaaaacatatatccatatgtagctttcaaaaactaataactgaattaaataagaggtataatttgagt

SEQ ID NO: 4776 - DNA, 1000 bp, mus musculus; identical to SEQ ID NO: 4775

SEQ ID NO: 4777 - DNA, 1000 bp, mus musculus
gtcatgtataaatgtgattttatgttgagaaagtaaggtgtcttctgaaatttcaaatatgtttagatatttcaaatatgaactagcttttccactttactttgcctgacttgttacctgtaataacactgaggaaggagtgtgtgtgtgtgcgcgcgcgtgcgcatgcacgcacaaaattctcattaagttgcattgacaaataactttatacactattaaaatgtatacatttacttatttcttttaaatatgtcctggtgtgtatttgctttgtatacttatgatgaaagtgagtggagccctaccagctcttcacctgccattaaatcatttgattatctacctgattatgttgaaggactgtgcatgaaaacaggttcgaatataattcataatataatacaatataatccattctagcccctatttctaaacattatctccaagaaaaatgtacatctgttgtttcctgtcagactctgcaatgggcaaaacaattaccattattccctgtcttagtcagggtttcacttcctgcacaaaacatcataaacacgaagcaagttggagaggaaagtgtttattaagcttacaattccacagtgctgttcatcaccaaaggaaatcaggcagaaacttggaggcaggaactgatgcagaggccatggggcagtgctgcttactggcttgctttctctggcttgctcagtttgctttcttgtggaaccaaggactaccagccaagggatggcatcaccacccacaatgagccctctcacccttgatcactaattgagaaaatgccttacagctggatctcatggaggtatttactcaagggaggctcctttctctgtgataactctagcatgtgtcaaagttggcacacaaaaccagccagtacagttccttcatgaacaaatggagattttgaggtatcaacaaaatgactttatgaaggtcacacagttgtatgtgtgagggccttaattttgtg

SEQ ID NO: 4778 - DNA, 1000 bp, mus musculus; identical to SEQ ID NO: 4777

SEQ ID NO: 4779 - DNA, 1000 bp, mus musculus
tatcatcctgtttagagaatggtaggcatatagctcaatatccatgaagcatgtaatgtcaaattataagtcagatattcacgtggcaaatgattaaaacatggcttggaagtttatatcatgaggctgtgagaattaacagctgaatagattttgtggcttggtagacattaacccactcaacaataatgtttaaattccctaaagagtatgtgatattctttgagatttttttcagctctagaaatatgacaggcccagaagtggtgtttaagggattcttcttaattactgaataaaaaattccaaaactaagtaccaaaaattgtaatacaggaagaagcacacatggattttgcacacaacaccaccatacaatattaaagccttgtagagttactggagaaatgtagcatatagtttctgctatccctccttaagctcagggaatgggcctcgctaccagctcccacccatatttccttggattcatggataaaaagacaacacgggacactctcaagcctcccttgccaccccaggaatcggagagagtggccattggccattccaataaaaaactatcatggttgcttggctgtatatcctatagatattgcctccttctccagctctctccattctcccttcatcctttccagcaactcagtgtcctgccccatcttcagtctttggtcactggtatctttattggtgaatcgagaaccaattgaggaacaggaccttagcatcacaaccaatccctactgagaaacataaaagtgatagcttgaaagttagaataagacattatgtcctgaagtacactaatgatgtttgaaatgctgtgggaaaaaaaaaatgatccaaaatgcatgagtgtcattgcatgcagctttgccaaagtgattgagaaagagactaatagcaaacgggttaaaagtgtcatacacaacgacagggcttgctatccctctaggttaatgtttataagaagctt

SEQ ID NO: 4780 - DNA, 1000 bp, mus musculus; identical to SEQ ID NO: 4779

SEQ ID NO: 4781 - DNA, 1000 bp, mus musculus
tctcataccagcggatggcatgtacttcatttactcctgactagggccctgtcatgtgacctcaggactccatggagaggatcttgacaatcagtcacataggggacttgctccaagcctgtccacatgcggttgaggcatccctaacatctcagactaggtcaatataaagcatctgccatcaaaccccaacccacaccacaatgtatttaagaccctatccaaaagaagtaaaggtgccgggcttgacagcgcacacctttaatcccagcactcgggaggcagaggcagataaatttctgagttcgatgccagcctggtctacagagtgagttccaggacaagaggtgtgtggtgtttcatcaagggtttttctgagagattttgtcatataagggctgtaacacttcttggagaagagagttatcttccaaagcttttttctctgaaagctaccctcgtccactgtggtcactttctgcccagtgcccggtgaccttgaccttgtttcctatcctctgcaactctctagttagcaaggccccccagctggccacacagcctcttgccacttcttgcacaggagcagcatcagtgattgcacttcccctttagcttgctgctccagagtaacagcagccacagaagagaacaacagcctcctccatcagactgccctctccccatctgagaaagcaactctttggctgctccagccagaccagagcttctatgatctctggggatagcatttggtatactgaccagcagattattgttatcaagaatctaaaataataactattctgcaatggttatataaaatcataaagccacagcccacaataaactgtggtaaactctgacctttgcgatcaatttcccaggcatttatttcccaggcatttattttctttctttctttctttcccttccttccttccttccttccttccttccttccttccttccttccttccttccttccttccttccttcc

SEQ ID NO: 4782 - DNA, 1400 bp, mus musculus
attaacgtttaggacaaagattaatgattttaattcaataaaacttagacatgtttcctagataaacttaaagagattgtgatatattgtaacataaggggtattagctttggttctctgttctaatttagttgtatttaaatgcttaccttattgcacccacttaaagaaggcattttaaattatcagaatatttttattagaaaaaaatccagtcctcatgaaattgaaatatttatgtatcaaaataacttacattaaaatatgggaggagatggggtagaagtacagagggtcgggaatttgaaaggatgtgtgtagcagcagttggttcccaggacccaacagggagcacattagctgaaatactcaacaaagatggagcctgtagagaccatatccagaagataggcatgccccctgattaaggggtgaggccacccacccacttcaaaaatattaatcttgaattccttctgtcaaaagtgtggagtagagactgaaggaaagcccatccagagactgccccacctagggacccatcccacctgcagacaccaaactcaggcactattgctgatgtcaagaagggcctgctgacaaaagtctggttatctgtcccctgagagggggtagccccatgacctgccagagcctgaccaatacagatgtggacgctcgcagccaaacatcagggctgcaatgagcacagggattgcaatagagaagttagggcaaggactgaaggagctgaagggttttgcaaccccataggaagaacaacaatatcaaccaaggagacactccaatctccaagggaccaaactcacaaccaatgagtacacatgaggggacccatggctccagctggttatatagtagaggatggccttagcgggcatcactggggagggaagggagccccttggtcctgtggagacttgatgatcaagcatagggggatgctagggtgctgaggcaggtgcaggtgagcaggtaggggagcaccctcatagagggagggggatgagggaggggatagaggatttgtggaggggaaactgggaagggggataacatttgaaatttaaatacataaaataactaatataaatgggtactaaacacatttatgaggaatattgatatctttgtacttaaaagctcctttttgattcagttatttttaattggctaatatttctagtggagtattacataagtattaaaaattcaaacaaatacattgaaattctcagccaatgaacataatgcttcctctgtactttcactgtatagataccgcactgattggaaatttccaatgacatcataggcttggctaaccaatctgctctcaaaacttgattatttataacacccctttttatgttttattc

SEQ ID NO: 4783 - DNA, 1800 bp, mus musculus
atgttgcttggaagtagtagtgaagacttgagaatattgatatttgtctagatcataaaacaacaatttcaatcatcttatttatacctcactttcatctcattttgttgatattatttgtttttacatagatatcttttacttgatttgttaatttgatccctgtatatcccataacttctaaaaactggattactgatttattttcaagtagttgtagaaatgaaataaatatttgcagcaaaactgattcaacaatcaatttactagctaaacttttctttagttaatttctttcagtgtactgtgtgttggatatgttttctaaatttgtcatttaaatcacgaggcaatgccataaaatatcattaagagtaaatagaaagtcggaaaaccatgggcataatttgtgaaatctggccctaattataaatgagtttgaattagacaaatgccaaaagatttgaggttgaggatagcaaagataataaattattattatcattagtattattattattattttatttattcattttacatcttaattgcttcccagttttgactctcttcttttacagtccctctgcacatcccctccctttctcctctaagagagtagaacctcgccaaccctgggtattcccataccctggcacaccaaatacttgcagggctaagaacttcttctactggggccaaacaagacagttaagttaatggaacagattccacaggtagcccccatttccagttttgtggactcacatgaagaccaggctgcacatctgatacatatgtgctggggcataggtccagcctgtgtgttctctttgcttgatggttcagtctctgagagttcccaaaggtccaggtacttgactctgttggtcttccagtggagtgcctactctccccaccacctctacttcagcttccttaatctcgcccccaactcttccataagagtcccaaagctcgatctaatgtctggatctgggtttctgcatctgctgagtcagctgcatggtggagtctttcgaaggacagccattctaggctcctgactgcaagtataactaagtatcattaataatgtcagggattggtgctagcccatgggatgggtctctagttgggccgggtttgcttggccattcccttagtctttgttccaccacctgtccctgcatatttagtaaaaagaataaaggtcaaaagttttgtaggtgggttggtgtacctatttttgattcttgtcatggaaaggtttaatttctgtcatctgtcctagcttcctattttttcaggagtctacattctcttttatatgacaaaaagcagtcaagttctactccatacattctagaagttgacatctttaaaagtgtagaccaattaaaatccatgcctttattagaagattattttggggtttctctgtggagccttgggtgttctggaattcacaaataatgttacagtcatgaaacttggttttcttgtgggacttctaacagtggtacagggggctttctctgactccgttccctgccattggaagcctttactccttctggcttgtctcttctggcttcaataagaaaggagatgtctagtgttactgcaacttgttaggtcatggctgttggatatatatgggaggcttgcagttttatgaagacagatggaagagaagtgggtgtggtaggagaaaacaggaaaagggactgggagaagagtaaggagaggaaatgtggtttggatgtataagtaagtaagtaagtaaataaggaagaa

SEQ ID NO: 4784 - DNA, 1000 bp, mus musculus
taatatttaaaataagtcattatttagaatataatgagatatgccttaattaaaatctatatatgtttataaaatgaatatttaaatcacactattaaatcaaagaagagagaaagacaaagggggcagtaatggagacagagaaattgcaaatagagattttaatttcaagaggaatgatgggacaatacaacaaaattgaaaatccatggaagagctcagctcactgtcttccaaagccaaatgtctccacgaaggcagatatttacatatggtgccacagcatgatgaacttgagggttaaactcactagtagaaataacttcattaaaagtctatattttagaaaatggaagacctttagaccagtaatgttaaatggagaattaaggcaatgacccgaataattagagtaaaacaagccacatgtatatgagaaaaatagaactttgagttttaaatcatcacaaattactgtctacatatatcacattgatagtgtaattactcagcttgcagtttaaatacaatataagattttaaaccaatgtcatttatgtagacagacaggcaccgatttactgattttaggccacgttttctttcttaataccagaatgattattgtatttaatttaacaaattctgatgttgaaagagaatcttttgttttattttggttttatttatttctttatttacatcccaaatgttgccccttcttcctgtcccctccccatccattctgccattctcctctgagagggttttacctctctctgtatataccaaccctgtcccatcaagtctctgcaagattaggctcattctttcctagtgaggccaggcaaggcagccctgtgaggatcgaattccagtcaggctactgttttagggacagcccagctccagttttgtaggacccacatggagactgagatatatgtgtgctgcatatgagccaggagcctcagtacaaccatttatgctctttggttgt

SEQ ID NO: 4785 - DNA, 1200 bp, mus musculus
actgttattttgggaccttaggtctaaaattcaagaataatcccagttactctgatatatattcaccatcacttcaagaaatccaagggcattaaaatacatagactttcaatgtttcttagttatgaattaaagaataattatgtttcattttcatttattttatcttatcatgcattcatattatgagataatatttagatagaagggagagagagagagagagagagagagagagagagagagagagagagagaggagagaggagagaggagagaagaaaaagagagagagagagattaattaaacacagattcctgactgtagttgataaaggagtttgagcccaaaatacagacattaaataacgctggtgttatggtttgtatgtgctaggcccagagcgtggcactattagaagatgtggttctattgaagtagatgtggccttgttggaggaggtgtgtcactgtgggcaagagcttaagaatgtcatcctagctttctggaagtgagtattctgctagcagccttaagatgaagatacagaactctcagctcttcctctatcattcctgactagatgctgccatactcccaccttcatgataatgggcagaacctctgaatctgtaaaccagccccaattaaatgttgtccaaataagagttgttttagtcatggtgactgttcacatcagtaaaaccctaactaagacagtggtcttagtaaaaaatcatctcttttgaaagttctcctttttaaaaaaaaatatgcaagtggtatatatcatccattacaaatctaacttgaaggtattaaagaaaagatttgttttgaattaatgatgcagaaaagaaaagccacatcgattggaacaccaatgagaccagaaatttgaagaaactgaaagcagtctaaactggtaaccactggaatacgatagatcttaaaaagtggtacacaattttgtaatgaccatgtgtctccaggagattatgaaatctacagtgtgatggacctgaaactttaataccgatagaggggaagtcctttgtcttgtcccattatgacttcctctcccacctttcatttagcactggtatagatgcccattatcacaagtcacatcaataaacctttgatcctactttttataaataaataaataaataaataaatgaatgaatgaatgaatga

SEQ ID NO: 4786 - DNA, 1600 bp, mus musculus
tgaaatattttctctataaataggtttggaattaagaggaaaaataatacatattcatacttagaaacttttgttctgaaagacacagataaagaaatgcactgtaaagtggatccatcacaatgtgagttatagtctgtgacaaaagattctaaagttcttatattgaaaagaatgtaacattttcaaggtcaatggacttaaaatgctaaggtacaattcgaaaatactttcagaagaatccacataatgcagcattgtagaaaattatgtaaatgtgtgatttttaggcattatgctggacaaattactaaaaaagttctttgaagtattttgctagggagaaagaagcaagcttttggtttactgcatttcatgcataacctttgcagaatcagagcaatcacaatgtaaaataattcgtcaagtccccagaaaatataatgactttgcataatgatccccataatcatattatcaatttacttaacagaaataaataatagtgattcaaatatcaaatggggtagttatttctgtatacacaatttactttttagctaagtatctttgcaactaaatgacatatgaaagttattgaagaaaaaattttcatgtttctagtcttgacattaactttaagcataaggtatggaaatctatgttgacttgaatgtatggtgagggataccagaagaacatgagacttagaaccaagaggacatggcaacttaatagggttcatagagcctcacaaaggtagtcacagaacctgcatgtgtctgcactgggtcctctgcagacatgctgtggttgcttagcttggggtctctgtgtaactcctaacagtgggagtgggatgtctctgactcttttgcctactctagtgactttccctcctattgagttgcctcatccagccctgttttgaaggtttgtgcctagtcttattgcgtcttgttatgctgtgttcagttgatatcaatgagtggtctgctcttttctaaagaacagtggaggagcagtggatttgtggagggcagaaggtgtaagagaagggaaactgagaggagtggcatacgaggaggctgagttcagggtgtgttgtatgagaaaagaagttatgaaagaaacatattttcaaataaatgtggttttatattggttattttatttatttacatttcaattgttatccccctttccagttttccctccacaaataccctattccctcctccctacccctgtgtctatgagggtgctcccctacctgtcttcccactctctcctcagcattccccctatgctggattgttgggagccgcgcccacattcgccgttacaagatggcgctgacagctgtgttctaagtggtaaacaaataatctgcgcatgtgccgagggtggttctccactccatgtgctctgccttccccgtgacgtcaactcggccgatgggctgcagccaatcagggagtgacacgtcctaggcgaaggataattctccttaatagggacggggtttcgttttctctctctcttgcttcttgcactctggctcctgaagatgtaagcaataaagctttgccgcagaaga

SEQ ID NO: 4787 - DNA, 1400 bp, mus musculus
atgctagaaaaatgataagccaaatcttggggcagtgagtttaactcttgactaaagtcattctacctatcaaacattttcttctcactaggaagtatcgtttcttccccagccacactttccaattgttttcctgcaatgatgtaagcacagaatgcagtaagagcaaagtggcagaaaaatgttcttttctctctgccatttaagccctaatcacagctcccatgacagatgacattttccacagctgactctacacatcaagagaaattgtagagaaatatgaacttaaatatggaaatatatgaagaaatattaggagagatgtcttatttactagtgggatactaaaacttaaatactgtttctgtgtgaatttaaaaaacagaaacaataagacatttagctcagatattttcaagtataacaaaaatgatgtaagataaacttaaaaatattttaatctcaaaattatcacaagtacagagtattaccataactagagcatagagaaagaatatccacaaaactatatttatattaattaaagtgtagcttccctcagccctgaagcggctgatccagactttgaccttgctgccactgagaaggaaattacctaaggtggagcctaggtggctcttttgttctgccacctgccactgctctctccaagacactgctacctgctgagaagcacctgaggcattcaggaggaacatcttattctgcacatcctacaggctggctccagacaccaagaatggactggcgggggatgggccttcccttttataagtagactctgttagtaaactggagggccttgagcagaatcatgtcttggctccattaatctctctccatctaagtctcttttagccacagcctgcctccctggtgtacctggttcaagtatgccacaggccagcatacaacattaaagattataaaaactttaaatatcatacagttatataagtgaatacataaacataaggtatacttaagttttatatattattcctatatgaagattcaagccaaaccactaagtaacaatttgccttaatcttctacgtattaattttatttatatttttgtgaattcaaattattattccataggatagtttctctatgaggtttattaattcaaaattcattactagtttttctatgtaaaaatcactctttaaatagcccatttattatagtttatagagaaccatatgcattaaggtcaatggtgagatggcatcaataacacagatatgagagtaagaatatgtacctgagaaggctttttatatgtcattaagaaatataagtaacagtttctaaaaatagacagctaaataagaaatgtggggaatacaacaaaggaaaattaataacag

SEQ ID NO: 4788 - DNA, 1200 bp, mus musculus
gcttggaaaacctacccctttgttgtaatttagtatttctaccaaaatataaggaaagtcctttgatttgcaggtttttaaatatttgaatggaaacattaagtaagtagcttacagcacaaagtcaggaaggatcttcagccccaggtactgctaggattctgagttttttggatgactttgctactaatctatttcaaaagtttttatcaattagtcaaaggattttagctcagaattggaaatgtctgtttaggatgtgtcctacatagacaagacatatctgaatggaaagctaagagttctttggaaagtcagttgtgttgcatggtgttttgctagggcaaacatgtgaagtagtgctttccagaagtgacacaggtgaaagactaaggcagacacgtgaaggaatgtttcactgaagcagaaaccgggaagaggaagttctctaaagcaagcttgggaaaggatacatgagggaaggattcttcactcaccccaggcatgcaatgatcaatcttacattgcatagctgaactctatatgccaggactccatagagagaaacacaccaaaaaacttcaggcggtgtgccacttcctcagacttgcgctgattggcagagtgaagacagacttatatgctgaagcaagagccatggaggacacatggtgtttggagggagtataaatgggacttgatgagccctggaggaagttgagtttggcttgcttataaaggtagctatgcaaagcttgttggtctctcatctttgcttacctttgcttccctgaaggaggcacagccaagaactccccccttccccaccccgaagtttctcccaggtccttccttctgactcatgctaaaactgaggcctggctatatctggtacatcatgctactgctgctcatttgtgtttgctgttctgactttaccaagctgaacttctggggtatctgtgaagcgttcgctagtggatctagctgttgatgctaacctgtgagctgatctgctgaattccagacaacacagacaggattcgctcccaagaaccatccaaagtaggtccacttcccagtgttctttcttttctacacttctgatgggcggtgggctacaagagattataaagcatttaagagccatcattaaaaataagcattgaaagaattaacattacacatatctatttaggg

SEQ ID NO: 4789 - DNA, 1000 bp, mus musculus
caattctttaaggtcttctacctgtttagcagtgttctcctgtatttctttaagtgagttattaaagtccttcttgatgtccttcaccagcattatgagatatgattttaaatccaaattttgcttttcaggtgtgttggggcatccaggactggctgaggtgggagtgctgggttctgatgatggtcagtggtcttggtttctgttagtaaattcttacgtttgcctttcgccatctggtaatctctggagttatttgttatagttgtctctggttggagcttgttgcttaagtgattctgttagcctctgtcagcagacctgggagtctagatctctcctgagtctcagtggtcagagtactctctgcaggcaagatctcctcttacagggaaggtgcacagatatctggcatttggacctgtctcctggctgaagatgaaggcctgaaacagggcctgtcctagaaaagatattgcctctgtagttgcatgctcacctgcacagactggtctcccgggtacatggaacacaaggtggctctctcaactgctctactggtcagagctctcctgggcagacacctctcctctggcagcaaagatatcaggatatctggagcccaaaatgggggtctgtcccagtagctgtgtcatttttacatgtcccagaatctgtgttgcttctgtagtctacactctcacgtgagcacactagtctctgagggatctggaacccaaaatggctccctcacctgatctgaaagagccctccagagtggacacctcccctctggaggggaaggtgcccggaagtctggagcccgaaactgggtctgtcccagaagctgtgttgcttgcttctgcctgtcccagaagctgtctcttctgcagtctgctcactcaccttttgcagtctgtgagctgacttgtgcagactggtctctgagggacctgggacccaagaaggctccctcacctctaagtggtgaatactaatg

SEQ ID NO: 4790 - DNA, 1400 bp, mus musculus
tgtaggcaaatgaattgactacaaaatatcatcttgagttagggaaccaagaccgaaaaggacatgcatagtatgtactcacttataaatggataatcacgacacaaattcctcagtttgagtggaagatggttgtctaagatagcaagcactgaggagttggtggactagagaaaggcattctattgcaacaatttcagtggttacaaaatggagtaactatttcaatgccataatctaagggataacagcaaacacagaggagccaaatatccagtaaaggtgcaaagaagaatggttgaatcctcctcagaaggggaaataaaaggtggatggagggagggaagtggatgggagaggggaagagaagggtcaggggcttggggcaatcaagtaagagtagagtagggaagaaaaaacggaaatcagcagtgggctggatgatggtaggggtatttctcagacacacaagagaactgagacaggggtagaagcctggggtagagggtgctatgggagcaactctagctgagattcctagaagtaggggatatggattctgatctggccacttccagagtagggatatggagagcatccaacccacaaaacttttgacctgaaatgtgtcttgcttgtaggatgtgtagcgacaaaatagagcagagacagagggaatggccaaccgatgactggacaaaactgaaatctactctcctggcaagaaccaactcaggtcactattaatggtactctgttgtgcttgcagataggatcctggcataaatgagaggctccacccagcagtcaatagaaatagatacaaagacatgagatggagttcagggagtcttgtggaagagttagtggaagaaccaagggacccgtttccctttaactttcctgtcttgatgaatggggggcccatattgccagaagctaccagcttttgtcccacagccaactctatgtccactttaagcctgatgtcaaagctggtctttggcacatctatgtcctttaccatggttttcgttgaattttcattaatctaatttcacagtttatgagtttccccacatttcaagatataatttcctccatcatctaatttaaatatttttcctacctttgttggaattgctaatgttaattttagaaaataaatctaagtataacatttctattttctttctttcttactctttgcctatgcaccattcttctggggtcagagcttattgcttctttcaattggatcttgctgatagcagcaggcaattaggaaaataaatgtaattacgtgggccagtaatcaatgtaacaggtaagaaactctgtactccataatctcttggggggagtgcatcaagaaaggaaaagaaagagaaaatcacaca

SEQ ID NO: 4791 - DNA, 1200 bp, mus musculus
tcaaaatttactttgcatcaatgtttgtataccattttcaactgcacattttcaaacatctgttcccattatgctttctcttttcacttttttttttctgcagctgttctatcattgactctgataccagaagtttattttccttgattcttctcaaatttggtttttagtttccaaaggaaatccttcataaaagtttagattaagccaatcaatttcttattatttcagttctgtatttatgtggtggcttataatttgctgcaaagagaagtgaacagtgttgatcagagcacacaaggaaacaaaagccacagatggatcttcagggagatgggtttaggcagacacctggccaccgcagcttcagagaagaccacaggaagcagaaatagaggactgggtgccttgaagaagcacaaaagcccgagggaattttctgctttctcctaatgccatgaccaacacatgtttttcagcatccatttctgtgttttttaatacttacttgagacacaagtaataaatgtcaattttaaaccaaaaggaaggaaggagaccaatcaaactagcagcataatagtctttaacagctgtatacttccattatatctactactaatatatattttgattttattcaatttttatccatttcaaatgaataaatttcaagtgaaaagaacattcagccctttgaacatattttcaactttccattattagcatgtacatcgatgaagaataggtgtggatgatgatgtcgtttagcaggttaaagagatttaaagcgatttttggagtattataactaagatttccagtttaaaggcattttgaggaatctaaacaagtaatattatcattaaaatgctgttgaaagtaggcatatttgaaggcataggtgatttctaattgcccagtatcacaaccatattaattcctgaaacaagaacaagagcaaactaatgagtgctgtagcattgactgaacatagatttttcctcttaaatagaaaaaaaacaatataaatgttagatttctagatatttttccagtttagtacaatttcaagagttcttttcaacagtagggaaatcataaatgtttatttgtctgagaagtagttttgactcttagataatcatttcttttcaaatggagacacaaagttcagatattttatagatgtgtttcctg

SEQ ID NO: 4792 - DNA, 1000 bp, mus musculus
aacttacaggtagtctctatatagtaaaggaatttattgatgatttacagtctgcagtgcaactcccaacaatggtcagtagcagctgtggatggaagttcagggatctagcagttgctcagttccacacggcatcaggcaatggagagagagagagagagagagagagagagagagagagagagagagagagagagagagagagacttcgttcatccaatgtccttatgtgggtctccaacagaaggtgttgcccagattagaggtgtgtgccaccacacctttaatatcagatgatcttgaactcagagatctccctgtctgtcttaatcttctggaattcatagccactatgcctcaagatcaccataccaagataaatgtcagaaacttctatctcccagactctagattaggatcactggtatacctttcaattctgtattgtagttcgttccagatatagtcaagttggcaaccaggaatagccactacacccatcatactaataaattttaaaatttattttgtttagaatttgagattattttttgatcacagtacaattacatcattttgcacttcatttttctctactcatacattctcatataactctttttgctctccttaaaaattcatgggctaatatccacttatcagtgagtacatatcatttgagttcttttgtgattgaaacttagtatacccgagatataagatacaatttgcaaaacacatgaaactgaagaagaacaaagaccaaagtgtggacacttttccccttcttagaattggaaacaatcacccatggaaggagttacagagacaaagtttggagctgagacaaaagattggaccatctagagactgccatatccagggatccatcccataattagcctccaaacgatgacaacattgcatacactagcaagcgttggctgaaaggaccctgatatagctgtctcttgtgagactaggtcggggcttggtaaac

SEQ ID NO: 4793 - DNA, 1200 bp, mus musculus
caggggagtgggggtgggtggatatgggggacttttggtatagcattggaaatgtaaatgagctaaatacctaataaaaaatggaaaaaaaaagagatcatgaaattgattggtagtgaagatatacatttcaggggttgaacagagatatgttaaatttaggtgaagaaaataaccaaaaccacaaaaaattagttttcttaagatggaggtgggaggttgtgggattctctagaaagtaccagagacttaggaggtgaagcactctcaggactcaaaaatagggaccttagatcaagttcccaacagtggagagagggaactcatagagtctgtccccagtagaaagacaggacatcatgtgccgtgatggggttgccatcccatagccaaaaactctgacccagaattcctcctgactaaaagaactgcagggacaaaaatggagaagagactgaaggaaaagtagtccaatgacctgtccaacttgggatccatctcatggggctgggcaccaaggcctgacactactatgctatgctgtgcttacagatggaagctttgcatggctgtcctctgagaggcctctaccagcagctgattgagacagaagtagacacttagacccaatcattgaactgaagttggagatccttgtggttgaatttgggtaaggattgaagaagctgaggaggagagtgaccccataggaagaccagtagtgtcaactaatctggacccctgacatctcacagacagtaagacaccaaccaggcagtatgcacaagttggtctaaagcccctgacatgtatatggtagaggactgactacctggtctggcctcagtgggagaagatgtgcctaaacctggagagacttgaaactccagggagtgggcagaactagaaaggaggtgttggggacatcctcttgaagacaggtgaaatgaggaattaaatgagaaactgtgggagggggactgggagggggaaaccaacagttagactgtaaagaaataaaagtaagaataaaaaatagcttaaaattaagtagcagatatttagttatattttcatagccttacaaaaaaataaatatttgatatatttaactattcacacttaatcatatttcttttatagggtctaatttatgctaccattttaaagctaaatgtttgacctgctcataaagatttg

SEQ ID NO: 4794 - DNA, 1000 bp, mus musculus
ggacaggggaaacgtcaaccttttgtggatgaatactccttctagtgcactatttactgaaggttctccaaagcatgtgtacaaggcaacctataaatcagatgaccgagaacctcttgatttgtttctctgagatctactcatttgcagattatggtcccctaaataattcccagacaataataccaggttgttgtggatagcccttggggctaattatatttgatgctaattctgttctcctgtgagtggttgtgaacaaggaatgggtcaacactcagatgattccctgtaaacctgcttcccaacttaattggtaaaataacggagagctgatgattgggtagataaaagggaaggtggagcagaaggtgggagagagaaggagaaaatggaagagggagaggacacggaggaggaggaagaagaagaaaagcagggctgaagcacatggcctggagaaaccacaagttctaaggggtctcatagatgtggaagatggtagtatagtggtagatctgcccagtctaggtgcacaacatgtaatcatattaactgagtcgtgttttcattgctgggtcatagttgggaggagatttcatgcaacaccaggtgacatgacaatctagaagacagatatctcacaagtccctactacataataaagatgacaatattttctcatattcaatatttgtaaaagaattctgagatataaactgagtgtgaaaatgttatgttaacaaacttaagtaaaccataatgagagatacagtatcctcctcactgaagaaaagaatcaggcgtttttagaatacgttgctactgttcattgtttggcctctattaaattcaacatatttatttttactgattaattcaaacattacaataataatgtacataattggactaagtgagaatatttactatagttcaattttaaatagagatataattcaaatgacttataaaggaacagtcaaatgttgaggtactg

SEQ ID NO: 4795 - DNA, 1200 bp, mus musculus
taattataatttagaccggataggtgccatagaagataatttttaaaaaatgatctttaatctttttttttttttacagtctagtcattacgcccctccttgtctgccctctgatggttgcacattccattcctcctcccctgtgtccaagcggaagtgcccaatcccttctacccagcccaccccaccaggcctccagacttcctgggccctaaagtctcttcagggttaggtgtgtcttctcccactgaggctggaccaggtcgtcctctgctgtatatgtgtcagaggcctcagaccagctgctgtatgctgcctggttggtgactcagtgtctgagagatctcagggatccagattagttgagactgctggtcttcatcgggggtcaccctgcttctcagctgcttctagcctttctataattcaaccacagggttggttataagtacctgcatctgtctcaatcagctgcttgttgggcctctctgaggacagtcatgctaggctcctgtctgtaagtacaccatagcatcagtaatagtgtcgggccttgagtacactccttgagctggattccaatttggacctctaactggacctcctttccctcagtctcttcttcatttttttggccctgcagttatttcagacaggaacaattctgggtcagagtttttgactgtgggatggcaatcccatccctctacttgatgctcttgatgtccacctccagatgaactctacaagttccctctccccactgtttgacatttcatccaaggttcctccctttgaggtcgaagagtctctcgcctccgagatctctggtacattctagagggtcccctgccccctgactttccaccacctctggaggttgcctgtttccattcactctgctggccctcagggctttgctcctatttttcccacccaatacctgatcatgccccccttttttcctcgtctaaatctcattatacatttgacatgtatgttagaaaactctctaatgtactagtgaataaattaattttaatctaaagccagcatatctgtgtttctacatgaaatgcatgtggcaaatatctgaattttacttataaattttcatatttatcatgaaggcaaataaaacctcttgaaaataatacatacccacgtaaatatatgtacatatagttgccgtatgtatat

SEQ ID NO: 4796 - DNA, 1200 bp, mus musculus
tgaccaggaaatctactgtgagcttatgtctcctagaaatcgtagaagagcttcattcgcaatactgaaacagaatttttaaatgaagaagcacacatggataaaagtgtttaaaacaatgatcaacatccttacctattagggagatatcaattgaaaacatgtcaatacacaccatactccagcctaaattactaagatatatatatatatatatatatatatatatatatatatatatatatatatatatatgtaaatgaatgtaatgtggacgtgatgttcatctagtgtcaactctagccaagaaattattggcaatggatttttcttaggggaaggttggggagggagaatttattttctgcaaaagtgtaatcccataaagatattaattctacttccaactggtttttgctgctggggcagaactactagttgttctactccagtgaaggctccatatccaatctatcctagaggacccactgcactcagaacagttggaaccactgcactcagagcagttgagcagttgatgaccctctgcactcagagcagctgaaggtcagctgcactcagggcagttagacaatagcttgactgctccactgaagacccaacagtctgaaggcctcccaggagatctactgcaaccacagcaatagatcagcagcttacctgcccctgcaaagagcccccagttggaaggtctcacaggtggtctgatacagccagggctgcaagcctaccaggagatctgaagcaaccaggaacaaaagaggcagattccatacagtcacccaaaccagcaaacaccagggttatgcagatggcaaaaggcaagggcaagaccataagcaacagaagccaaaatacatgggaattatcagaacccagttttccaaccacattaagccctgaatacaccaacacacctgaaaaatcaagaatctgtcctataatcctatctcatggagataatggagtcctttaaggaggatatcaataactcactgaaagaaatataggaaaatacagataaaaaggtgaaggaattgaatgaagctatccaagacctaaaagtggaagaagaaacaatgaagaaaacacaaatggaggtaaacctggaaatggaaaacctaggaaagaggtcaagaattacagatgtaagtattaccaacagaatacaagatctag

SEQ ID NO: 4797 - DNA, 1800 bp, mus musculus
atcctgagtgaggtaacacattcacaaaggaagtcacacaatatgtactcactgataagtggatattagcccaaaacctaggatacccaagatataagatacaatttgctaaacacatgaaactcaagaaaaatgaagactgaagtgtggacactatgcccctccttagaagtgggaacaaaacacccatggaaggagttacagagacaaagtttggagctgagatgaaaggatggaccatgtagagactgccatatccagggatccaccccataatcagcatccaaacgctgacaccattgcatatactagcaagattttattgaaaggacccagatgtagctgtctcttgtgagactatgcccgggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctaatcggccatcactggaaagagaggctcattggacacgcaaactttatatgccccagtacaggggaacgccagggccaaaaagggagagtgggtgggtaggggagtgggggtgggtgggtatgggggacttttagtatagcattggaaatgtaaatgagctaaatacctaataaaaatggaaaaaaaaaaaaaagaaaaccacatgtgctctgctatagtgcaaacttctgcttattccacaccaggaagtctttattggctaaaccccatgaaaagctatcatcaactcccattgtctctgcttttacaacagcattgaggacagagaaacacatccgcttgtcttcagatataatgatgtggggattcaaagatccttgctttcctcccacagttggaatatggagaaatgcagccttactgctggtactacttgagattctcgcttcagtctgccctaaggattaacagattctgcaggcaagacagaatgaaatgcaaaattgcataggaaacttgatgtttctctatgagacatttaaatctatcttatttagtatctggattagtgtgcagcaaaactgtatatttccactctcatttcaagacgttgcttgtaaactgttttgccagcggtaagatggaggagattcattgggtttttattattttcctataatttatattatctttctgatctttcaaatgacagtcttgatcctggtttacattcttctttacagataattaagtttccttcagagaaaaagaggaagttctaactcttacatgtcaatgtaattgattccccaagatattcatttgaaaaacaaaacatgaatcattcatgctactaaattcacagctcttgtatggaattttaatagctattgttcatgtgaacctgaaatcttaaatactctgtctaaaatgttctccagtcattttcttcttgcttaaataatgcaggcagcactgaaatgattcatcaaggggtatttgtatatttgttcagttgtgtgtgtgtgtttgtaataacaattgttaaagaagagaaggctatgaatttaggagggagggatgtgagggaacatgagaaatgtagaaaggagaaaagggagaaagatatgatgtaaaaattatatttaattaaataattttgttgcttcaagattttttagggaacagaaaaatagagttaattttgaaacctgctatagttttatttgttgcaaagagaaca

SEQ ID NO: 4798 - DNA, 1000 bp, mus musculus
gtactcactaataagtgtatattagcaaaaaaaaaaaaaaaaaaaaaaaaaaaaaggaaataaagacagaaaaaagaaaaagaaagaagaaaagaaagaaaagtagggaatacacaagatatagttcatagaacttaaaaaaaaggtcaacaagctgaagtctccatgtgaggaagcctcagtcccacttgggagagagaagaaagcaatcacaagtggggagggagagaggggactgggaaggaaagtggacagatgggtcaaggaaaggggaacctggtggtattgggttagggaaaaggactgcacccctggtggccagcaaaaagaatgcaaacaggcaacttcaggaggtaggagattgaggggaccttccagaatgcaccagagacctaggaggtgagagactctcaggactcaaagttagggaccttaggtgaaatacctgacagtagggagagggaacttatagatcccacatccagcaggaagtcatggcatccagtgagggagggggtgaccatcccacagtcacatttctgacccatagttgttcctgtctgaaagaactgcagggatgtaaatggagaggagcctgtggaaaagaagatccagcgacaggccctgagtcaaatccagctcaaagggaggttccaaggcctgacactattactgacgctatggaatgctcacaaaaagggacctgtcataacaatgacagcactctgtaatactcaacaagcagctgaaagagtcaggtgcagatttttgcacccaatcaatggacagaacctgctgaccccagtggttgaattagggaaaggctggaagaacctaaagaggagggagaccctgtaggcagaccagcaatctcaattaacctggaccccagagatctctcaaacactgaaccaccaaccaggcaacatataccagctggtatgaggcacccaacacatatatagcagaggactgctgggtctgggttcagtcagagaag

SEQ ID NO: 4799 - DNA, 1200 bp, mus musculus
tctgggatcttatacggatgctagtttacattttttttctcattgtctttcagtaggcttgactgcagtgtgactgttctatgctttccacgaccttggctctcctaataaggattggtagtctagtttgaagttataccttctgctggaatttgtctgctcttttaccatctgtggagtagggaaggagggccaggcagtcaaggttccttttctaccacactaatgacttgctgccctgaactacaatgaccctcacccctttcctccccactttctccccccttgggaaacttgaccttgaacttgacttgaactttgcccgcattcagtgcagatgatggtcatccctggttctagaaccatcctttgctctgagaactcttgcgtgtttagttgcacagggagctcttgggacgccgctgtttcaggccctctcagctgacctagctaggaagcccatgtgtgcatattataagccttgtacggactgagttttaatccgccattaaataaaatggatgttctgccttaacatcgaatgttccggaatttgctcggtatactaaataattcactttaatccattctcttttgcattgttaaatgaaaatagtacgttataatgacattccgttctccaaattagtaacaattaatcatcggatttctacaaagtaaagcaaaccgagtttgatccccataacccatgtggctgaaggggagatgctatgcatgtcatctcagaatgctcccctacttcagtaagtaactatataagctgaaaatgaaactatctgattttaatcatagttcacaataaatgctagtctctaaatctcccttcaactctctctaaatatgcatcataaagaagaatgcagagagcaagttgtactcaaggagcagcagggctttgtagctgagttttagaagtactgaggttttattttgtttctattattttggtcaatgtctcttctaccatgttctagattcatgagtttgataagacattgatagtcatgatgcaataagaacccgctgccagtcaaattggggttgattcaggtttaaagagaagaaaagtggttttgtgattttatttttctgaaagatttcaatgtatctttaatgttcagatttatatatttgtaatatgcaagttgacttcatgattccttaagcaagggcaattgc

SEQ ID NO: 4800 - DNA, 1000 bp, mus musculus
acattcatgagtattcaataaactctctatagaatgaaactcgatccagattttcctggtaaagcctcatgatctgaccttggatcctaacgtatgagcacagttatctcagctatgcagtgttgttggccagtaaactgtggcaccctgatgttttctgaagcacagtagagacttgtgtgacatcataatgcctgtgggatttgtcaccaatatccaggtgtataaaaggtccttggcaggtggtttcatccagactccagaaacctactgcttttcttcctctgaacactccactcctgacaccatgtgttactatggcagctactgcggaggcctgggctatggctatggtggcctaggctgtggctatggctgtggctatggctgtggctatggctgtggctatggtggctatggatatggctgtttccgcccactgtgctgtggaagatactggtcttatggcttctactgaggaccttatgtagagacccagcctttctaaccagaagggcttccaagtgattttacaccaggaactcaacaatgtcttcaaattttctaacttcagcacaaaacatcatgttttatgttatctttatcatactatgtaaatgatatcaagtttgactctcaatatttattaaaaaaaagaaaaaaaaaaaacaaaggaaggaagcaaggaaaaaaacagaaaccaaacacctgtgtagcacatataactaaataaagtttacaaaataatttctgtatgttctgtgcttttgtatctgattggtcccatgtgtggaggtagttgtgggaatgtgtgagggaagtaaatgtgtgagggaagagacagacatggacaaggaaaatgggaggggaggaaaggaggggagaggaagttagagtgagaaagaagtaagtcttaccagtgttcaaacacaggtgatcattttcttatatttataaattgactattatgattattttaataataggcttggtagggtaa

SEQ ID NO: 4801 - DNA, 1000 bp, mus musculus
gaatgttgcttagtagcttcctcctcatggcttgctcagcctgctttcttatagagcccaggaccatctgcccagggaaggcatcactcacaacagtctggaccttcccccattcaatcattaattaagaaaataccctatgggctgcctacagcctgatctgatggaggcgttttcttatcgaaggtcctctccaatgactttagcttgtgtcagttgacaaaactaaccagcacgcacctcgatgaatgtaacccagataatccctcacacgcatgtaaaaaaggctggtttcctagttggttcttgatcctaacaagttggcagcattagcaacaataaatatatttctttctcttgaaatatgctgtgcctcagggccagtgagatggctcgctgccaagcctagggacctgaatccaatctccagaaactccatttccaaaggaaacaactgattcacaagagttgtcctctagtgctgtgatgcgcacactcctacacacacacacacacacacacacattaaataaatgtaactttttaaaattaagtgttagtcaagtcattttttttcctttgctatttgtggtgatttgaatgaaaatagccttcttaggctgctagctagtggcactcttaggagccttgttggagtgggtgtggtcttgttgaaggaaatgtgtcactccggggtgggctttgaagtttcagaagcttaatccagacccagtggctcctgcttttagaatctgtccactaaattcacagctggagaaaatgtttccacgtcaaagtcaaagaactgagttcccctcaagttctcctacttcaaagtccctgttgtgcagccattccgaggccattactgtgtgcacactcaattagttttaagcatctgacctccggtgacaccggactcctgctccaacaatgttttctgctggccgagcatttctgagagtcccttgtcagaacttctgtcattttgactttcagc

SEQ ID NO: 4802 - DNA, 1200 bp, mus musculus
gggattctatggctaacggggtgcacgggttccatcttctcttggtaccctcagcagaaggattccaagatggcctcagaactacacccactgacagagtggagtcatatttgtgaacagctgtatttaaatcatcggtgagtagcctgcaatacctaaagcaacatagatgctatgaaaacggctgaccacgtgacactgcttagggagcggtgacagggacgaaggggacgctttttcttaacaccccatcacctggcagattttcagtgtgcagttggtagaatccacagatgtacagcctatggatatggagggcccagaacacagttatctaggctgaggagagactctgaggatacaaagatggagcacagggctcaaaagcagccggaatgcatgctaagctcttggaaggccaaaagagacaggcgagacatagcacaggggagagctgacagaagaggctggatcgaaattcaacttctgcagactctccaggaagtgacacattcggggaaaagccacttctgaggatgctacaggttcaggcacgcctctgagcgctgataaccaaagctctgcttccttcaggccccagcgctccccagaggatgaaaagcaaccactctagttagaactttacagtaaccctttggatacaggctcagagtcacacacccaacttcgtgaagtaaaacccacttcccgggaatccttcagaaggaaacaaatcctttatgcacaacccctctgaaaacatgtctctcaaaagggaaactgagataaacaagggccactggggtagggggtgggagatgggagttggcaggtctgtagatcctaacactaggggctgatgcagaaagagttaagagttcaagtccagcctgagccacatcgggagttccaagacagccttggctacagatcaaggtcctgtctcaaaaactaaaaagcaaaacaaaatggcaaaaacaaacatccccagctccagtcttacctttcttggaagctaacccggtttccttgacactgttcacgtagagccttcgaatgccatcttcatccacagaagaaagcaaaaaccctacagaacacaagacagaagccagggctcagagctcagaaggtttagctgacagcaggaagtacctggtgtgtacactttggatttttttttcctgttgttcagattgt

SEQ ID NO: 4803 - DNA, 1200 bp, mus musculus; identical to SEQ ID NO: 4802

SEQ ID NO: 4804 - DNA, 1000 bp, mus musculus
gctcagagctctccttctctacatcctggtttctcccaagacagagttaatgttgcctagcttgcctcaaggaagcagggcagagcgatgaaagcaagagttctctttttgattatgaatcaaacacccattggctgagttacctcggccacattagtttaactaccatgtgctacagttccttatcagcaaaatgggcatgctgggtaattactccatacaaagcctggtctataataatcaccactcagatgttgggtggctattatctcttaagattctcctctgcagtaagattcactcctgagtctacaagttcaagtatgaagggaagaaccttaattacagagaatgcagccagctcctacctgcacagactggaaatgactagcagggcttatttaactttaaagatactatccgtgctgcccttgactccacggtcccaccagaagactgcagtctcttccaggttgtgtgcaaacctgctggggctgatgctggctatggcccatggaccaggactgtgcttatattatccacagactgtaagtggaacttgtacaagaaagtggagtcctctctgtctcctggaactttaatccccaaagttcagcagggaggatttggaggtgtgtgtccttgggttcagcaaggtgcttgagctgtcatccatcctcacgtacaaactgtgctcaagtttcagttggtgcacatctcatttcatctccatcttggtgttgtagtcatttgtttggggtcacaaccataccaaaaggaaaaatgaggctaaaagatatcctcggtgtccatcaccccctggcagccaggtcttgtttcctgtgcaccctcctgaatgcttcagtgatgatgctgtgccccttcctactggagagtgagattcagttctgcacggggcaatgtagcctttcccctgactttcctaggttgagatctgcctccacctccaacatagctggagccattttgttccaggcct

SEQ ID NO: 4805 - DNA, 1000 bp, mus musculus
ttgggcctggttaaaatttccaagaaggcttaaccatctactgccaatggattcttagctcagaggagatgagagagtagcctcccgccaggacaggcctctgcttgcatctggccggctgctttaatgtcaggtggctttgtctgttgcctgcagcccctgcctttggcagtgtccagtgctcacataggccagttcagacttgagaagtctgactgctcctgaaagaaagggtgttggcaccacagccatgcctacttcctgttatttgcaggtgacggagtccctattcagcttgcttcaaccctctcggctggagcagagagcccaagagtcagcttgaaggagctgtgacttgtgactgtgctagattccacttctgggatgatgtagtccctcttggccccagaggcacacagatatgttcaagatccaaggacaaacctcacagctctctgaggatgtccataaagtcttttcaggatagtgacgtgatgtttgtgacgtccataggtacatgactcgtcagcagagacttgaactaaaattacttgtgctcatcagcaatttgtgaagatctagagcatttgctggtgaaaatagaacagaggtgtgcattcagcatccatccctggctcttctgcttaatcacccttcaaagaagcctggcctcgggtgtgaaaggatgccagtcctttaggggtacacatcagagatctcagaaagcaccctaactcagtacctccagtccagttcgtaaaacccaccccttcgtccttgaacaatagatgctcttgtttaaaacccaaatggtgagttgagaagatgactcagtgagtaagagggcttgctgttcaaacagaaggacctgagttcaaatccccgtccggcacctgcattaaaaagtctcacatagttgtgtatggcctgtaaccccattgtggagggcagagataggatttgctgggttttgttgatctccaagttcagagaagagacc

SEQ ID NO: 4806 - DNA, 1200 bp, mus musculus
gcactgcctgtcattgcttcttattacatttggcatccaaaattctacagggtagcattcaatttggcccagtaaaacagttgtgttcttagtggatggggtaaaatctaagcatacttctatatactaacagtaatcacttagaggcaaaaatacaaatttattaattccctcactagaaaacactgccaacttcacttttaactgggaacatttctatgggtttatctttcttttttttttaagtttatttttatatgtttgagtgctgtacctgaatacatacatgtctgtgccctgtgtgcatgcctggtgcctgtggaaaacagaagagggtgttggatgcactgtacctgtagttacacatggttgtgagctgtcacgtgggtgctgagaactgagaccaggtcctctggaagaacagccaatgctctgagccccagagcccctcgcctgcctctagcccaatgcctgtcttttagctcctcatttcccacttggaaactcagagccatcagccctcaacagcagaaaccaccacagtgaaaaacaatcagatggaagggctatcgctgaagatttaatctgttaaagttgcactttccacatctggaaaacatggacaaagcataactggaaaggaataaagcatgtgactgcctatgacctgaaggaaatgcatgaagaggtgcctcagggcactgcagccaactgggaggtgcaaggatattttaaattgaagaaaacacctagggtttcaacatatactggatcccaggtaaactattagcctgaagtggttcagagctcatgactgcagggagtccattctgcgatccctgtctatgtgaagctaggtatctagcagtccctgtggtaaaaggcaactcctaatcaattcagcagaccaggagatgaggacggcagcactccagctgcttccaaggtgtgacagctgcctggaactcaccaagtgtgcacagaccactaataaacaactgcggttatttatgaagaagataaattagtctctacttgtttgtgttactttgtttgaacaacagctaaagttattgggatttaaatatttattgtttagctctaacatcagcaattagggctgaggcaggaggactaatgtgagcttgatactaaattccaagctaactagggctagagtgagacccttttgctaaaaca

SEQ ID NO: 4807 - DNA, 1200 bp, mus musculus; identical to SEQ ID NO: 4806

SEQ ID NO: 4808 - DNA, 1200 bp, mus musculus
attgatattcacaagcaaagttcatgggcgtttctgtgggaggcctgaccttcgctctctctacatgtctctctctattcttcctctcatctcctctcctctcaccaccttctctcctttatccttcattctctttctcacctcgctccctcccatcgttcctttaatccacccagagagctcaatcctcgtgctaggcactgtgccaggtctggaaaacctggctctccctatacagaaacttacaccggggtgtgtatgtcccaggaatgctaggatgtttgtgaagctacaccgctgccttcctgtagcatcctcagctctaacgattcctggaagctgaaactgttgagtagattaggagaaaaagaacagcttccccagctgctcccgccggtccctcacgactgctcctggcttctaagccacagggaccacttgcttgtgctcactcagtcttgtgactcacactggagtcaccgctgaccctgacctatatggaggatggtcatttatttaccctttgaaacttgatcaggtggcccattaattttgcaacattaattctaagaggaaattagattccaaccagagtcatttgtcttttgaaaatagagccaccagaagagaacatcgataatcacaatgtaattttctgagttaggaagtggccagagcttggtgtcgaggcttctgcacatctaagggtttcatggcattttcttaaatgaaagaatttgttttgagacttgagggggaaaaccacttcaaagggccatttctccctaagatgtagctgagagcttcgtgtgcaaatgaaaaagtcatctacacatcgttggggattatacttctgcagtacacttgttatctccccgagtctacagaggctgggagatggcttggctggtgaaatagtcacagtacaagagcaatgagaggagtttcatttccagaacccacaggtaaaaagacaggcatggtagcacatccttgtaaccccagcacggagggagtcaggcagatccttaagactccctggtcagtcaccttcacctactgggatggagtacctcaggtgccagtgagagatgctatgtcaaaagtgaggtagatggccttcacttaaggaataatacctgagggtgacctctggccttcacatacattagccccatgtagaccttcacacacacacac

SEQ ID NO: 4809 - DNA, 1000 bp, mus musculus
ttatgtaaggatgtacataagccttacattttactgtggtttgcataatcgcacacattaaaaatgcatgcaaccaaatgggagagcggcctgtgtggggctattattgctaaacctgcctagatctctgtcatgggaaccccaaatcaccaagtacttcaaaaggacaagagtcatccaacagggagcagagcggagcggggaacaatgttcgcacacagctttgactatgagtcagggctactggggccattaaacatatcagcagaatgtctttaatcttcttctctgatctcggagagctttacctgagagtgaagcaacattctgaggatctttggggggtaaggaaaaaagttccaagccccaacttgcttcaggagagtattcacttcatatacatgcctccaaaatcctgcccagggaataacaggcattaactggtacttaactaaatattcaaaatcttacagagtccaaagcaatcagcagagggaagaacaaagaaacacaagcccagcctttgcccccacagcagttaatctgtctcctaaaccccaggtagctgtgaggtggaaagtccagggacagaatccagcatgcctaacctcttttataacaatgctctcgtttgaacccctgtcatccggtgaaatggctggaaacagtgacaaataaacagaataataattgatttttccagagatgaaaaatttgaaattagtgaccatttcccgccccccccccccaagatcattggctgattaatttaatgtttgtcttagtctttcaaagacatcctctcccggagcatctgctctgccaggcactgtgatggtttgtggttaaagcatattgcacagttctgcagttttaaagtgaatgtcgacactgtgaggagggacgcagccaacgccaagacttaagtctcccgggattggaacctggcttgtcagacagaagtcaagtcggcgattgcgtggttaatgtgtctctatcc

SEQ ID NO: 4810 - DNA, 1000 bp, mus musculus
acatgatggctcacagcacttgggtatggcaggcacatgatgcacagacatgcatgtaggcaaaacacccacacataagtcagtcaatctcaaacaattttttaaagattagagatgaaaggagaggagctcttgtagattccaattaaatacagagacttattatgaaatgctataacaagccctactgcaaacacgagaaaatcctagtgaaataggtaaattccaagacccattattagggttcaggagttgcttcacaaaccacatggacacggatctcagtgagacagggagagtttattgagcatgtgccccaagactggtcaaccagggccatggtccagacgcagaatctgagccatgatcctgagttaagattctataaaagttttaagtcccaaatccacaaacatctgtgacaagttattccaccaatcaggatgtaggggtaggggatttccataggaacacgtctttgttggacactcatcctgctcccattggtgggagtattcaaaggaggcggggtcttcccttgcctaataacattcatgtcctcacttatctaactgaacaggacttgtctcagattcatgtcttaacttgccaactaggatgtcagttacacacgtccatgtctctttctgccaagtaggtgtccgttcccaggaagggcttgggaacctgatctttacaagagcactactcaaaatggaagtcttattccaaatggtttgtgtctctcttatgttggggtctgtcccaggggcagtttgtatcataaaatcttgtacacaggtacaggaagtgctggtggtggttgcttctggtccagtcttgttgtgggtaactatgcagagcagttccatgacttctgtcgtgattggtttccatgggcacagacagaacagaatatgtcacctatcctggcattaggaagggtccagtaacagcagaaacctgtgagaaatcttccttataatggcaggctagccaa

SEQ ID NO: 4811 - DNA, 1400 bp, mus musculus
agtcaatttgataaggtcatagggtgagcccttatctgataggactgtgcccttggaaggaaaaaaaggtgccctccctctgtctaccgtccaagcacccacgtaaagacacagccagaaggcacttatctgcaagtctccaagagacctgaaccagctgtccctggatcatggcctatggtactgtgaggtaaatctctgttgtttaaagcacacacgctacattatttttttttaaggcagccaaagagactgatgcagaaaggttggagttaaacctggctgcttttcagtccatacaactgtttggacatgagcaccagccttcaggctggcatttgagactaatataggcgttcctgtttgtcctttagtgggccccaccccctccaagctttattgacacacagtaacctgagcattgttataaaaacccaactgagccacgacaccaacactgcacctactaagtgtgatttggtggggttttgacatgcgtacaaccccttgagccccttgccactgttaagactgtgtcagtcccctccagaggttccctcttgatatattttatatccatatctctagacaactgtctgtcaccctcctttctgtcactgtaaatgagtttgctttttaagacgctttctgtaaccagccaggtgtggtggtaaaggcttgtattcccagcagctgggcgatagatgcgggggacttaacagttcaagtccagcctcggatacatagttttacagttggactgggctacctaagactgtcctcaaagtaaactaaatgaatatttgtataaatgggcttgtcctgttactcctgctctggcctttgtcactcacccaggctgttctgaaggtcagccaagaggtagacactgataattcatgtaccttgtactgctgagtaagatacacagatacacaggatccatttccatagtcagttgagttccttccagtggatatgttttaattttcttttcaacaatttgtgtgtctgtgtgaggatcccctggaactagagtcacagacagttgtgagctgcggtatgagtgctgggaattgaacccgggtcctttggaaaaacatccagtactcttaaccattgaatcatctctccagcctgtcttaattttgtaaacatttctttgtgtgtgtgtgtgtgtgtgtgcatgtgtgtatgtgtgtgtatatgtgtgtgtatgtgtgtgtgtgtgtatgtgtgtgtatatgtgtgtgtatgtgtgtgtgcatgtgtgtgtatgtgtgtatatgtgtgtgcatgtatatgtgtgtatatgtgtgtgtgtgcatgtgcatgtgtgtgtatgtgtgtgtgtgtgtatgtatatgtgtgtgtatgtgtgtgtgcatgtgtgtgtatgt

SEQ ID NO: 4812 - DNA, 1400 bp, mus musculus; identical to SEQ ID NO: 4811

SEQ ID NO: 4813 - DNA, 1000 bp, mus musculus
cgggcctcagattctccagatggcaggaatctctccaagaaaacgtgcagagagctggtttgtactcacccaagctctgagggaacggagggctctctgagtgcataatccacaaccatggcccctgtcctcctgacccactaagttatacaagggcaccaggcactggaagctaaaattaacgtttcatggggcatgccagagagttcttatgtctctggtggagactttccatgctcttgtgacaggccgatttccactgatgtccccacagggaggggaagaatgacgttccttgctttgtttccccactgcatagaaagtcgccacgtggacaccgtgctgcagcgaagcccacacagtcacgtgggcagcctgcttggcttttggtaaaactcccactatcactcaacaaatatttactggtcatctgtgatgagcctggctcgactcggggtgctgagggtgagagacaggatgggctatagcatgtgctagagcctggagcctgggcctcctgggcccccctccctcagcccctggccacacagttccctgccaagtgtgataatcatggagtgtctaagaattggaagaattctgagtgaaaacaatgccctaccccacgtcaggaggagcttaaattcccagctctcttccttctcagctgggcagtgggagccagaggccatttagatatggtcagaaaggaaaacgaagtacctggcataggggcccacaggggagagcagagggaagacatggctgaggcggcttcctttctctaccctgggcgtgtctttcacaccctgaaacagtatagccaagttgtaataggaacactactagatgaatagctcaccagagttctgtctgacatggcagcacagaacatacctagcaccccagatgctggaggctgtaatgtgaaaatgtccaacatcaaattgcaggacttctgtgacgtggccacagtccgtcttacctggctgcaatgatg

SEQ ID NO: 4814 - DNA, 1600 bp, mus musculus
aagctaattagccttcttgcctgtcttcaaccctgcccagcccaggtggcagagacaagcctctcagggcaaaggcctaactaatcaacactcccagtatcagctgtgactttgacaaggaggagcgggggtcagatataaacgctgaaaggctagtgccagcagcagccattaaaacctaaaaaggcagagtgggtaccagattttctcacccaagtcaactctaccctcctgcaggctccatccttgcctctgatcagggatcctggcagaagtagtgtgttaggatgtgggattggttcaggcaggtgaatggccacagattgggcaacagggagagggaggctgagctggtatgggtgtctgcagagcccagcctggtcagagctagaacatccctcccgcactacaaaatgtataagcccaaaggtaatgctgtacagcaaatgaagtggttggacccaagagatttagcctgtgggctttgctcactcagttaaagtggatacggatagagcccacattggtggctcccactgctgtcaacgagaagaacccatgtttccagtctccagttaggactctttgtgacaaaagagctctttgatccatcgggccatgccagggttcactgacatcagggaacctgaagagacaagagaatatgctactttctgctcagcccctgacatgttcacatcagaatggccgaagagccacagggactcacaggccaagcgttccaaattctaagcaggaccccagataccctcgcctatagccagccacctcaagaagtcctctcctggccttgacgacaccagcctcaagcccagtcctcccaagtcaaaaggccaagggcctctaatgcccacccctgggcagacctgggaagtggcaccgatgtgagacggtccagtcagtgggggagtggaagcagtggtagtctcctggggccaggtagatgactcagtggtagagcgcattcccttctcgggggaccagctggtttctgaaggagtcactggaggaagctattgggtgggacagaaagaaggcctggcttttggacaagctccaggtgccattcatcccacagtgagcacctgtacatggcctgcatgtagcctagctgggggctccaataatgacttttggctacatagcagcctgctgccccaaagcttgcccagcctttattccctcagccccctatgccttttgttactagcctttgctgtctaccccagctccaatcctgacttgccgcagaccctctgggcccctttgtctgcgtggaacgggtctctcgtctcgggtgggcaaaacgtcggatgagtaacaaacagacacacacaggagagtttgtgttggatctgaatgtaatgtcaaatcgagcatcacactttttatacagaagacaataaggaaattgggtgacacactcgaaaggtacaaagaggttactggattcttacataaaacagaggaatgtaaacacagaaggtctaacaggaaccacctgggatagaattcattgttaacaactgggatcaaaaagggctccacctaagattcacttaatcttagaagccagggt

SEQ ID NO: 4815 - DNA, 1200 bp, mus musculus
atgagactctactgcaacccactctaggatgtttgaaaaagcacagttgattaaacaagctaaggctgccatctgagccttgctcaagagaagctgagtcctgtgtctcctagaaactgagcaaagcaaagaacaaaaggggattgcaacagagaactggtgagcggcacaggctaagaccacagcacaccaactgtcctgctctcctcctttctcttccacaggaccccagtatgtctctaaaaaacaagaggaggtggcagggaccaagcaaagacaaatcagcattctcctgtgggctgcccttcccaagtcactgcagaagagcggatgccagtccagaagagcttgggggaggatctggtagaggaagcaggggtctagggaggaaaaagggggcctcggtgcccttgccaaagaccaagacacaggatagaagcccactgcttcccctgccttaccccattcccccagccagagccatgggtacctgaagtgagtctcctactcggggcacagaggactccctctccagacccctttagccactccctcccccctgaggccactggacttggtgtctgaccctcctgaaattatgccggggtacattgagggttaggtctcatgggcagcatctcactatttcgctgctgcttggagctccggttctggatgcttctctgactgacacatcttgggtaggcacagggagggtgtgggcctccacgagagtgtgctcctgtgcttgctggcttgcttgctcacttgccttttttttttttttctccttactccccttccccctcgccagagaaacttcagtgtggtcactgctccagttgttggtggcaatgcttctagtttccgttcactcttggtggctcacaggcacaggttagaggaccacagctattacaaatagacaggcaccaaacacctgtttagacctcctgttcaggtcacctgccagggtgttgccagggcagaagcccttgtacttgggccagccctatcactcagctttggtcaccctgaggcagggggattcccttgagtaaggaagaagctgaggcagggggatgacatggttatgtagccacagcctcaatctgcctgtcaatcaccggccccgcccactcagctgtgctcgccaatcagaaaaaaaaaaaaaaaaaaaaacagctgggcggtggtgac

SEQ ID NO: 4816 - DNA, 1200 bp, mus musculus
ttctgctcaccctctcagcaggtacttgcggctgagggctgagtagactctgaagttcagtcatccctctctaagcacacggaaccctgcggataatactgaagctgtgcccatgttttcaggggatgaaaagatggggagataaggagttcaggggttactaaagtcccttccaaacacgtccagagctttgcaggtctcctcggcctctccactcctgctctcagacatgaccccatgaccagtctgagtcctcaccccagctccgcttcttccttccctaccccctcttattcccactcatgtctcatgggcttcagagaactacagaagtcaacaggcttcgaatagactgtcctacatcctgacaggaaagcctgtggtccccttgcccgggccgaggagtcagaagaagggcttagtgggctatctggtctgtgaggagtgaagagaggcagagagcaagctggccattccctcttgggcaactcattcagggcttagcatagctgcctcgagatccacctcctcctgtctgtgtctttaggcttagggcctgcccagagacgccgtgatgatctcaccttgaaatctgtaacttaaccacatctgcagagccacttttccaaataaggtcacagccaggggttcccgaggctcagacaaggacgcatctgtccgttccgcccgctccatagcacagtcccaaacctgcattatttccctgtacctcccctaaaatgtggatgtcctctgaatatatcaagctgttctagaaaatcaattgaataacagcagactgctggttagggaataaaatttcatataagggtgtacgctctgtgcccaaggaattcatcttagaaaacaaaacaaaagatcaccaggtatggtaatgcatattgtaatccctacagttgggaggcaggggcaggaggatagataggtgtttaatgtcatctttggctacatggcaagcttgagtatagcctgggatacctgagagccatctcaaaacacgaaacaaaaagacgcaaaggctctcagacccttatgtctcacgcctctccctgcctctgccaccacactgctgattcctgaattcttgtctccctcatgggtacaggggtcaccctgcttcctccttccctcctcctaggtctctttccatacctccacatgcatgaacatacctgtaga

SEQ ID NO: 4817 - DNA, 1200 bp, mus musculus
aaccctataggtggaacaacaatatgaactaaccagtaccaccagagctcgtgtctctagctgcatttgtagcagaagatggcctagttggccatcactgggaagagaggccccttggtcttgcaaactttatataccgtttgctttcttataatcgttaaaaagcaggtttctgggctgggaaagtggtagagtggagcaggaggggtggggccacttctatgtaaattccagagggcagcagagctgcaaaagcatctcctgcaggaggacctgattgaggactgcctgagagaccaaggattgctggtgcagacaatgccagccaatcaggaactgttctttagaacagatgttttcttgagaccaatgtgggcacaggtggagggtattaaaagagcttgctgcagcatttctcccctgatcctggaggctgttattgactctgcagtagggtcaggcagccagtagcccagagcacaggcaccaatagagagcttacatatggtgttagagggaaaggagagagaagaagaggaagagaaggaagaagaggaggaatgggaggaagagggggtggggagggaagaagaaggaactgctttctgggaggggcgacccagtcccattgagtactttctctgtggtatacacaacacagcacagagcagttggggactgaaaacacgagttcagactttcaagaaatgtctgggacagactgggccttgtgctccagaacgcaagttggctctcacaactgcaaaagctccctgtgtcttaaagcacgtcgccaatcatgactcaaattttcacattgtttgctctgtgtgtgtggccccgtagtcatcttgaggtgacactcacgcccggtctcttgtctcttttttataaacgcaatttgcataattcacggacagctctgcaaggcatgcacaaccggaggccctgtcagaaaatgtcatttcaagagatttgtaatcgccaccagctcaagtcattctgtcatgtctcctgatgaaagcatggctggtctaaagcacaatgagggatcaggtgactggagctgagtgcgccacccaccctgggacagcagatgatttaccacttagagagagctgtgacagtgacctgctcgttcccttccttaccatcagtaaggactggtgagcaatggtcaggagacttgcagaactaaag

SEQ ID NO: 4818 - DNA, 1000 bp, mus musculus
ggaagatggctcagttagggacattcttgctgcacagctgtgaggacctgaggacaaatctccaacaccatgcaaaagccaatgacagtgtctgtaacctcaggactgaaggacacaggaggacccaggaggagccctggagcttgctgccagctcatctacctgaatgagtgtactctcatagcactgaagtcaacctctggcctccatatgtacacacacacacagcactgtggtaataattactgcaggacaaaaagtccatggacaaacatgaaagctagcagacaaggcttgaaagaggaagatcctcgtgcagctccagacatgcccctccaagggccgagtcctttgtgctgtcagcaaaagccacagcagtgtgttgtcctgggagctagagcttcacccctcccttgtgtgtggagagtgttggccacaccacttactcaggtgcattgtttatgctgagataagatgtgagggataggtgtcccatctgttctattcttgccgcaaatcagaaacactcggctcatgataaggaaacatcaaacagtagcaaataaaaaagcattccacaaaatacccaacacgaggtggacatcactgacagactcagaaactgtccaggtaccacggtccattgcaaaaggcttccttttaacactttatacattctactccaaaagaagacaggaatgagggagccgaatctatagctctgttgagggctggcagcccttgccccactgttagagcagtggcttggacaaaggtgtagagctagcagagacctggtcagggtgtgcagcaagcccccagcactggcctggcggggcatgtgtgggccaaattactttcaaaacaaacttttaaaatccagggacggctataaagcaaaccgtatggcccaagttaatacaaaaatacctcgacaaccaagtttcaggggttttctgctaacaaacttgtctttattccacacggactcactacggtt

SEQ ID NO: 4819 - DNA, 1000 bp, mus musculus
ccttgcagaaaaggttccatatctctagggctgaagcacgagacatagttgtctcctgtgggcattgcgccgtgttccaacatccttctccttttggagtgaatcctcgaggcctattgccccttcaggtgtggcaaatggacgttactcaagttcctgagtttggaaagcttaaatatgttcatgtctcagtggatacctgctcaggtatcatgcatgccacccctatgttgggggaaaaagcaatacatgcattgtctcgatgcctgggctgcctggggtaaaccccaacagcttaaaacagataatggacctgcctatactgcaaagacctttatgtccttttgtcaacaaatggaagtgcaagtgaagcatggcttgccctataatcctcaagggcaggggattattgaaagaacccatagaaccatcaaagagatgttacacaaacaaaaaagggggaataggctatagccgcacccctaagatgagactttctttagttctttatactttaaatttttttaatttgaataaagatggacccacgcagcagcagatagacatgttcaaagagtgcctggcctacaaggatatgccaggtagaacgatgtgcttaaaggcacatggaaaggaccagatccagtgttgacgtgggcaagagggtctgtttgtgtgtttccacaggaccagacggagcctctttgggtgccggagaggttggtgagacgctgcaagaatgaggctcctgatccagttgcccctgtggatgtggtggatgatcccacaagcacaaacgatggagccgagatgggagatcctttcggtgttccagaagccgataccagctcaacatgacattcaaattttcccatgcctttttgatccctgaattccccttaaagagagagccctttaacacacactctggctatctatcccttgcttcagggaagatgagcggggatgggagccctgggatatatgcttgttatagtgt

SEQ ID NO: 4820 - DNA, 1000 bp, mus musculus
actgcagggatcaaagactgccagggtgctgggaacagttgtcctgcccctccccgcgatgaggaaacaaccagactgagggttcttccacagcaggagctgaaccctgctctttgacctgcagtcgcaatctcgatgctgtgaccatgagagagcggctctgcttcagagagatcaggaaaggtgtagacactcctacccacgggagcctcataggcaggggggctcagtgaggaggacatacatcatctggaacctgctctcaccagagccactgacctctgaccctcagcaagggatttcccaccctccgactggaagggaatgctcattccagcccctcctttctcaggaactctgaggcccagaacagtcaaagacttgtatgaggaccagctgggtccagccctcgttggcatgacctttgtcctcagtagcacaagggtcaggccccaccccaggcaaagtcatcagccgctagcaattgctcagcacactctggccttgggttctattaggccaggcacctgtgcttgtgtctatgtgatcgtgacatgaggtgccctgcttgaggggcccttcctgatgctgtggcagtgtgggtgacccaaggctctgggtcgattgctgtgggggtgctagaggacacacgaaagcctagtctcaacctcacccacctccttttttccagggcatgaaggtcttcttcatggtggtggccgctgtgtacattttataccttctattcttgatagtgcgagcatgctccgagctccgtcatatgccttacgtgggtgagtgccatgctgggaagcatagggcaccaggggccacacccccagaagcccttggccctaggaagccaagagattcctcaagaaggattagcagtgttgaaagaaccctttagagtagaattcagtggcccctggtgccacagagctacgtgagctgcccgggacctgtaaggatcattaataacaatgtccttcactggggc

SEQ ID NO: 4821 - DNA, 1400 bp, mus musculus
ctcttctggtgtgtctgaagacagctacagtgtacttacatgtaataaataaataaatctttaaaaaaaaaaaaaaagggagctgaaacctctaccacaggttaggaaaccacactcttagcctcctacagtcagctaggaacttgaggaaggcaggaaacaaaaggcaggaagaaacacatcacttgaggacaatccttcctttggcagccaagagctatgcctgcggggtatgtactccggtgtttgggctgtttgctgttcacttggagagtgggaaaacaaaacaaaacaagacagacaagacaaagcaaaaccaaaagccaagcaaagcactggtcaggcttatgaagtttccatggcatgtgaaagtgaactgcacccactaccagaccaaagtgcaaggcctccatagcgaggcccatgggagatccttgaagcagtatcttcagatgcctcatgtcaaagcgggaatcatcaggactttcgtcaactcgagaaggaaccgagagagccatgttagtctcagttcccactgaagaatgggaacagagccaggatgacccaagagcaaaagcacaaggtgcactccaccctgagggttcagaggggtagggctggctagccttaccaggagagagcaagtggggtaatagttgagggctgctgtgcatctacccttacctacctagcttcctccatcttttagggctgtggcagagtggagcctgggagccatagctgtatgtgtgagagatgactgcaccaggtgcaggaggagcctgcggaggagacctaaggagtaaatggcgctctccaggtgaaaactgcttatgatgaagaggaagacaagctgcagccgaatgaatgccttcccttacttcttgttactacaaacagtcatttcacttttatggttctgtaatttcccaagagtgcctaccttgtctccaggttcaaagttttgacactccactggaggctccatcctggacctgtgtcctggcttttcacatcctctgtagtgtaggaacacacctccctgtggagaaaagcagagcacaggaaaaccagaaaagggaacggaaggggctgtgcaccacgcccacacatggcactgaggcaccaacatatttattagcacctttcatcttttaggtactataacggagcattcattttctccccccatgatataattaacatttattagaaaaaaataagagcataaaatcaggtcacgcaatttggaaaagtcggtgtcatccatcccaggggacatgcactactaattggattcttttttaaaaaagatgaaaacccaaaaaaagtcaaaacaattcactaagtgggcaatgagatgacagggacatttcgagtgttcccagtcatgatggcat

SEQ ID NO: 4822 - DNA, 1200 bp, mus musculus
tatgataggaaaaaattgaaagagagcacgtggatccatacactagactaacgcggggatggaactcgggaatgaaagattgctgtatgggtagggaacgctagactccaggaggagagcttccttgaaactcttttgcctcatgagtgacttttaagcctctcggcttgtccagttgactcgaccagagagcgtagcactcagggaatgtacaaacaggcactgcaaagcaaacagccactgactgcctgcagggtgagtctcacccagtcagggaggtaccaggcaggatccattgggccagtcactgcttaaaatgactaacgtggtcccatcagtgacagtgacagccaaaacaaaacaaaaaaaaatatgattgctgcgtgtggccacgggtgacaggggtcgcacccttgcatttcggcttgggccgagaggcaaagtcatgccacccagaggcaagtattctctcaaacacctccatgtgtgtgtagagcccttgggagaaagttctctaaacagctctcacacactgtacagtgtgttatatctagggctgttatcctttttccttgtcatctaacataaactactaatttcctggcctgtgtgctgttttctactgagattcaggcctcttccccatttaagaacatatttagggctgtgtgcatcaatctttaggccctaggagaatccagacaccaggtagttctcaaaaaaaaaaaaaaaaaaaaaaaaaagccatgcagtggtggcgcacgcctttaatcgcagtacttgggaggcagaggcaggcagatttctgagttctaggtcagactgatctacagaatgagttctgggacaccaggacagctggggctatacagagaaatcctgtctcgaaaaaccaaaaccaaaacaaaacaaaaaattctgtgagacttgctatgagggaggccagtggtccacttcattctccatggcctccagtcaagggtccagggccctttttctaccacacttcctacacctttgccacatgcctatgtgctggtctccacggtgggtctctaacacaccatgcagctggagaggccatctccacacgccatacagacctaatgctacattccccgtcagcaccaggtgcagagcagctgacagcggaacggtgccatcagccaccgagtagcacgctctgtctttacggctagg

SEQ ID NO: 4823 - DNA, 1000 bp, mus musculus
tgattggttaagacatccaactgcacattttgattggccagcagggactgcaccagccctatgctctgggtgggagacagagcttgagcagagctgtagattggtgcaatagggatgttcactgtacagggcgggttgttttcagggacacctgatgctcctgtaactgtaaaacaaacaaacaaacaaaaaaaatcggttgcaaaacagtgtaatagaactatgccagaataagacgcatactgaaatatatctgatcttttccaagcaaaatgtacccactaagacatccaactgcacattttgattggtcagcagggactgcaccagccctatgctgttcacgaagcttctcaaacccttctggaagaacatagccaactaaggagtgtgcagcatggcctgcctgttgagcatattctaaggtactgtcaaaacatctcaatgaacgtgttctaactttctgaatttggtaccatgtgcttgcatgataccattacacataaatgtctacagaactctttagtggttttgctcataaaatgcctatgtaaaataaagtggaaacaccaaaaataaaaaataaaatagaatccctagaaatgggcatattggctgaatgccctttgcctatttactgctttttaatatttcaaacagcatttaaggtacaaccaaccaataaaagcatgtggatattccatttactatccagacgtcacgtcatgaaccataaacgtcagccatgacttgcaggcaggtgctcagagccacagttggcagtgcccctgttggcagtggcgctgactctagctttgctcccttagcctactaagtggctgtgcctcttcctcagagcacattgtcagaggcccagaggcttaaaacttggtgtttaatgctgtatagcaataaataattgagcaatcaacaggatctaacaggcttattttataggttggctgacttcacccaaacagcaggatgcggccaacacaag

SEQ ID NO: 4824 - DNA, 1200 bp, mus musculus
ggaattataagatgaaatcagcctctttttccctcaaagtgccttttttcccccagggtgatttatcatagcaacagagataaaactcagatttatgaagctaaactacaggagcctccacagcgccttaccctggtctctcacctcagccgtcgaagcctgggctcaagcgaaacagtgtagatcccagaggcagctcaggctctgcctgccctttcagaataaaaccttccacaccagtggccaagacactgttactattccaaacagctattctattctattctaaaatccaataaagttccatttttctcggtctgttattatcccagtaaatcagagtttacaagtacgtttaaagggttttgaagtaaaggcgggaccaggcgtggtggctcctccctttaatcgcggtgcttgggacaaagaagcaggtggatctctatgagttcaaagtcagccaggtctacatacactgggagttctgggaactcttagtggaaagagagcttgtcttaaataaataaataaataaataataagcaagcaaggggaaaaaattgtatttttggctaagcagaccatttccttccttaagaatgttattttacgtgtgtggtattttttttcctcgtagatgtttaacatgcacgtatgttagttcatcatgggcatgctgtgcctctggaggcccaagagggtatcgggcccctgggcctggagttacagatgattaagtaccatgtggctgctgggaatcaaacccagaccctctggaaaagcagccagtgctcttaactgctgagccatctcccctgtaactctggaaaagttctcctattaaaaacattcgtttgtactgaaagacccacaacgtgaggactcttccacgttctgactcaggagaggcgacaccccaaaatcaccaacgagaaaacggtcttgctgcaaattgcaagaggatttttattcaagagcgctctcgggcccacggtcatacaccacgcaggggtagaggactgtggcgccccgagtagctgagtaaaggggtatttaaaggagaaaaaccacaactcaaggaggtgggaagggagttgttggaaaataccaaaaataccaggtaagagtcacaaggaagtacaaagtcacaggtgtcacaaggaatacctggtaattgttaactctcaagacagtttctaa

SEQ ID NO: 4825 - DNA, 1000 bp, mus musculus
gggaactagactttttaaatcaagaaagagggagacttgggcgtgccaattaaaagtatacaaagaaggggcaggcatggtgggtttcagtaagttccaggctatgcaggagtgagactttttttttgttttgttttgttttttgttttttcaagacagggtttctctgtatagccctggctgtcctggaactcactttgtagaccaggctggcctcgaaatcagagattcgcttgcctctgcctcccaagtgctgggattaaaggcgtgcacaaccacacccagctagactctttttttttaatcattattaatttatttgttcactttacatcacaatctcagcccccctcccccctctcctctcagtcttaaccttacaagcccctccccttctgccccctcccttgggaagtgaagtcccagcaggactaggcacatcctctcacactgaggcctagccaggcactccagatgggggaaagggagccaatggtctgatagcccacgctccaattgctagaggacccatataaagacccagctgcatatctgctacaagtgtgcagggggcctaggcccacccctgcatgttctttggttggtgattcagtctctgtgagcttccacgggcccaggctagttgactctgtagatcttctcatggtgtccttggcccctctgcctcactcaatcctatcccctactcttccacaagtctcccagaactccacctaatgtgtggctatgggtctctgtatctgtttctatcagctgctgggtgaagcctctcagaggacagttatgctagggtcctgtctgcaagcatagcagagtgtcactaatagtgtcagggattggctctgtcccatggaatgggtctcaagttgggctagacactggttggctgttccctcaatctctgctccatctttatccctgtgcatcttgtaggcaggacaaattttgggttgaaggttttgtgggtgggttgatgtcc

SEQ ID NO: 4826 - DNA, 1400 bp, mus musculus
gtgggtggcaccatcccctagacagggcatgaattgtatgagaaggagaaatggagtggggcaagcaagtaagcaaatatgcattggttcctctctgctcttggccatgggtgtgatgtgtctggctatttgaagtttctacctggacttccctacaatattgggtggtaacctggaattataagatgaaatcagcctctttttccctcaaagtgccttttttcccccagggtgatttatcatagcaacagagataaaactcagatttatgaagctaaactacaggagcctccacagcgccttaccctggtctctcacctcagccgtcgaagcctgggctcaagcgaaacagtgtagatcccagaggcagctcaggctctgcctgccctttcagaataaaaccttccacaccagtggccaagacactgttactattccaaacagctattctattctattctaaaatccaataaagttccatttttctcggtctgttattatcccagtaaatcagagtttacaagtacgtttaaagggttttgaagtaaaggcgggaccaggcgtggtggctcctccctttaatcgcggtgcttgggacaaagaagcaggtggatctctatgagttcaaagtcagccaggtctacatacactgggagttctgggaactcttagtggaaagagagcttgtcttaaataaataaataaataaataataagcaagcaaggggaaaaaattgtatttttggctaagcagaccatttccttccttaagaatgttattttacgtgtgtggtattttttttcctcgtagatgtttaacatgcacgtatgttagttcatcatgggcatgctgtgcctctggaggcccaagagggtatcgggcccctgggcctggagttacagatgattaagtaccatgtggctgctgggaatcaaacccagaccctctggaaaagcagccagtgctcttaactgctgagccatctcccctgtaactctggaaaagttctcctattaaaaacattcgtttgtactgaaagacccacaacgtgaggactcttccacgttctgactcaggagaggcgacaccccaaaatcaccaacgagaaaacggtcttgctgcaaattgcaagaggatttttattcaagagcgctctcgggcccacggtcatacaccacgcaggggtagaggactgtggcgccccgagtagctgagtaaaggggtatttaaaggagaaaaaccacaactcaaggaggtgggaagggagttgttggaaaataccaaaaataccaggtaagagtcacaaggaagtacaaagtcacaggtgtcacaaggaatacctggtaattgttaactctcaagacagtttctaagagcccctaacaatagcacatttgca

SEQ ID NO: 4827 - DNA, 1000 bp, mus musculus
gagggaactagactttttaaatcaagaaagagggagacttgggcgtgccaattaaaagtatacaaagaaggggcaggcatggtgggtttcagtaagttccaggctatgcaggagtgagactttttttttgttttgttttgttttttgttttttcaagacagggtttctctgtatagccctggctgtcctggaactcactttgtagaccaggctggcctcgaaatcagagattcgcttgcctctgcctcccaagtgctgggattaaaggcgtgcacaaccacacccagctagactctttttttttaatcattattaatttatttgttcactttacatcacaatctcagcccccctcccccctctcctctcagtcttaaccttacaagcccctccccttctgccccctcccttgggaagtgaagtcccagcaggactaggcacatcctctcacactgaggcctagccaggcactccagatgggggaaagggagccaatggtctgatagcccacgctccaattgctagaggacccatataaagacccagctgcatatctgctacaagtgtgcagggggcctaggcccacccctgcatgttctttggttggtgattcagtctctgtgagcttccacgggcccaggctagttgactctgtagatcttctcatggtgtccttggcccctctgcctcactcaatcctatcccctactcttccacaagtctcccagaactccacctaatgtgtggctatgggtctctgtatctgtttctatcagctgctgggtgaagcctctcagaggacagttatgctagggtcctgtctgcaagcatagcagagtgtcactaatagtgtcagggattggctctgtcccatggaatgggtctcaagttgggctagacactggttggctgttccctcaatctctgctccatctttatccctgtgcatcttgtaggcaggacaaattttgggttgaaggttttgtgggtgggttgatgt

SEQ ID NO: 4828 - DNA, 1600 bp, mus musculus
ggaaggagagccaccagggaagccacgtctctgctttctgccatgtgggctatgccaaaagcaggtgaccccaactccagatagtgcctgggttctaatccagcccaggtgacctgttggcaggccaatatgtttgatctgctgagctctacaggacccatgtcccctcctctgtggctgtaggctccatccacgatgtcccccagactgtcccttttgttttgagactgtggtaagcttaatcttctccctttgggaacatactctacagcattggctcccaaactgtgagcctcctcccctttggcaaagctctatctccaagcatatattatgattcataacagcagcaaaattacagttatggaatagcaacaagaataattttatgggtgtgtgtgaggggggggtctccacagcatgaggaactgtgttaaagtgtcgcagcatcgggaaaggatgagaaccccctactctagatatctcacaacctgcctctgtctgcagccttccacctgctcccaagaaggataaaaataaaaacagtaggggtctctgtctctccagcatggagtcctgtatgcagccagtgagaaacttgcctttaacttgctatcccagtcttgcaggtagattccctaaacatcacatttgttacagtgtgctagactctgcacacagagctttaaatgactgtcaacccttccaaaatgagtaataaatacaacccggttttacactgagagacacgaggcttagtcaggtccgggcctctcctggagatgaggatgctgtgcttcagttggtctcatcttggtttggcgactaagctctggagtaactactccaggtataagctgtggctggaggagagtcacggggctcttggaatacagactcccataccatggagttttccccgggaatgagattcagaggctctggggcatctctgctgagcttctggtgataagggcctgcagatgctggtactttcccaatggcttgtgtctttaacatgtgggatggactcagcagggcttttgaaattcccaggtacaaacaagtatctgctcacagtggcgtccctggagccaaccgcttttcttcagggctagcataaggtccatttccaaagcactttgtcctaggcagatggtgccttcatagcctagtgtatcacggaagggtgacttgctcccatgaccatgaaaaaaaccctgagctttcctccttggccaaccaacacgtcctgcagctcatagctagggaaaggccaggagtagaacctgggtttaaatgttgctaatgtcttaggctgctgcagtttcccctgtgaggacacaggtgaaggcctgatgaagtagtgttcaaggaagggaaacccagaaggacggcacttagcagtcagatcaagctgatctgatggtggtactgaccaaaggctaaccacaagccaggcattgtcccctgtagagaggccatgttgctatttaatgttatctttaaagcagctctgtagaatctgtctccattaaagataagggcattgggtagtgagatggcagagaagggtgtggtcagaaggggtaggccaatg

SEQ ID NO: 4829 - DNA, 1600 bp, mus musculus; identical to SEQ ID NO: 4828

SEQ ID NO: 4830 - DNA, 1600 bp, mus musculus; identical to SEQ ID NO: 4828

SEQ ID NO: 4831 - DNA, 1000 bp, mus musculus
gattcttaaacatgcttggtttaaaatgtatcataaaccattgccaaggggaaccctcagtgaccccttaagggcagcatctgcctgccagtcaccccttggtcccctcctcatcctgctcttctgatgacatcatctggtcagtcctagctcctctttccatctcccgtcctgtacagctgtctccttgtggatgtctccactcctctccaacatggttcgtcacttctggaccactgactcttgtccaaacacctgtccctaagcactttacttcctcatctaaggactgtttccctacaactcaaacccattgggctccaagatggcagctgctctcttcccttcctgcaagctagctgctgcggccactatcaagagtgtcatagtttttactcttctgctatttctacagggagggcacctggctatccccaagtgtcagaggctagggtaggcatatcacacagggcagagtgcaggtcctttttgatcatgctatcatctcagaaccagagggaagtgcccagcttacacacacaaatacatttagggcacaaaggacagtgagctgcatctatgcatgatccatgctgacctttgccctggcatgcagattttttggaggaaaaaactttaaagcagaaatcaatcactgtttgctttttgcttctgaaagtacaaagccatttgactggcacctgtttcactgaccgtgaagcctaataaggcagaggacacactgtcaaatttccactcctgcagtgcaaaagcagactgagtttggaacccagtttcttcaccagaatgtagctccatcttcctgtactgtctcacaaatgcccgcctttcctggccctggcactcagtaccaccctcacaaagccttaccctcttatctcagtatttgagcatttccaattaaccttcttattttcattatttcccaaacttttatagagttgctataattgtccttaataatataaacatgatacta

SEQ ID NO: 4832 - DNA, 1000 bp, mus musculus
ttatgtgaggagcgaacaggcatctcatctgttgggaaagcaggttaaataaatggagcacccagaaggagtcagacttcatgcacttatgaacttgaaaaaaaaaaaaaaacccttcaagcagctaacagggcaaagtgtatttttagatgagacatgctatgtcttaaatgcactgccatggcatgtgagggttgctatagcaactgcatccatcctccctcagctgtcagactgaatgagcagttaggcagagattcactgctgggagattgaagagattcctagagccctcggggtacctagccccagcaggaggagcgagtgtcctgtgacagattgttaaactgagggaggataaaaatggtgacccatattgccacatctgtcccttatgtgcttaagtgcagtcggaggccagggaggacattgaacattcttctctagcagtctgaaccgttaagatgagtctctcactagagcttgagctttctggttttcggctgactgcctggccagccagcctcctctccctttccccagtgctgggtttacatgctctgacttggggatctaggctcaggtcacatactgttcgtgcagcaagtggatttacccactatcccatctccccagcctcacacagcactgttcttgacatgtggccaaagctacatgcaactttccatgttgtaaaggaacagacgtccatttggatgcctttgtgtggatgtgctgtgctctggagacctgggcgggagccagctgcagggactctactctcaacactccccactggggtggctgcaggcacaggctttcaaagaaactactccccaagaagctggtttatcttttaacaaaaattatgctcttacctcttccaaattatctcaaggaaggtcttaatgaaattatctcaatttaaattatcattccttgttcaacagagtcgctcaagttactcactggatttgagtgttcacgtgtgtgtgtgtgt

SEQ ID NO: 4833 - DNA, 1000 bp, mus musculus
aatggggcctaccttaagtaccatgccaccctggggcatctagtcctagcaggtctaggcacattctttcctactgaatctggacagtcttgtggaagagtggggatagaactgagcaactcggaggagtcaaggacaccacaagaagacccacagagtcaactaacctgggaccatggggctcagagaggctaggctaccaaccagggaacatgcaggagctggaacaggtcccctacatatctctaggtgaccagagtttaatcccagatcatacaaggtgccaggagacactcccaagagttgtcacctgatttccacttacacatgcacgctatggctcagatgaacctgcacacacacacacgagtcttagggtttcctaactaagtgtgaagagacactatgaccaaggcaactcttataaggacaacatttaattagggctgccttactgattctaaggttcaacccatttatcatcatggcaggaagcatggcagtatctgagcaggcatggtccaggagagctaagagttctacatcttgatccaaaggcagtcaagagcagtatgtcttccaggtagctaggaggagagtctcaaagcccaccccctaataacgccatacctcctaacagtgccacttcctgggccaagcatattcaaatcactacaataagtaaatatatatatatttttaatgtttaaggagaaagtaggttcctttggtttcagaggcctgagggtcggtcagtctctctctctctttctctctctcaaccttctgaccttagcaggtcccctccatccctcacatcagcctccctgatgagccaagatggcccaggctctggacagcatctcacaagcaccttggtggcattttcttgttgtgttaccaaccttgctcaccctgggcttcattttgtgggttagaacaggatttcattacgtttcctaggattcaacccccaggctcagataattctcccacctta

SEQ ID NO: 4834 - DNA, 1000 bp, mus musculus
gtagcccaggtcttctgcccctgcatgcagcagtaccccgttggcctcatgcttggtggcattctcctgctgccatgctagatcagcttcttggaggagtgtggtccagggtggctgccaagttgcaaagtgtacatgtgtacccacatctggtaggactggatcctgctaagatgaggtatttaaatttatgatttctttcccctgccaaattcaaggcacatgcccatgttcattggaaggctgtggaatgaggcaactgctctgtcaacaaaaaagactggctgagcttacatccctcgaccggttctaatgagccttcataggaatgttggattccatgaaaaagcgtggggctcattgagaacaaccaggcaagagagtcgaccgtcttcacgtctctgagaactctgctcccttgagaaatactggattccagaggaagaaaccattcgcccctcccccttttctgtcctagaacttgctctgtagaacagactggctctgaactcagagatctgcctgtttctgcctcctgagtgctggcattaaagttgtgtgtcacccccaccccaactatttgcccctcttacttggactcaatacctagcacttcccattattcacattaatccacagacaaggatgatgtgtggggattcccagcatctgcatcagctgcaacggtgtttgtttctgtgccagtcactgttctaacaggaatgattgttagaactgctcttagtctaacaggcttattgaagggctgtgaccagttaacctgtagactgaacttgagttctcctgagtggctgctgagtgcctcagcctcatccctcagtttgcttttgtcttccctgtcctgaggggtccttgcctgtggtcagcaagtccaagtggttgttactaagagtcagtgaatgggtcccttatctcctgagtgtctgtcactttccttctcctcctgacagaaggcttgcttttgacctgtgctttgagg

SEQ ID NO: 4835 - DNA, 1000 bp, mus musculus
aatttccaaaatgggcttatacacattatacggtttgtttgtttttaaatgaatgagctgcttacacagttctgcttcaaacaatatagaggaagtgggaggggcttctgccccccccccagagtgctacccttcaagttttagtagatcgttggctagagaagacacaccaaagagagttggatatggggcctaaatatatagaactggtcatggatatatccctagggcatatggtggaacccaaaggatatctctggcctaacacagcctaatacagccaatcctggtgtatggagccacccttaaggcaaagatcaggcattagggctttgcttctggtcttaaagcttactgctttgtctgattgtatgaatgagtttataaacaaagaagccaactgctgcagtgtaaacaagatatagaggtgaggctcataaaagtccccaactccttacctcctgggtgccagtgcagaagactacgcactttcctggaagacagacaagtgaacatttaaaaattactcccaagggaggatcaagagtaaggattcactagatagactgtatccagctatgaacagactcactgtgaccccacagagccagcctccacctctggaccagccatgctctgatgttgtgttaaatgtgcgtggggtgagagctcttccttcccagcaagacagctgccatgagtgccaagtgacccaacaaggtgccaactgccaattgggaacactccaaagccctatgtttccttaccaaccagctagtagtgacctactgagcccagagagaacagcactgaggacggaagagagagcttccaaaaggatgcttctatcctggacaagaggacttaccaggtccattcagacagttcccagttgagcccctgccacatccccacagttttgcctcatagacaaggcacacacgggattcctcctttacctggaacagattatcaaagttctcttaggaccaatcaataa

SEQ ID NO: 4836 - DNA, 1600 bp, mus musculus
actcaacactaaacacacagtaagttcaaagatagtctgatatacaaagccaagacccagtcttaagcatacaaaacaaatacaaaattataaataagtatataaatataatttccagcatactaaggatacaaagaataaggaagccgggtgtggtggcacaggcctttaatctcagctcttgggaggcagagacaggcggatttttgagttcaaggccagcctggtctacaaagtgagttccaggacagccagggctacacagagaaaccctgtctgggaaaaaaacaaaacaaaaaacaaacaaacaaaaaaagaataaggaacaatttcccaacaaagaagttcaagttgaggcattggggggggggggggtgttcgagacagggttgagacactacacccagctgaggctttttttttttttttttttttttttagtttaaaaatttttttttttaatttttatgtaataaaaagtaaaagtccttgaggcatctgtcagtctctcacacaggacactaaagttaatggagaagaacagggagcccaagtctgagattataaatatgagaaaataaaagatcttctgtccctggggtggggaggtagatgagaggatgggagaacaagactgggtgagacccagctgggacagagcaggaacctcccccacccctgctggaccccagcctggccctcttgaaggacccttcccattcaaggtgcttggcaagaattccccaactcccccagctggtcccagctgctggagggaagagacatagatcacttccctccactcaaggtcgtctcaggtcctggtcaggacaaccttcagttccccagggagtggaaggggagctgctgggagggatgagattgaactggttggaggggaaagcaagaaaacaggagcattagaaccggagcagctgtccctgtcaatgcatccacggggtgaggggtgtgggaaggagcagcctcctagaggagtctcagggggctgtcagaagcacaggtcaattactgtttcccagtaggccagagccttactcaggggcccagctcagccccgccccacccccaggttgaggcatttttttttaaagatgttttcaaattttaaaagtttttaaaattataacaaggttcaactatttgatttggacactgcaggaataaagaacactccagatgcaactacagaaatctgagttgtgactcttgttaatgtggtgtcactaacaaaatatattaattttgaaagatacaaactttaaagatgaaatatcaatgtatctctattgtattttaaccaatactgaaaatacagctaagcagaagtaacacagatcagctatagcaatgctcagaaaatcttcactatgtttgctaacaaagatttgatttaacacaagacatcattttgaaaaacatctcaccaagccaagctagttaaattctaagagtcaacaaaagcaagaatttcttcattcttttcaactttcatccaaaaaaatcaaaaagtacaatttttgttaggcagtggtggtgcaatgcacgcctttactcccaacactccagagacaaatacaaa

SEQ ID NO: 4837 - DNA, 1600 bp, mus musculus; identical to SEQ ID NO: 4836

SEQ ID NO: 4838 - DNA, 1000 bp, mus musculus
actaaatatcaccctctctcctcccagtacactctcccacaggccctccctccatccctcccttccctcctcctctgagaaggggaggcccccaccccacccctgggtatcaccacccactagcacatcaagtcactgtaggacaaggtacatcctatcccactgaggccagacaagacagcccagttaggggaatgggatccataggcaggcaacccatttagggacagcccctgttccagttgttgcttcttatgtgaaagacgacatgttgtaagcataagccacttcagttactttggctattgaaggagagacctagggataaggagagcaaaagagatttaaggtcccgaatgaggtggaagcaggagaagtgccttagtgactggaggtgccaagttcctgctaaaggcttttgaggtctttcacagaatgactgactacgagttccagctgcaggctcatcagtgaggccaaatgggaacccttcccacaaaagtgtgaggcgtttgtagtcattactgcgaagtatactccaggacacagcagaacacagaagcctgcccaccgtaaagcatgtcacactgccaaaatggtaggaggtcactctgaaaagggctctcatggttcacctgaaaccccagccgcttggctaaatgaaaccaacagcttgaaatgtgccatggccggcactgtgctgaccatggtctctgttagcctgactactaattggctgggtgtggctagcaaggtataatggattgcatgtcatcctgcaggattccggggcaccaagatggcatgcagcagtttgcaacgggtttctcaaggacttagtgaaagttgaggcaggcagaggtggaagggaatagcttcctcccaccctccaccccccatacatcattagcagagacaataccacagacactgctgttgctataagggatgagaggagtcttcagttcccagcaggtcttaatctcctgtacccacagtg

SEQ ID NO: 4839 - DNA, 1200 bp, mus musculus
cacgcagataccggtctaaagccactgtcgtcaggaaggctactcccacaccacggctgaatgccagcaagaagagcaggacttggcagggcatgtgtccaagtttccaggtcttgcccttcagatagaaggcagcaaagaatggcagactggtggccaatagcaggtcagccaccaccaggttgaacaggtagacagcataaggcttccatactttgagacggtaaaagaaggtccagagggccacagcattgcccataaggcccagcacacactccagtgtcagcatggtgcccacggctgtctccaccacagtgctggcagctgagcagttggtgcgctccatgggcctgagcctcactgagctaaagcaatgcgaggagagagagaggccaggaggcctcactgtgctacttcctctgagaaaaaaggaaaactcccccttcctgtcacaaagcacacaagttctgcatgtattcagtgagaacataatactgaaacagtgccagaatctgaaccaagtagccagcagaatttgtttggggaaagaggatgaatggacacaggggaaggcccccaagttttgctgtttcatttgtccctgagaaagaggaaactgtgtttgactttgtatcaggggcttcaaagccagggccctagtgttccaggaaggcttagtgggcagagccatgtcccagctgctgaagaaggaactgaaaacagttcatgacatgacgatatctgcacctttagacacttcaaacagtgactggattgaaacaggcaggctgttctgtggtgtgaaccgttctgtggtgtgaaccggtcttagatggttctgcagtctgactgtttcatggggaacgtttacaattccctccctcaaatgatgacatttggtaagattcttaagtgtggctagattttacacattaggtcaaagctgattttcatattcacttgaaagagtatttcagatttcttggctacttaaagttgaacttttcatttattctatccagtcaaaagtgtgtgtgtgtgtgtgtgtgtgtgtgtgtacacacacaagagaatgtttcctgctgagactcttccctgatactcacactatctacataggacctggaacactgggttttgtgccctgcaagcaagagtttccagatgggaactacatttcatcagtgaattcttcatttt

SEQ ID NO: 4840 - DNA, 3000 bp, mus musculus
acgagcccaggggtgctctcatccactcggaacaccagtggcttcaagggggccccttgggtttcatcttctgtcctcaaaggcttgctttcctaaacattgatcatccagacaggaaggatgagacaacagagcttccgatgagaggtgacatggttccctctctccctcccccaagctccggcttctgtgcgccagagccctccctgccacctctgcagacaaacccacctccgcctaggcctgacatttgtctgcttacctgttacagaatgtccctctagtggcagtccaaaaatctctgcagtcacatcacccaaactctgcagaccatccattgtagtcctgcctctgggatcagcagtgtattggaaagaataagggtaattagtgaaaacaaaaaatattaactttttaatacataagcaaatttaaacacatcttttgaaaaagattgagaggttggagagatgggtcactgggtaaagtacttgtcacacaagcatgagtttggatccctgacacccacataaaaggccaaacactggtagagcttgctggccagtcaacttagcttgctgagttagttccaggtgtgcaagagaccgtgtctcaaatgatagggtaggatgtgaaagaagaagacatccaatatcagcctcttgtctccactcacacgagggcatgcacacctgcatagcctgcgtgcatacaggctaacacccactcgactcacacacgagtgaatgccgtgcaattcctgagtttcctcaaccatgtgtttccaaatgtgagagccactgtcacacacagcttgcagctgtgattctgggcatactggggtaggactgactcaaccaaatgacacatgttcattgctacaaccttggtcaaggggctgaataagagacctgcatttatagtgtattttcaaactgagcttaatgatatcaataagcgtttcaagttgtgtgtgtgtgtgtgtgtgtgtgtgtgtgtgtagtatatgtgtttatgtatgtgtggtatgtgtatgtatgcatgtattatagatggtgtgtatgtctatgtttgtgttgtgtgcactatgtgtatggtgtatgtgatctgtgtgtcactgtgtatgtggtgtatatgtgtgtctgtgatgtatgtctatgtgcatatgttgtgtatggtatgtgtggagtatgtatatatggtgtgtgtatatgtgtgtgtatgtgtgtatgtatgtatgtatgtatgtatgtatatgtagtatgtgtgtctgtgttgtgtgcactatgtatgtggggaggggtttctgtgtgtgatgtgtatggtgtatgtgatctgtgtgtctctgtgtatgtcgtatgtgtgtggtatgtatgtcgatgtatgtgtatgtggtatgcatgtctttgtgtatgtgatgtatgtctgtgggtatgtgtgtacgtggtgtgtgtctaagtgacgtgtggttgtttgtgtaagtgttaggtgtggtgtggtgtgatatgtgactgtgttgtaaattgtttgtgcaggtactgaggggccacagtcagttacttttacattaaaagtgcttttctttggcagaggtgtggctccagggtcgaacatttccttagaatgggaaagctcttgctttggcaccaccatctcacctcgttatcgtctacctgtaagaactactcatgtctcctaagcttacttggtcataagtactgtggcgcctgtgaggatttcataaaccgcatgggcaggaaaatggattcatgaagaccaatggccatctccagtgtctccccactcttgtgcagaacgcttttgaggctgaaaaagaagacagtgatctgctgtggctatgcctcccctggaggggtggtggccagactgcctagctaggctgtgtacatttgcacattaatgttcccgtctcccacagaagcaagactctcagctgctcataagttaatgagcagtccaaaacattcatgttctcatacaggggctgttgtgaagtccatgatgtaaagggccatagcataggctatgatatgtggctgtagcacagactatactatagaccatacagtgggtcatggctatgttgcagtcattggattgccccttgatattttccagaccaggggttccaccgtggagcacaagagctggtaacagaagcctccaacctttcggaaagagatccattcactcagaagaaccatgggaccttgtgaaaaaagcccaccagtagagcaggtgtgcacctctctctgatgggaacggctcactcttggtgtgtatcctcctagtagtggaaatttgctttgtttttatcagcttcccaggaagctgagcaaggggtttgcccagttttgattgctgccaatgtctcaaagtgccatcatgatcctatcagtcagagccagggcctggcagcaagagcaatctggtcttgcccaacacatccccacatgcggggaaacccggggacactgtttcttattgtgtgataacatcttacaccctctgccgtgggaaaaccaccctttaatttgattttattctcagtgggacgagctctagttcagcagcacagctccagaggtcatgcccatcttcaccgaccccctcaaccagagtagagaaagaaacacactaagtctcctgacccaattccccagacaggctgggcagtctgctgggttccactggaggccatgcaggtggcactgcggggcaagtatagcttagtgctgcaggtcccctccagtggaaaggttgcagattgtccctccaggtgttctgggtatctctgcatggtccctctctgtcctctccagatccaggggcttaggaaaggcccttgggctgccttgcccacatggggtaagtctgtttgttcctgtatcaggcaccctgcacatgatagagtaaatggggggccagcaagccaaagaatgaggagggagggacataggtgttatagtcctctgtgtg

SEQ ID NO: 4841 - DNA, 3000 bp, mus musculus; identical to SEQ ID NO: 4840

SEQ ID NO: 4842 - DNA, 1000 bp, mus musculus
ccatgctagcacacaactgtctctaactgcagttccggagaatctcatgtctgctccgggatctaaaggcactaaatgcacatggttcagtgataaatacatgcctaacacctctctctctctctctctctctctctctctctctctctctctctctctcacacacacacacacacacacacacacacacacacacacacacaattggaactactatgaatggttgtccgcttctcaagatctagagtcatgtaagagacaagcctgtgggcccatctctggggagtgagggactatcgtctaggttagggtagtctctgggcatgccagtgggggattatctcattactgagggacatggtggcctggctgtatctaagtgaagtccgtggcctttctttcacctgatgtgatacagagactaggtttgtcctcagtttggctgagtgaccgtgatcacgcacaggaccacatgccttgtgtcttccctgcctgggaactcggtcatcatgagggaaggaggtgggtgggtgacttctgagcttcctgtcatcagaaccagggtggagggaggaaatcattccgatccagagcctgtcacttccagaaagttctgctgtaagaatgaaaggctgacatcctccagccagaatgtggcatgaaggagatgctggctctgcccccagtgggtggggttgagggaagactggcctggaacattccccaagtcaggggataaggagttgggcagatgggcataacattggcctgtggctcagttttataggaagatgagccaggtaaattcttcttagcaactctgtgtatccctactacctatgtggaagttgggagtgctcagtttccccatgacaactaaagggactctagccaggtctcaaacgtgtctctggaaggccttgcccttctccccaattccttctaccttgctaaaaaaaaaaaaaaaaaaaaaaccattagactacattcttaaagatag

SEQ ID NO: 4843 - DNA, 1000 bp, mus musculus; identical to SEQ ID NO: 4842

SEQ ID NO: 4844 - DNA, 1400 bp, mus musculus
tgagaaggttttggggagtgagaacaaccatcagaagccagatgaggctggagatgccccaagctgccctcagagacagcaagttaactctgagccgaggatggaccacacgcagataccggtctaaagccactgtcgtcaggaaggctactcccacaccatggctgaatgccagcaagaagagcaggacttggcagggcatgtgtccaagtttccaggtcttgcccttcagatagaaggcagcaaagaatggcagactggtggccaatagcaggtcagccaccacaaggttgaacaggtagaaagcataaggcttccatacttaccgtctcaaagaaggtccagagggccacagcattgcccataaggcccagcacacactccagtgtcagcatggtgcccacggctgtctccaccacagtgctggcagctgagcagttggtgcgctccatgggcctgagcctcactgagctaaagcaatgcgaggagagagagaggccaggaggcctcactgtgctacttcctctgagaaaaaaggaaaactcctccttcctgtcacaaagcacacaagttctgcatgtattcagtgagaacataatactgaaacagtgccagaatctgaaccaagtagccagcagaatttgtttggggaaagaggatgaatggacacaggggaaggcccccaagttttgctgtttcatttgtccctgagaaagaggaaactgtgtttgactttgtatcaggggcttcaaagccagggccctagtgttccaggaaggcttagtgggcagagccatgtcccagctgctgaagaaggaactgaaaacagttcatgacatgacgatatctgcacctttagacacttcaaacagtgactggattgaaacaggcaggctgttctgtggtgtgaaccgttctgtggtgtgaaccggtcttagatggttctgcagtctgactgtttcatggggaacgtttacaattccctccctcaaatgatgacatttggtaagattcttaagtgtggctagattttacacattaggtcaaagctgattttcatattcacttgaaagagtatttcagatttcttggctacttaaagttgaacttttcatttattctatccagtcaaaagtgtgtgtgtgtgtgtgtgtgtgtgtgtgtgtgtgtatgtgtgtgcgcacaagagaatgtttcctgctgagactcttccctgatactcacactatctacataggacctggaacactgggttttgagccctgcaagcaagagtttccagatgggaactacattttatcagtgaattcttcattttaatttaattccttttaatcatgcaaaggctgaagccaatataatttaagtcttctgtctgggtccagggagaaagatcctct

SEQ ID NO: 4845 - DNA, 3200 bp, mus musculus
cccttgggtttcatcttctgtcctcaaaggcttgctttcctaaacattgatcatccagacaggaagcatgagacaacagagcttccgatgagaggtgacatggttccctctctccctcccccaagctccggcttctgtgcgccagagccctccctgccacctctgcagacaaacccacctccgcctaggcctgacatttgtctgcttacctgtacagaatgtccctctagtggcagtccaaaaatctctgcagtcacatcacccaaactctgcagaccatccattgtagtcctgcctctgggatcagcagcgtattggaaagaataagggtaattagtgaaaacaaaaaatattaactttttaatacataagcaaatttaaacacatcttttgaaaaagattgagaggttggagagatgggtcactgggtaaagtacttgtcacacaagcatgagtttggatccctgacacccacataaaaggccaaacactggtagagcttgctggccagtcaacttagcttgctgagttagttccaggtgtgcaagagaccgtgtctcaaatgatagggtaggatgtgaaagaagaagacatccaatatcagcctcttgtctccactcacacgagggcatgcacacctgcatagcctgcgtgcatacaggctaacacccactcgactcacacacgagtgaatgccgtgcaattcctgagtttcctcaaccatgtgtttccaaatgtgagagccactgtcacacacagcttgcagctgtgattctgggcatactggggtaggactgactcaaccaaatgacacatgttcattgctacaaccttggtcaaggggctgaataagagacctgcatttatagtgtattttcaaactgagcttaatgatatcaataagcgtttcaagttgtgtgtgtgtgtgtgtgtgtgtgtgtagtatatgtgtttatgtatgtgtggtgtgtgtatgtatgcatgtattatatatggtgtgtatgtctatgtttgtgttgtgtgcactatgggtatggtgtatgtgatctgtgtgtcactgtgtatgtggtgtatatgtgtgtctgtgatgtatgtctatgtgcatatgttgtgtatggtatgtgtggagtatgtatatatggtgtgtgtatatgtgtgtgtatgtgtgtatgtgtgtatgtgtgtatgtatgtatgtatgtatgtatgtatgtatatgtagtatgtgtgtctgtgttgtgtgcactatgtatgtggggaggggtttctgtgtgtgatgtgtatggtgtatgtgatctgtgtgtctctgtgtatgtcgtatgtgtgtggtatgtatgtcgatgtatgtgtatgtggtatgcatgtctttgtgtatgtgatgtatgtctgtgggtatgtgtgtacgtggtgtgtgtctaagtgacatgtggttgtttgtgtaagtgttaggtgtggtgtggtgtgatatgtgactgtgttgtaaattgtttgtgcaggtactgaggggccacagtcagttacttttacattaaaagtgcttttctttggcagaggtgtggctccagggtcgaacatttccttagaatgggaaagctcttgctttggcaccaccatctcacctcgttatcgtctacctgtaagaactactcatgtctcctaagcttacttggtcataagtactgtggcgcctgtgaggatttcataaactgcatgggcaggaaaatggattcataaagaccaatggccatctccagtgtctccccactcttgtgcagaacgcttttgaggctgaaaaagaagacagtgatctgctgtggctatgcctcccctggaggggtggtggccagactgcctagctaggctgtgtacatttgcacattaatgttcccgtctcccacagaagcaagactctcagctgctcataagttaatgagcagtccaaaacattcatgttctcatacaggggctgttgtgaagtccatggtgtaaagggccatagcataggctatgatatgtggctgtagcacagactatactatagaccatacagtgggtcatggctatgttgcagtcattggattgccccttgatattttccagaccaggggttccaccgtggagcacaagagctggtaacagaagcctccaaccgttcggaaagagatccattcactcagatgaaccatgggacctggtgaaaaaagcccaccagtagagcaggtgtgcacctctctctgatgggaacggctcactcttggtgtgtatcctcctagtagtggaaatttgctttgtttttatcagcttcccaggaagctgagcaaggggtttgcccagttttgattgctgccaatgtctcaaagtgccatcatgatcctatcagtcagagccagggcctggcagcaagagcaatctggtcttgcccaacacatccccacatgcggggaaacccggggacactgtttcttattgtgtgacaacatcttacaccctctgccgtgggaaaaccaccctttaatttgattttattctcagtgggacatgctctagttcagcagcacagctccagaggtcatgcccatcttcaccgaccccctcaaccagagtagagaaagaaacacactaagtctcctgacccaattccccagacaggctgggcagtctgctgggttccactggaggccatgcaggtggcactgcggggcaagtatagcttagtgctgcaggtcccctccagtggaaaggttgcagattgtccctccaggtgttctgggtatctctgcatggtccctctctgtcctctccagatccaggggcttaggaaaggcccttgggctgccttgcccacatggggtaagtctgtttgttcctgtatcaggcaccctgcacatgatagagtaaatggggggccagcaagccaaagaatgaggagggagggacataggtgttatagtcctctgtgtgtatgcgtgtgtgtgtgtgtgtgtgtacatgtgagtgcatgtgtatgtgagtgatgtgtgtgcatatgtgtgcttgtgagtgcatgtgtgtgcatgtgtgtacatgtctgttgtatttgagtgcatatgagtgtacatgtgtgtgcatgtgagtatgtacatatatatgtgcttatgtatatgcatgtgtgtgcatatgagtgtatgcacatatatgtacatgtgtatatgcatgtgtgtg

SEQ ID NO: 4846 - DNA, 1000 bp, mus musculus
ggtgtggccttgttaggggaggtgtggccttgttggaggaggtgtatcattaggggtgggctttgagttttcaaaaacccaatccagggcacaatctctctctctctctctctctctctctctctctctctctctctctctctctctctcattctctcattctctctctctctggaattttcagctacttcttcagcatatgtctgtctgcatgcctccatgctccccactttgagaataatggactaactgtgagccagcccccaattaaatgctttcttttttataagagctgccatggtcatggtgtctcttcacagccatggaacactgactacagatgatttagttaatcttacagctctcaggtcacattctgacactgagggaagtcagtgccggaacctggaggtaggagctgaagcagagccatagaggaacacttgccagactgactttccttctgacttgctcagtttgctttcttgtacatctcaggaccaactttccagtggcggcaacaccacagtgggctgagcactcccacgttggtcgtcaatcaagatgatagcccacagacctgcctccgggccaatcttatgacagtgcctcctcatttaagattcccctgtctcatgtgactctggtttatgtcaacttgataaaccaataaaaccacaacaaccagaaaagcacgcacatggggctaaagagaagtcatggtcctgcacatgagctcagagaggagaccacttagcagagagcaaatgaagaccgagtgcttcacaaggaccccaggggggaaatgtcctttaaccttagggctctggatcacgtaactcaccagccaccgaggacctctgctctaccactgcccaaagcagggactctgagattcacagtcacataaatcagtaaactcccccattgagacgcttaagcaatagcctgctcttttaggaaacatgctcatgtgagcaagctactattagttttcttg

SEQ ID NO: 4847 - DNA, 1000 bp, mus musculus
caaacagaagaggagagaaaaatgttctaggaaaagaggaggactaaagaatgcagatgatcctaaatctaactgtgcaaatgaaaagtcctaagatttgactcatcccatgcttctgagcagttcttgtcaatgtgggggcagtgtggtgttctcgaaagtcttgagacaagaggctcgcaggactggcctgccccttctgttgcagtcattgtagcactgaaacatgtcttgtggatatgttcctttggtgatggatagtgatgatcagggtacctgtcatcccctgaaggcactaaggatccaccgcttcccctgaccttttgcactctcgtctattcctgcctgcagaggcgacaggaggaagggtattacagccgcctagaagctgagaggcgccgacagcacgaagaggcagcacgcaggctgctggagcctgaagagcccgggctgagccgacctccacttccacgggactatgagcccccgtccttgtcctcagcaccctgtgcccctcctcccccacctcagcgaaacgcatcctacctcaaaacacaggtcctctccccagactcgctgttcactgccaagtttgttgcgtatgatgaggaggaggaggactacggcccagcaggtcaggataagtaccccagcacacggaagtctcatgggcaccttcctcttgccacccttaagccgcagcagcccccctgccagccacgcccagcctcggatggcatctccctctgcaactcattccagccacccttggccaaagccaacagtacagcttacaaagcaggccagcccccgcccctgccaggcaaaccaagcctgtaccgtcctggccactggaaaggtcgaggtaaaagagggaatggtgaatcagacctttctgtccttgatgattgagcctggaatctctgtacccctgccatttggcaaggtacatggagaccatgcctgctttggcactgggttttatctgatcactctcagc

SEQ ID NO: 4848 - DNA, 1000 bp, mus musculus
caggaactggcctaagctagcagctacagctctctgtgtatgagactctcacctaaatcctcattgggcgaaaacggaaagaaagcaagctttgtctttctgtccccctggcagcccagcccaagtctacacacgacgatattgttacagaaactggaaattcctgtgtgtacagtctcaggtgtttgccaggacaataacacaatggagggtcccagcttgactctgacagctcggtcccaggtgacatctagggctccagagttgcagggtgtgtgaattgatgcagtcctctctgggactctgctgctttcggggagtttttgtctgccacccacacaaggttgggggactgcattacaggggagggtggtgacagaggtgggcacggtgtcttcagcattgggactcagcgttgctcaccatctgaaccgttgtcatagggtcagggctgagaactccaagtctcaaaccagctccagccgctcccccacccctgaagcctagggtgtggctggtagaaaggaaccaagtcaaaaacaatgttagcatattcttgttatgaatcttctgacatggagctcctattgagggagtgtcagctactgcatgccttttggtggggttttcagatgctcatcaaatagtcctgcgctgggggcatcctccctggaactgtggggctgttcctgggcaggaatgacccaagcaggcagactccagcccttggcccaggaacccaattacttcagtctgccctgggatgaactgctgtacggacctcatataattattttgataggaggaattgtggctgcaacctaagtggagcccccatcccatcttttaagaagggagactcataactcagaggatgtgggcccaaggtgggcccctcagaagggagtcacataaaaggaatcaaaagccattcatgctcagtaggcagacagacacttgatagtacctggccagccttggccactgcctctgctccact

SEQ ID NO: 4849 - DNA, 1400 bp, mus musculus
acatgtctgtccacatgtgttcctgacatctttccgttgctgactatggttgtgtttacaaagatacttgctcttttacaggtgtgacttatgaggtactgtcagcattagagacagtgatgacaaaatccaacttcctattaaaaatcatgttgccatattgggaaatggcagtgagcaagttcaagtcgcacaggtaacaagggtggcatggtgctatttattggtgctaagacgagaggcctgcgcaatgctgagggggtagaggtgagacctctcagattaggctgagtgcagaatgccttcctttggtgactcagacaagccctgactggttgaaatattctgtataatcttcttggtgctattgatagagcttttttttgttgctgttagaataagcttctttgtatttttctgagctcttactataagtaaaatattgcacctatcataagagaactacaggagtcggggagggaggaagacagacaagcctggccatgtattccctcaaaaccaaagccatgcaagagccaggcacagcatgttttcagggaggcagagcctggagatccagtgagtggggtcattactgatcctcaggtgacctcacgcttagattcacttttcctcagctactccctgcagctctgcagctctgcagctctgcagctctgttctggccatcctcagaagtgatatgcagtgtttatagaaccttaatggcattttgttctactgaaactatgaaaaggtttcatcaagctttaaaacatgccccccccccaaaaaagaaagaaaaatggttttaaagtcattagtctatttagaattggatcctagtattttgcttccacattagcaagttgtatatccttgttttcaatgccatattatttgtgttgaggctgcagtgcagtaactgagacacctgctaatagactctggtcccccaggtttgccgactacaccatgttgttgctgtcacagctagaagctggactcaggagactgtttgctgcagttaacaagtgtcctgatagactgctcacagccgaggtacaagtgtttctgttactcactcaaactgcaattactatgttgacaattgtctgtggctatttaaaagttttaagggctggagatgcagaatgttagctaagcacttgcataatatgtgcaaaaccccagattcagtcctttacaacacacacacacacacacacacacacacacagcatgctttatttgctgttacagcatatatttatttgaattgtgattacataagatggttctgtttccaaactgccctttcaacttcatggtgttgcaaaagcatcaacattttctgaagccagaattgtttctgattttgcagaatactgctgttcttt

SEQ ID NO: 4850 - DNA, 1000 bp, mus musculus
attttagaagtctatatgtctacgtggagaatagatatcataacatgggccaaaggttaaaaacaaaaacagaataagaagggatagtaaacagaactaggcagggcccttctagtgaggcttgagggtctgggcatgatgtaggtgtatgtagatcagatctctggctggaactggtgagatgtctttggggtacccggctcattcgctgtagccagttgtgaccagacttttttctgcaccacctgcaagccttttaacttagcatacagattattattacaacaacatgtaggtttaagcacatcatttaagacagtgatgggcatggggaaggagcaccaagtctacaccagtctcttttagaattctattcatcttttctacctgtcctgagctttggagcttgtatgcacaatgtaacttctaatcaatctctaatatcttggccagtccctgatttacctgggcaacaaaggcaggtccattattggacctgattgccttggatatcccaaacctcgggaagatttcttctaggatcttcttggctattacattggccatctcagtctttcaaccgcgaggctactgccatccgtgtaccagcggtgaaatgcgtggtggtggtggtggtggggtgggcatcccagggaaacctctgcatgggtgttcccccctgggccacggtttcccatgtggtgcctcaccttggccagtgcatgctgctgccgccgaagccagaagttctcagtccggccctgcagctgcctgcggccaggaacgtgggtgtgaatccacgttctgccaactcgggaccccgagcgcacgtcccgctcagcgtctccccgactgagatccccaaggccgccaacttttccgactttcccaggctgggggcgcttcgtctcaagcactcttcccgagtcccccggtcccagctattcccggacaacttcccaccccgccgcgcaggtctccccgacgtccgcgcccactg

SEQ ID NO: 4851 - DNA, 1600 bp, mus musculus
cccactctcagttgctgcccaagtctctgaagagatccagttgcccatttttccttttggcaacttcctaaggccactttactgtagctgtaggccaggtactctccctttttagggatgctctgcctcaggccacagttcatctgtcccagggtgctggctggttgacatgtctgtccacatgtgttcctgacatctttccgttgctgactatggttgtgtttacaaagatacttgctcttttacaggtgtgacttatgaggtactgtcagcattagagacagtgatgacaaaatccaacttcctattaaaaatcatgttgccatattgggaaatggcagtgagcaagttcaagtcgcacaggtaacaagggtggcatggtgctatttattggtgctaagacgagaggcctgcgcaatgctgagggggtagaggtgagacctctcagattaggctgagtgcagaatgccttcctttggtgactcagacaagccctgactggttgaaatattctgtataatcttcttggtgctattgatagagcttttttttgttgctgttagaataagcttctttgtatttttctgagctcttactataagtaaaatattgcacctatcataagagaactacaggagtcggggagggaggaagacagacaagcctggccatgtattccctcaaaaccaaagccatgcaagagccaggcacagcatgttttcagggaggcagagcctggagatccagtgagtggggtcattactgatcctcaggtgacctcacgcttagattcacttttcctcagctactccctgcagctctgcagctctgcagctctgcagctctgttctggccatcctcagaagtgatatgcagtgtttataggaccttattggcattttgttctactgaaactatgaaaaggtttcatcaagctttaaaacatgccccccccccaaaaaaaaaagaaagaaaaatggttttaagtcattagtctatttagaattggatcctagtattttgcttccacattagcaagttgtatatccttgttttcaatgccatattatttgtgttgaggctgcagtgcagtaactgagacacctgctaatagactctggtcccccaggtttgccgactgcaccatgttgttgctgtcacagctagaagctggactcaggagactgtttgctgcagttaacaagtgtcctgatagactgctcacagccgaggtacaagtgtttctgttactcactcaaactgcaattactatgttgacaattgtctgtggctatttaaaagttttaagggctggagatgcagaatgttagctaagcacttgcataatatgtgcaaaaccccagattcagtcctttacaacacacacacacacacacacacacacacagcatgctttatttgctgttacagcatatatttatttgaattgtgattacataagatggttctgtttccaaactgccctttcaacttcatggtgttgcaaaagcatcaacattttctgaagccagaattgtttctgattttgcagaatactgctgttctttttaattgtttctcttttttatcttcccttttc

SEQ ID NO: 4852 - DNA, 1000 bp, mus musculus
agatatcataacatgggccaaaggttaaaaacaaaaacagaataagaagggatagtaaacagaactaggcagggcccttctagtgaggcttgagggtctgggcatgatgtaggtgtatgtagatcagatctctggctggaactggtgagatgtctttggggtacccggctcattcgctgtagccagttgtgaccagacttttttctgcaccacctgcaagccttttaacttagcatacagattattattacaacaacatgtaggtttaagcacatcatttaagacagtgatgggcatggggaaggagcaccaagtctacaccagtctcttttagaattctattcatcttttctacctgtcctgagctttggagcttgtatgcacaatgtaacttctaatcaatctctaatatcttggccagtccctgatttacctgggcaacaaaggcaggtccattattggacctgattgccttggatatcccaaacctcgggaagatttcttctaggatcttcttggctattacattggccatctcagtctttcaaccgcgaggctactgccatccgtgtaccagcggtgaaatgcgtggtggtggtggtggtggggtgggcatcccagggaaacctctgcatgggtgttcccccctgggccacggtttcccatgtggtgcctcaccttggccagtgcatgctgctgccgccgaagccagaagttctcagtccggccctgcagctgcctgcggccaggaacgtgggtgtgaatccacgttctgccaactcgggaccccgagcgcacgtcccgctcagcgtctccccgactgagatccccaaggccgccaacttttccgactttcccaggctgggggcgcttcgtctcaagcactcttcccgagtcccccggtcccagctattcccggacaacttcccaccccgccgcgcaggtctccccgacgtccgcgcccactgtccgccgcactcgttgctccaggacccgccgc

SEQ ID NO: 4853 - DNA, 1000 bp, mus musculus
acaccagtaatgactactaattttcctcaatgatgctatataagtctgatttaattcttacattgtattacctgccgtctgaccaatgtctggactgaaaaatttgcatataagtatatttttaaagattataccccaaggaaccctccagaatgtaccagagacctgggaggtaagagactctcaggaatcagaaggaggaaccttagatgaaatgcccaacagtagggagagggaccatgtagaacccacctccagcaggaagacagggcatcaagtgagagatggggttgccatcccacagtcacatctctgacccataattgttcttgtctgaaagaattacagggatggaaatggagaggagcctaaggaaaagaaggtccactgacaggcctaaagtgggatccaacaaaagggttggtcccaaggcctgacactattactgaggctatggagtactcgcaaaaagggacctatcatgactgcccttcgaaagacccaacaaacagctgaaagggtcagatgcagatctttgcactcaaccaatggacagaagcagctgactcctattgttgaattaggaaaaagctaaaagaagctgagaagaagggtgatcctgtagaagtacccagcagtctcaattaatctggaccctggatatctctcaaacactggaccaccaaacagacaacatacaccagctgatatgagcccccacaacacacatacaacagaggactgcctggtgtgtgttcattcagagatgatgcacctaaccctcaagagactagaggccccaggtgtttaaaggtcaggtggggggggggtggagaaaggggacttgaagaggaggtgtggaatgtggagcagttggagggtggatgggaggtgggggaatggaatatggagtgtaaaaaataaattagttaaaaacagagatcgttgaaaaaaatattacaccccaagactgtgaagagaaatactttcgggaatccct

SEQ ID NO: 4854 - DNA, 3000 bp, mus musculus
aaaatgttctttcagggaaattctgactcagtacaattttcctagcattttcctaattgtaactatgttgatgtttttgctgatagtgtaaaatcactggtagataaagctacatgtgctttagaattagttagtgacaccaaaacattctcgtagtcattttatttttcaaaaacatgtggtaatagtaaaggtctgcatattttaaatgttctgcatagtggaccacaaagtacttacaatgtacttatttctattcatttttgaagcagatggttatataatggcaaattacttgcacaattaagatgtgagccgaactagtgaaggaacaccattgctaatgaaaggaaataaaacttgagacatgtgattcatgtaatttatgtcaaatatcccaaagagttgtttgtgagctttgaaacctggggctgagaacatagcagaacaggccaggacatgcccgggcaggcccgtcgttacatgtcctgactggcctagtgcctccctatctcccgcccttctgacagtctgttaatgtttaaatggaccaatcatgtgaaaccgcgccaattcctccaccagccccaccccttttctataaaaacccctagcttccaagcgtcggggtcaaaaccactgtctcctgtgtgagatatgtttcgaaccggagctccgccattatggctccaccatgtggtcaacacctctgtctcctgtgggagatacatgtcggcccagagctccgtcattaaactacctcatgcttttacatcaagatggtcctctgttcgtgattcctgggtgcgcgccaaatcgagaattgagtggaggtttccccactaggttctttcatttggaggtcccaccgagatctgcgtgacacccaggaaccccgaaagaccccttggaggtacgtttgtttgtgtgtgtcttacatgttgtctgttgtctaagtgtggcaccactgaatttgtgtcttggtttttcagttctgagattgtgaatttgtgtcttggtttgtaaatctgtgtctcggtttgtgaatttgtttgtgccttggttttccagttacgagatcgtgggttcgagtcccacctcgtgccttggttttagggttgcgagatcgtgggttcgagtcccacctcgtgccttggttttagggttatgagatcgtgggttcaagtcccacctcgtgccttggttttctggttacgagatcgtgggtttgagtcccacctcctgccttggttttagggttgcgagatcgtgggttcgagtcccacctcgtgccttggttttagggttatgagattgtgggttcgagtcccacctcgtgccttggttttagggttgcgagattgtgggttcaagtcccacctcgtgccttggttttagggttacaagatcgtaggttcaagtcccacctcgtgccttggttttagggttgtgagatcgtgggttcgagtcccacctcctgccttggttttagggttatgagatcgtgggttcgagtcccacctcgtgccttggttttagggttgcgagattgtgggttcaagtcccacctcgtgccttggttttagggttacaagatcgtaggttcaagtcccacctcgtgccttggttttagggtggtgagatcgtgggttcgagtcccacctcctgccttggttttagggttatgagatcgtgggttcgagtcccacctcgtgccttggttttagggttgcgagattgtgggttcaagtcccacctcgtgccttggttttagggttacaagatcgtaggttcaagtcccacctcgtgccttggttttagggttgcgagatcgtgggttcgagtcccacctcctgccttggttttagggttatgagatcgtgggttcgagtcccacctcgtgccttggttttagggttgcgagattgtgggttcaagtcccacctcgtgccttggttttagggttacaagatcgtaggttcaagtcccacctcgtgccttggttttagggttgcgagatcgtgggttcgagtcccacctcctgccttggttttagggttgcgagattgtgggttcaagtcccacctcgtgccttggttttagggttacaagatcgtaggtacaagtcccacctcgtgccttggttttagggttgcgagatcgtgggttcgagtcccacctcgtgccttggttttagggttgcgagatcgtgggttcgagtcccacctcgtgccttggttttagggttacgagatcgtgggttcgagtcccacctcgtgccttggttttagggttgcgagatcgtgggttcgagtcccacctcgtgccttggtttcacatctggcagagtgaggaacaagtgtgcttagatactggtgtcttttattttctgttgctgtcttgtttttgtgttgctgtcttgtttttgtttgtggttttcgtcataggacagactgtgtgtgtagtgccgactgcggacttgaactgacgttaagacagaatttgtcagtgatagttaagaaaaactggctgcacacagccgcaggactggaatgagaccttccggcttaggcggcagcagcgcatactggccacgtgggaaaccgtgaccaaggggggaacacccgatgcagaggtttcccccgggatgcccaccccaccaccaccacggattcactgcctatgggacgggcaagaagaaaaagaggggtgaggcccacagggcccgcgctggcccctcctggcttcctagggtcgactagagttcgctgccttcccctgctccctgagttggcctggcgcagccagctgtgagagctaccttcccttccctgccccacgtgttttctcttctagagaggccccaccctaagctgctaaccagtgagggagacatctgtctacttaaaacttctttctcaggtaaggagcacctgcaagtctaatcaccaagctctgacaaatttgtatagaggtctagaaaaaggtgagcttagactg

SEQ ID NO: 4855 - DNA, 1000 bp, mus musculus
tgggttttttagagttgggatttttcagtgatagatttatttccatagcgattatgggatgcttttggtagtttaccctatccttatttagctttggtatcttgtatctgtctagaaaatctttcatttcatttagattttctagttttgttgagtataaacttttggagtaagatctgatgattttttgaatttcttcagtttctattgttatatctctcttttcatttctgattttactaacttggatactgtctctgttcctgatagttaatttgactaagggattatttatcttgttatttctcctcaaaggaccaactcctggttttgttgattctttgtagtgttatctttgtgtctaatttgttgattttcatcctgagtttgactactgactgcattctactgctcttagatgttttgctttattttattttattttattttattttattttattttattttattttattttttgatcttgagcttttaggtctggcattaaattgctagtgtagtatctttccaatttcttttttttttcaattttttattagatattttcttcatttacatttcaagtgctatcccgaaaaacccctatatcctcccccacgccctgctcccctacccacccactcccacttcttgtccctgttgttcccctgtactagggcataaaaagtttgcaagaccaaggggcctttcttcccaatgatggccggctaggtcatcttctgctacatatacagctagagacatgagctctgggggtactggttatttcatattgttgttctacctatagggttgcagtccccttcagctctttgggtactttctctagctcctccactggggaccctgtgttcctttcaatggatgcctgtgagcatccacttctgtatttgccaggcactggcctagcctcacacgagacagctatatcagggtcctttcagcaaagtcacttagtgctatgaattttcctctta

SEQ ID NO: 4856 - DNA, 1200 bp, mus musculus
gctgagtttggagtactcaggcagcagatcaaatagatccctttggtttcttgtacctcttttagggggtcttgagaaatgacttatatttaaatgccgcaggctattctacttatgtttatgatattttgttaatttattttctgagtcagattcctcctctaaggttgacattttttcttttgaatcatcattcacctctcctgagaaactttcctagactattctgttgaggaataaacattgtttttcgaacctgagcaagatagtattaacagagtcccctcacaatgaggtgaaattgtgtctcctgagaacattattgcttttttgccatccattagtgcctacctaagcacattccaaatagcatactcagtaaggggcatgcctattcttctatgctctttatatcagtttttaatatctaaccctacattctcccatgtatccacaactaaagtactccttcctagaaatcaaggcccaaccatttgtgcaaactgaagaaattcattcagctggaaagtgctaatcttaatgacttttaaaaagagtatgcttaatagcatttataaagcactcactgtacattcactttgtccatcctgagagatataaacaaaatgtacataacccacaactgatagcttctgacataagattggtgctgatagttctcaacagctatgatgggagaactgcctaatggcagtaggaaattaaggccagagctgatggctcctggcgtaacctgggtactgataacatccaatattagcctctgctgatggcattaggcagtataaactcctatttctcactctgcataaaaacacactcactggccaaggggtttccaagacacagttgtgagtcctatatgtgtcgacttaccttattcaaagtacttgttccaagtcaccgatttagatgccagtaacctcccagcctggagaagtagagatgaggccagattaggactctggtatggctataaagtctgtgggtccatgaaagttctagctctctaactacaatgaaatgttgataataacttctaaattgtcctaaaacctttttggctctttctgttagggattgacaactgtagcctggcagcaggggaataagcaaagtggacttttgttctatatccctagaaactttcagctctaagtctgttattcagaattcata

SEQ ID NO: 4857 - DNA, 1000 bp, mus musculus
cttttcctatgtgtttgccttcatgaaagtgcttccatacccacccacactctccagccccacatcaccatcatttcccttctctggggcatcagatcataaggttcagaccataaacactgagtccgggccacctcctgtgctgcttttcatcactcccctttgatgttacactgcctgctacctgccatgaggccaaaccagattttccggagttaactctgaatttggggagtttctcctaaaagactgttctgacaacttcacatctctacatcaggaaacttagcatgactggggatgggtttccctctttataagtgcagattttattattatacatttgaaccttgaacagactagcatgtcttgattccattatttctcgacccacgtagattccttcttctctttcaggtccaggatgccacccaggctcaaacccggacaagagagctgcaggccggccccatcaatttggtgtccgactcggggcctgggaatgacagaagaagctggaagaaacactgctggtatggagctccacaggtaggaaataattagaaaatttgtacagggacagggagaagcaatgggcaaaaggttgctaaggtatggtacggactgagctggaacagtgtgctgacccgtgcgctagattcgctcaggttcagcagtgatatcaggatctaggaacataacaggcagtcggccacagcttccagtagctgctttttaggcgagagaaataaaagagtttggattaaataatcaggcggatggccgcagtcggaaactgcatcaggcgggaggaaaatggattttgaaattctcccaaaggcagagagaaatcttgtgggacgccctgcctttttctctctagcccttacagcagaagttctctgctctctttgttttctttaaagtctaatgtctggtgcaccggtctgttaatgtgttcaattcatgtgagttcatgtctggtcatctgaatgactga

SEQ ID NO: 4858 - DNA, 1000 bp, mus musculus
ctagttcaagatgttccataatctaaattggctccttggagcaagaattttgaggaaggtatgtcaacacagataggactctcaactggaacttgtaaaccccttgatcatggagtgtatggttatggaggatgagaaataggagttgatattgtctaatgccaaaaacagaggctgatattgggtacaatcatcacatgcttcataccatgagccatcagcactgacttgaaattgcctgctgccatcagcataagcccatagtaggtgccatcagaatctggttgtgttagttgatgtgatggtttgtatactcttggaccagggagtggcaccatttggaggtgtggccttgttggaataagtgtgacctggtttgtgtaggtgtgtcacggtgagtgtgagcttaagattctcaccacagttgcctggaagtcagtcttccactagcagcctttggatgaagatgtagaactttcagctctgtctttgccatgcctgcctacatgctgccatgctctcaccttgatgataatggactgaacctctgaacctgtaagccagccccaattaaatgttgtttcttataagacttgccttggtcatggtgtctgttcacagtagtaaaaccctaactaagacagttgagtaccatcagtgcccacagtaggccaagagccatcaactctggccttaattgcctgctctcaccaggcagttctccaagcggttctattgggatttgtcagcatcaaccttagatcaggagccatcagagcttggttgtgagcatttcatgtatctctcagggtggaacaaagtgactctgccaacagaaaattgttacagatgttattaagaatacttttaaaggaaaaaaggattaaggttagcaccagtcacctgactgactttcttcagtttgtaaaagtggtcaatccttggtttccaggaaggaaacttcagatatggatgcatgggagaaaacagagttagatat

SEQ ID NO: 4859 - DNA, 1200 bp, mus musculus
tgtatccctgtgtgccactttgaaacaaacaatacatttatcattgtgttgagatagatgtgtaatagatatttttcaaactacaatggattgaaaagatattgttttttattagttcatttatttattcatatatgtatttacactccatatttattctgtccctcatccaccatccaacggtaccacatcctttacctactctcacgccctgtatccatgtggatgtccctaaccccttccacctatcctctaaactcccttgggcctccagtcacttgagggttaagtgcatcatatctgaatgaacagacccagaagtcctctactctatgtgtgtttggggtctcatatcagctggtgtatactgcctgtttggtggtctagtatttgaaagatatcaggggtccagattaatcgagactgttggtcccctacaggattgcctgtctcctcagcttctttcagcatcccctaattcataggaggggtgagcagcttcagtccattggttacgtacaaaaatctgcacctgaccctttcagctgctttttggatcttcttgaatgtggtaaggctaggtccttttttgtcagcgctccatagcctcagtaatatagtcaggcctttggatgtcttctgagctgtttcccactttgggcatgtctgaggaccttcttttcctcaggatactcttaatttcatttcttcatttctttcatacaaaaacaattatgggtcagagttgtgactgcgagattgcaaccccattcctggctttttccctgtcttccttctggaggtgggctctcttagtttccacttcttcctatctggcattatatctaggtccctcacttggactcctgagagtctctcacctcccaaatatgtggtacagtatggaacctgccccgacctcctatctcctaaggttgcctgtttccattctttcttgtggcactcagagcttcagtccttttcccttacccaataccaagtcaggaacccctctaatcccactccccttatcctgtacattttccctcccaggtccctccctccatcccctaatgaagaagagattttacatgtaagaggagacaagtattttcactaagtactagaaatcacccgggacctatgtttaaattaaactcagggtaagacttcaaaggcctgtggataccagggcagata

SEQ ID NO: 4860 - DNA, 1200 bp, mus musculus
ttttaaatgcttctacctgtttagcagtgttctcctgtatttctttaagtgaaattattcatgtcctccttaaaatcctctaccagcatcatgagatatgaatttagatcaaaatcttgctttccggagggtggggtgttgggatatccaggactcactgtggtgggcctactaggttctgatgatgccatgtggtcttggtttctgttagtaaaatcttttattttccttttgccatctggtaatttctggtgttagatgttctagctgtctctggctggagcttgttcctcctgttattctttagcttctattagcactcctgggagaccaactgcctactgcttcctagtgttcattacactctctgcaggcaagctctcctcttgtagggaaggtgcacagacatctggaactaagatgcacctccttattcctggggtcagaacccaccctggaggtcaaaactcctctggcaggaaaggtgtccagatgtctgcatctcagctctgcctcctggctgaggatgaatgcccgacataaccatgtccaagaagctctgttgcttctgctgcccatgtgctctcctgcatagagtggtctcagtgatcccacgattctgaatgtggtagggcctgcctttgtcctttgaccctgttgttgctagcacaagtccctctggggttttttggaacagatgtttcattccactcaccgtgatctcaagatccctggtgtgagatcatcttgccaaagatggtgccagggttgtgctgaccagaaggaacccaagccacaggttgggcacatgtcctttttccctgttcctgctagcacaagaccctttgggttttttggaactgatgttgtattccactcaccagaggtctcaaggtcctgggcatgctagggttcctacagtgtggagagtcctctgggaaacagatgcttttcatgatccctttactcaacaatactttccatcaaattaagttgagaaatcaaggttgtccctgcgaaatcaaatttaaacaatatatatccacaaattcatccctacatttgatgttatatagaaaactccaaagcacagaggttaattacaaccaagacaacataagaaataaagaatttcataccaatgataccaacagcattgacatgtacaaataccaccacccaccagcaacaaaattaaca

SEQ ID NO: 4861 - DNA, 1000 bp, mus musculus
attagtcggcatctgagttctatgctcttgcaccccacagatttatgaatccattgcactgggatgagagagactcaatgatcattgatcagcccttgcacattgctgaggtttcctcattgcacacgatagggtgatcatgatttccccactaattcatttttgactggcctcttttgtagagtccgccctaggtcatttaacagttatggtcacacagcactgtggtatccagagacgggcaactttcctcatgcacagaccaacctaagacatggggcctggtgacgatagggttaccctatgacaggtaaggctgtgtcattagaggaacgacctaaaacaggagccatggtggatggacataattgcacaggcctagtccagcctcattttattaaaacaaaaatggggagatgtgggaagccacatgtgccattgcacggtggcgctggccaccactggccaccatgcatacagaggcagtaaagtttttttctcccaagatgaggttttgagaatcaaccaaaattaaccaatcagatgagagacaagttaaccaatcagatgtaggcatgcaaatgaggtggtaagcataacccatgcacaaccaatccgggtgtgagacatgcctctcctaggcctatataagcagcaccagttctgggcttggggtcacttcgcctctgcaatcaagctctcccaatgaatatgtgcggaaggatgctgttgcagcatcgttcttgctggccagtcgggcgcacacaagactctcaggtctgtctgcctagatgctgtcatattcctatcttgatgataaaggactgaacttctgaatctattattcagcacctattaaaggtttttttgtttttttgtttttttgttttttgtttttttaagagttgccttgtccttggtcttggtgtctgttaatagcagtaatattcaaacttagagaataactcttaccaaatttaaataaatattagagaaatca

SEQ ID NO: 4862 - DNA, 1000 bp, mus musculus
tggagcagagtctgaaggagtaaccacagagagtctgtcgcacctggggatacatcccataatcaaacaccaaacacagacactattgtgcatgcctacaagagcttgctgacaggaaactgatatagctgtttcctgagaggtatggggcaatgggctatgtagagacagcctggtttccagttgacgctagatcttgaatattgggagaacccgatgggtggtaattcccacctacatgggtcagtaggtgttcaaccatgtctcctggacccatggttcccctagaagttactaccgccacagcgcccacaggaaagtgtggatagtagtcacataaccaatgtcccaaccttctgaccttcaggctagactcctcccagttacatagcaacagtaagataaagcctaccataaggggggctgtttggcccctcctcactctctcctcatcctctcttcattctcctctcactcttttactctctctccctcttgctctctcccttttattctagattttcttctctctctctgtgtctctctctctgtgtctctctctctctgtctctctctctctgtctctctctctctccttttctcctttctttcctcttggccatggccattctatctctctttctaccttttctcttcccccctgcctttctacaatagagctgtaaaaccatagactgtctctgttcatcaaggctcgctgtgcatggatgatgggataggctttctcctaattggccatttctaatctcccgattgaaggccttcctgtgctcaagtctaagcctagaataaggttccctgcatgagaacctatctcaccatgccttctttcccataacccagtgttcaagggcgtcaccccagggatcctggtatcaggggttgccccttgtccactccctgtccagtggggtcagtggcttagatttccacaaggagttgagtggaaagcatctggcagtcctctagcatctgcctg

SEQ ID NO: 4863 - DNA, 1600 bp, mus musculus
caaagcaaaacatcccttagattccacatcacaagagtcagaatggctaatatcaaaaattcagatgacagcagacactggcgaggatttggagaaagaggaacacttctccattattggtggggtttcaagcttgtacaaccagtctggaaatcagtctggcagttcctcagaaaattggacaatagtactacctgaggatcccacaatacctttcctgggcatatacccagaagatgctccaactggtaagaaggacacatgctccactatgttcatagcagccttaattataatagccagaaactgaaaaaaaaaaaaaaacagacacccctcaacagaggagtggatacagaaaatatggtacatttacacaatggagtactacacagctattaaaaagaatgaatttatgaaattcctaggcaaatggatggacctggagtgcatcatcatgagtgaggtaaaccaataacaaaagaactcacaatatatgtaatcactgataagtggatattagcccagaatcttagaatacccaagataaaagaagaccaaggtgtggacaatttgccccttcatagaattgggaacaaaacacccatggaaggagatacagagataaagtttgtagctgagatgaaagggcagaccatctagagattgacataccctgggatccatcacataatctgcctccaaaggctgacaccattccatatactcacaagattttgctgaaaggaccctgatatagctgtctcttgtgaggctaagccggggcctagccaacacagaagtggttgttcacagtcacctattggatggatcacagagctcacaatggaggagctagagaaagtacctaaggaactaaaaggatctgcaacctataggtggaacaacaatctgaactaaccagtacaccctggagctcctgtgcttgctgcatatgtatcagaagatggcctactcggccattattggaaagtgaggcccgttgcttttgcaaactttatatgcctcaatacaggggaactccagggataagaagtgggagtgtgtgggggaggggatgggggacttttgggatagcattggaaatgtaaaaggagaaaataactaataaaaaatatcagcttgataaacacaacaacatatagtcaagtgttatatacagagttactgagtaaaggaagcaagcaactgagcagtaaatgaatgaaatgcatagatatattagagcattaatacagaactacacaatcaaataaatataatatactataaataaagttaatagctaggcaccaacctgttgttttcttgacttaaacttattctttctgaaatatatacaaacatacattttaagagacatacatgcacacagtcacacataaaaacaccataatatacacaatgataagaatgaaaggtcaaggcactgtactcatttaatgtcatctattcagatacagaagcaggctttcctatttctttctatgacattagtaatttcacactgccatactcaaaacttacatcagagaaatatctaccttggtcacatgcaatgaaatgaagttcagaatattat

SEQ ID NO: 4864 - DNA, 1200 bp, mus musculus
aggacttgctatgatgggagagtttggttgtgatgatgccaagtaaccatgttttctgttgcttctgttcttacacgtgcctcctggatctgattatatcaagtgcttactacccttaatatatctgattggagcccatccttcctgtcatcctgattgattcaggactcctcagagtccaggtttctctgtgatcctgtgattctgggctcctgtgaaccagagattctgggtgtgtcagagttcttggcagtcaagcttcctctgagatcctgagatcctggtgtgaccaagctcctggtatcctggtatcctggaaacctaagatcctgttcgtgttacagcacctggaagtcgtgtctcctctgagggttgtgggactgtctggagtgtttgaaaccaaggtacaccagtacatatcagaaggatcccaaccttctggtcaggcagggctcctgtgtccttgctcttgctgacaaaggcctgactcaattggtttggaaccaatgttgtgttccactcaccagtgatcctaagattgggtggagagttctctggggaccatgggactgtccgctgagtttttgcccaatgtgacttgatgctggcactgaccagaagggactgaactggagcctactagaagagacttgtgaccctggtcaggtaggttttctgcttccctgctgctggctcaggcttcgcataattggattggaattgatgttgtgttacactcactagtgatcctaaattgatcccaagattgcatggaaagtcctctagggaccttgggactgtccgcctagtttgtgcccaaggtgacctggagctggtgctgaccagaaaggacttcttcccctggtgtacttcactttttaataggattgtttgtttcattttatgagaaacttctaatggatctgaagatttttttttcacctgttctggtactgaatgtccatagaacacttacattcatcttgtaaagcattcacccaaatgaagtaaatatgattgtttttttcaaaaagaataaaatttaaggagagtaaagtcggtaatcacttaaaacttttgtcttgtaagcctgagcacaaactgctgagacccacagatgtatagaactgcctctacctaattgctctatggtttctacaatgatgaacacacatgcacacacacacacatccacaaaaa

SEQ ID NO: 4865 - DNA, 1200 bp, mus musculus
aaattttagtttatcaatctaaaattctgcatactattatatgtattacattgtccctgacaaaacaaaagacagtgatttcttgacagtactaatagttagaaatgtctcctaataaaaggaatcaccatgtattggactcctgtgttcatgataacctatatttctcacaagatgtataccagtgtgtgaagtgtccagaaggtcattatgcaaatacagagaggaacaactgcttccaaaaatctgtgatctttcttgcctatgaagaccctttggggatgactctagccagcgtagctttgtgcttatctgcactcacagtctttgttattggcatctttgtgaaacacagagacactccgattgtaaaggcaaataatcgagctctcagttacattttgctcctcacactcacattctgtttcctgtgttctttgaacttcattggtcagccaaacacagctacctgcattctccagcagactacctttgcagttactttcactatggctcttgctactgtgttggccaaagctattactgtggtccttgcctttaaggtcagttttccagggaaaatagtaagatggctaatgttatcaaggggtccaaactacatcattcctatatgcaccctgatccagcttcttatttgtggaatatggatgacaacttctccaccattcattgatcaagatgctcatactgaacatggacacatcatcattttgtgcaataagggctcagctgttgccttccactctgtcctgggatatctctgcttcttggcccttggaagttacaccatggccttcttgtctagaaatttgcctgatacattcaatgaatccaaatatctgtcattcagtatgctagtgttcttctgtgtctgggtcacttttctgcctgtcttccacagcactaaagggaagatcatggtctctatggaagtattttctatcttggcttccagcatagcactcctggccttcatatttggtcccaagtgttacattatcttgttgaaaccagagaacaattcatttactcatgtgcggaagaaaacatactctagaaagaattatcctaaaatataattgaaaaaaataaatgtagcttttatgttaacaactttttaaaatgcatcattcatatatcattctaaaatatcttatagcatactaatatgaatgcaat

SEQ ID NO: 4866 - DNA, 1200 bp, mus musculus
gtcaatttgtttcaccctataatttgcaacctttcccccaaaatgcaaaaatgaaaaataaaaaaaaatctttatggaaggagtagtctgtcagtatgtcccattgcataccatattacccacgtttctttacttacatgtgttctttgtattgattcctttattaagaatcctatggcttgtaataaactaacaatatgaaatatgtacctgggctgctctgcaatatcatgttattgccctgtctcatggatatcctgaagctttggatttgtaggtctgggcctttcatgtactccagcagatcacaaagcaagtgtgtgggaagacaagctcaaggttctggatctatctatagctgggtagtagctgagccacaccaacaacacacaggagagccccaggtttgtcgtggttatctcacctaatgctgcaaacagaaaggggcagaaccaactctgatgctctcatgtccagagactactcaaatttctcctcacaatcatcatcatctacagtgttactcatgcgacttacaggttcttatcagagtgctacagtcaatgagggggtaaggctatctctgctgttctcaataacacaggaatagcaaagctatgaccaactctattgtacttttaagatgagatgctagtcatgttcttccaagttttgtaatcagggagaaacaagggcaggataggtttcttgctctcattccttcaggccagcctttttgcctaccaactttggtgggaaggaagaagcttatggctagctctccatggcccacaccaaggcatcctaaaaaaattgcaggtctagagtttataaaaccagaccaccacaggctactcaaatttcttctcacaatcagcatcatctctacagtggtactcatgtgagttacaggttcttatcagagtactacagtcagtgaggggtacggatatctctgctcttctcaataacacgggaatagtgctccagcttactgaaagtaagaataaatttttcttttgtgacttaatgtcattttttagttacattttaagtgtgacccaggtgggtacattgtgtcaacacttcaatcactttgactaaaaaatgacattaagtctattaactacccatcagggaaatggtgtacgtttagaatttgttcttgttttccaaaaaagatgtgctcactgcttctta

SEQ ID NO: 4867 - DNA, 1400 bp, mus musculus
attacagaacaattgtgataaaacctgcatggtattggtaccgaaacaagaagatagataaatggaataggattgcagtcccagaaatgaactcacatgccaagggttactaaatcaaaggagcgaaaaacatccagtgaaaaaaaagagagcattttctttctttctttctttcttttttctttctttctttctttctttctttctttctttctttctttctttctttctttctttcttccttccttccttccttccttccttccttccttccttcctttctttctttctttctttctttctttctttctttctttctttctttcttttttaattattagatattttcttcattcacatttcaaatcctatccctaaagtcccctatacgctccctctgccctggtctccagcccatccactcctgcttcctgtccctggcattctcctgtactgaggcatataatcttcacaagaccaagagcctctcctcccattgatggcctactaggccattctctgctacatacgcaactagagacacaagctctggggtgtactagttagttcagattgtggttcttcctatagggttgcagaaccctttagctccttgggttctttctctaactccttcattaggagccctgtgttccatccaatagatgactatgagcaaccacttctgtatttgtcaggtactggcatagcctcataagagacagctatatcagggttctttctgcaatattcttgctggcatatgcaacagtgtttgggtttgttggttgtttatgtaatggatccctgggtatctcagtctctggacggtccttccttctgtctcagctatgaacttggtctctgtaacatcttccatgagtattttgttccccattctaagaaggaatgatctctccatactttggtattccttcttcttgagttttatgtgttttgcaaactatatctagggtattcttagtttcttggttaatatccacttatcagtgagtccatatcatgtgtgttcttttttgattggattacctcactgaggatgatatcctacagatccatctatgtgactaagaatttcataaattcattgtttttaatagctgagtagcactccattgtgtacatgtaccacgttttctgtatccattcctctgttgagggaaatctgtatttttttccagcttctggctattataaataaggcttctaggaacatagtggagcatgtgttcttattacaagttggaatatcttctgggtatatgcccaggaatggtattgctggaccttctggtagtactatgtccaattttctgaggaaccaccaaacttatttacagagtaattgtaccacattacaatccctccagcaatggaga

SEQ ID NO: 4868 - DNA, 1600 bp, mus musculus
taggatcctaaaactgtcttagaaggcatgagttttatctcaagatactcattgtaggatgagaacatttgtcctcacaatttttctttcacttgaaaatgtgaggtgcataaatagtatgtgcatacacacaaatgttatatatgataataaatttgaaaagactataatattaatgcaacaatcaaaaaagcctatttactctttaaattattcaatattaaacatgaacactggacacagtgaatattcacttcttatacttcctaaatagtagataaaaagaacaaaattagaaaatgttacctttaaaatgctaatataacagaatataatgacagactcacttgtttgtaaatgtgatagtaacaaggaaaacatttatgcttacaaacatataatgaataagaatctcaaacagagataagaaatcatctatttacctaagttgatctgctccgtatactaatccgtcgtagaggaaccactatactcagagcagttggtaagaacccagcccccctctgacccagtcccagaactgatgctcggagcctggtggactcaggacctatcacacaccaaaacccctgccctcccgaataccaatcctcttccttccatttcttctaccccttatgtctggtcctcactgctgagtcatactcctagttggtgtgctcctgtgaaagctacatatcccgtacatcctacaggatccactgtacacagaagagttcaacccactgcactcagaacagttgagcaattgaggatcctctgttctcagagcaatcgaggatcggctgttgttggacaacagcttgactgctgcactgaagacccaacagtctgaaggcctcccaggagatctacttcagccagggaaataaattagcagcttctttgctcctgtgaagagccccaagttggaaggtcccacaggtggtctgatacagccagggtagtaagcctaccaggagaactgaagtaacccagggacaaaagagccagactccatacagtcattcagatcaacaaataccacagatatccagatgtcgaaaggcaagcataagaccatacacaacagaatccaaattacatgggcatcatcagaacccagttctcccactacagcaagccctgaatataccaacatatctgaaaatcaagaatctgtcctaaaatcctatctcatgaacttaatagagttctttaaggaggatgtcaataactcagtgaaagaaatacaggaaaacacaggtaaacaggtaaagaaattgaataaagtgatccaagagctgaaagtgaaagtagaaacaataaagaaaacacaaatggaggcaaacctggaaatggaaaacctagggaagaggtcaggaattacagatgttaagtattaccaacagaatacaagagataaaagagagaatctcaggtgtaggagatacagtacaagagactgacacaactgtcaaagaaaattcaaaacccaaactcctaacccaaagcatccaggaaatccaggacacaatgaaaagacgaaatctaaggataatcggaatagagaagaacaaagattcccaactcaaaggac

SEQ ID NO: 4869 - DNA, 1600 bp, mus musculus
tataatgccataaatggaataaataatattataggaatatatgccagagcatctataattagtgattcaataataatatgtaaaaaattattttaacataaatttaatattttgttctaaatgataaattactatttaaaaaccatatgtaataaaaacagtaatgacatacagtgaaagatgttaatctgttcttctcccttctttataaacttatgctcctcttctggtacaactctctatttcagttatgtaaccttcacagtttttgtcatattcatataaaacacatagctaatcacagacatttaatttttgaaagtaaaatttagctcttatttacaactcatagacaagagagtatgctgcagacatacattaagaaaatacaatattctaaacatggtggcacagctttaatctaagcacttgtgtagaagagcaaggttgttcttggtgagtttaaggtcagcctgatctacatggagagttccagaccaaagtcacaaaattaaacatcttctataaaagaaaccaagagaaaggagatagggatgataggacagaggaggaggagggaaggaaaaattaatcagcagaagctacatgccttggtgattaagagatttctgctgggttagtcccagggagctctgggagtactggttagttcatattgttgttcctcctatagggctgcaaaccccttcagctccttgagtaccttctctagctccttcattggggaccctgtgctctgtccaatggatgaatgtgagaatccacttctgtatttgccaggcactgggagagcatctcaggagacagctatatcaggttcctgtcagcaaataggtagcagaggatggcctagtctgttatcaatgggagaagaggcctttggtgttgtgaaggttctatgccccaatataggggaatgccagggccaggaagcaagagtgggtgggctggggagaagggggggtggggaagggataggagatttttagagaggaaactaggaaaggggataacattggaaatgtaaataaagaaaatagctaataaaataaaaagagagatttctgcttttatatggcaccttgattttgttcttagcacccatatcatcaggcagttccccatctcctaaacttgtgtcccatgcgtgtctgagagtccctggattctgcagatatgtgcatataaactcaggcaaacataaaaacatatatgagaaagtaataaatacctgtaaaagttaagaaaagaacatacggtgactatatgatacatatagcatggaatgtaaagcaaattaaaggatgtgaaattcagtgtgcctgtctatatttaaatagggaatttgacatctgtacctctacatgtactttctaataattatcttcaggaacttactacatattgcagcagacaagaatctgcctatatgggaagcaatgaatgaaaagagacagaacaaaaagccatgttatctgtttcaaataagaaatacctggagagtaatagtggtcatagggagttgatgattcagttgtgtttatacgtaggcatgcaattgtatagattccttataaca

SEQ ID NO: 4870 - DNA, 1200 bp, mus musculus
aatattttctgaaccttggagctaggactcttcgccttcttctattcctattattcgaaggtttatgtcttttatggtatatcagacttcctggatattttctgtcaagatgctttatttgcattaacattttgtttgactgatatatcaatttcttttattatatcatctgtcgcatccaccccgaccagcaggaaagacgcaacaccacattgtccttcttcaagcaggtttattcaggaacactacacattgcaatgtaggaacaggaatcccctgaacaaccccggagcatgccttaaataccctactgtctcctcccaatcaccccagtcacgtaacggcagtccattggttcacaacaagtgatgacacttcaggcgagctgacgaagcatggcatctgtgcagtgcatgcagctgggatgtggctaagtctgaggtagtgaggaagtcaggcgcaggtcataagacctggcagctgtcccgggtgccatcttggggcggcggctgcacccgctcctcacatctcctcattatttattatttaggcagagagaatgcctgtcttaggttgtcccctgcgataatgctccttacctgtcatcgggaggacagacagcagtggatctggtccctgtcttaggttggtaacacctccagggagtcttaccagtcattgactacttctctagcatgccaagccacacttgagaagattgtcccaggtctagtgctgcaaaagcctgaatcaacagtgcctgtgcacgggtatgcctttttttgcatatggcaaatgcaccacagggccattactcctgtggcaatgcagatgaatgccagccctcctatgccagcccattccttgaggtgcaatattgctgtgactatggcagcggtaatctcaaaatctcttttaggtctaaacagtgtcatcacagatggagcttgcactggccagggtacaaatctaggcataggggttatcacagccaaggaacatacagatgaattccaatacatactataaaagcaattaccactacaacgtttctcagagccaaaacactcacagaattttcaaacaaatcaaacccgttccaataacaactagcattttcccaagcccctcccatcagtatacttagaggtgacaaatcagtacagtttccatttaccctacataacaaccatacattaa

SEQ ID NO: 4871 - DNA, 1000 bp, mus musculus
tctttttcaatcttttattctgagatagtatctatctctgtcacttatatgtcttatctattcagtttctgttgttatgtctcccttttcatttctgattttgttaattaggatactgtccctgtgccctctagttagtctggctaagggtttatctattgaatttctcaaagaaccagctcctggtttggttgattctttgtatagttctttctgtttccacttcattggtttcagcactgagtttgtttatatcttggcatctacacctcttgggtaaatttgcttctttttgttgtagagctttcaacaggtatgctgtcaagctgctagtgtatgctttttccagtctctttttgaggcactcggagctatgagttttcttcttaggactgctttcattgtgtcccataagtttggaaatgttgtgggtttattttcattgaactctaaaatgtctttaatttctttatttttcttgaccaaattatcattgagtagagtgttgttcagattctacctgtatgtgggtgtagtggctattcctggttgtcaacttgacaatatttggaatgaactacaatccggaattggaaggctcaccagtgacccttatctggaggcttggagatccttatctggatcttggtatggagatcttgagccatagtggctatggattccagaagattgaatccgagtttaaggaacacacctttaatctgggctacacctttcatctgggattaaaggtgtggtggaacacacctttaatctgggctacaccttctgctggagacaatataaggacattggaagaagggagtctagctcttcttcttgctccttcgcctgcttgctgcgtgagactgagtaactgctagatccttggacttccattcacagctgcgactgaacaattgctgggaattgggctgccgactgtaagtcatcaataaattcctttactatctagagactatccataagttctgtgact

SEQ ID NO: 4872 - DNA, 1600 bp, mus musculus
cctgtgggatcctgtaaaaacatactgtagcttttacataatagcaggtattagttactgacagaatgatacatgcattcaggagtgggattagttcaaatgattcactataaatatgaaatcatagttactgtctttcacatcatttcctctttttcttctcctaatgggggttaaggtcattgttattgtttgttgttgctgttgttactattattaaacatctctctcatactacttctccatcactgattttaaggtgtctctaacctcaaggcaatgttttccagtaactatgattattatttctattttcagagatctgccctagaatatttttctgaagaaaattctaagcatgtttccagacaccaccgcaaggtaggtattccacatgggtggactttaagaagctaccatgcatactgtgttttcaacttctttctgtaagatgtggtctattctgcctaattttttttcctttgtaagacttaattgtctgaataaacactcaaacatcataaagtgtaagaaagaattattacatagtataaatgagtatcataatgatttcactctatacatgacagtaatctttgtaactcaagaattttatttgtttgtttgttgtggtaaatctccaaatatgcccaggcaataaaaacacaactcagttaatatgaatacatgctgtgcacctagattgggcagatctactgctacactaccatcttccacatcttatgagaccccttagaacttgcagtttctccaggtcatgtgcctttgctctgctcttctacttcttctcatctgcgtcctctccctcttccattttctccttcttctctccctcccccttccgctccaccttccccatatctgcccaatcatcagctctcctttattttacaatttaaggtgggaagcagatttacaggaaataacctgagtgctgactcattccttgtttatagcccctcacagaaggatggaattaacaccaaatataattacccccagtgctatccacaactatatcatgaaactgttgctagtttcatgatataactctgtgtctccatgtttattctataaaattcactacttctaatgcatcacatttaagcaacccttctgttttgtgataggaaattaaaagaaaaactcactggaattcacaagtgaaactcatcgtgcaccacttacatcaataaataaaaaattacctgtgggtgacaattacaggaatctataggttgtaatagcagcattttagaaaagtctagaacatatcctaataatatttagagttagatattccctgaactacttcaactcacaaatagaaataggatatagacaactagacttgttgaaattatctgtcattacatgaagaggttgttctctggtattttgagttggtgtacaactatgagggcataggttcatatctaggttaatgttcaggaaatgtaatcaatgcagacatatactgtgcttgtataaatacaatcataatgcaagaactcatgttttccttggtagtttttgaggcattttatttttatgaatgctttgcccttttatttacatt

SEQ ID NO: 4873 - DNA, 1200 bp, mus musculus
ggattgtatcactctgaaatgctcttgcctcagactctggattcctgaaattgactcatttttgagacactactcagcaaaagtaacacttaatggaatagtgtagccttaatgttaacttgtttctagttcaggaagatggttcagtcagttcatgaagccctttcctttggtatgtgaaggcctgaattgagtctccagaagtcagaaaataagaactatgtagggtatcaaacaactgttactcatacataacagtggaacgccataaagttccatggggttactggaccagtaagcctagaatattcagtgtttcgggtgagttaaagacgttctctaaaaattattataataatattgtcagaatgtaaaatgtgtcagaagaaaaatgagaaagtattaactttcactcccagtggatgctccccttactcaagatcatcaccagcatgtactattccttgaatttttaatcttagccattctaatgggtgtgaggtagagtctcgaagtcatttaaatttgcattttctgataaccaagaatattgaacatttctttaagtactcctcagcaattcaagatccaaatgatgagaattctccatttagctctgtactccatttttaattgggctatttggtttgttgtctcagttcttgagttctttatatattttgggtattaaccctctgtctgatatagggttggtgaagattttccccaatctatacactgtccatttgtcctattgacagtattctttgacttaacataatttttttcagttttatgcagttccatttgttaattttttatcttagaacctgagccaccggtgttctgttcatggattttccccctgtgccaatatgcttgtggctatttcccactttctcttctattagttcagtgtatctggttttatgttgaggtctttgaatcctttggccttgagtttcatacagtatggtgaatatggatctatttgcattcttctacatggagacatcaagtcagatgagcaccatttattgaagattctttcccttttcactgtatgttttgcttctttatgaaaaatcaaatatccagcagtgtgtgaatttgagggtccttgattccattacattgaacaacaaatctgtttctataacaataccatacagttttttattcctattgctttgaaataca

SEQ ID NO: 4874 - DNA, 1200 bp, mus musculus
ggagctatcaattttttatgtatgttttaagggttttcaggagtatgtccattgtcaccatctgcctcttgagtgtcttccagaccatcactatcatcccaagaaactcctgttggaagaatattagagtcaaatctccaaagaatattagtctctgcatttctctctgctgggtcttgtacatcttcataaatgttattttccctttgtacatgtccataacatttactgggaaaaacaaaacaaaggatacaaatttcaaactctatactattgtaggatatgacaaaaacacagtttccttatatataactttctttgtgtttcctgaaattctgttctctggtctcatcacctggtcaggtagctcagtgattgtcattctgtataggcacaaacagcaagttcaatacgtccgcagtactcatgcttcccctagcagcacccctgaatccagagccattcagagcatcctggtcctagtttccatctttatggctttttatacactctctgccatcttacatgcttacaatgctctatttcacagttcaaattggtggctaatgactttcgcaaacattatatctttatgtattcccacttcaatcccttttgtacttatgagtcaatcatcccctctctccaaactctgcttcctctaggaaaagtatacaaaacatgttaatactttgaatgcttttgaagagtccagtttaaaaaaaaacagccatgctttggagaagacattatacaggcaaatgcctttataagttaaatcataatggttatttaggttacttcagctagtgggacttttttccaagattagcaaaattgtgttgatctggggattttgacactttaattgacacatttcccagcattttttttttgtccaggctttcttgatgagaacagtctcaatatgttttagcaaatcatctccacttttgctaacaggtgggtggatacatagcatactaaatgctctgtacattttctatgtgttctaactaagctttactccataggcccaagactaagtaaccacaaatactggttaaatgctggtaaatttttaccatagaaagccttgttcagttcacatatactccaggacatgaaggatccaaacacttcttgagcctgtgctccatatgaccttgcctgcagctgctctagatgtatgcatccctg

SEQ ID NO: 4875 - DNA, 1000 bp, mus musculus
gacagaacataaggcattaaatcttaagaaacaggccactgtaagaataagctgggcacagtccacagaagtaagcttaccctgacctgcatcatctggctctgatcttatccagtcatcctgaggagccttgggaactacaaaacacaaaaaacaaccaacatggaacactgccacaccaattccctgccaatagggtccatttgaggtacagctagcagaggtgagttggtctggtcccctgacctccattttctggctctggtctcatattgccatctgtatggctattgggggacccaaagagcaatctgcttccttgtcaggtctgtaggaccccaaaaccacccagcctggaacaatgcaccactaatcccttcccattttggtccacctggggcatagcaagcagatgtgagttgcttatgtgaggtcccctgaagactattatctaggtctggaattcctcttaataaaaaaagagccgtgtgaggccccaagaccatcatgcttctcagtggactcccacgggtatcctaaagacaatcatattggaaaactgccagaacaatctcttgtcagtaggtccacctgaggagcagccaggagagttgagttgcatttagtcccttgacctccattttctggttgtaggctcatcctaccttcccaatgagacatggagcaacccaagagcgttatgcttcccattagaggcctgtgggaaccagtcaggtgcacctgagtcacagctagcagagacaggtaacctgacctccattttctggtctatagctccctctgtctactcaaggagtcctgctggcaccagaatcatccagccaacaccagaaaaaaaaaaaagaaaagaaaacagatgtctaaagggaagtgtaagaacccaatttataagatcctggtcaatgtggtactacaagatcccagaaacgctcctacagcaagacctggatatcctatcaaaactgaagcacaataagat

SEQ ID NO: 4876 - DNA, 1000 bp, mus musculus
gtgctgtaaagtgtgaatttttatcatatttcacttctgcaaagggggagacagagtttaaccctggatataccccagggcctgccttgatgggcagtctggagaaccatgacttctggggaaaggctctgtcataggctgcctctctgagtcccaggatgtctggaaggctctgaacactatccagtattgaactctatatattaatggaagctgagccttctcccctatagaacctaccactcctatatcacagatcagagcagcccatctcattagaattcaaggggtgctgggaacctgactggatagtccattttctgctgtcaagtaaatgtcctttgcttccatgtggccaactgggagaagggattgagagaggcaaggggatgaagccctgcaaatatctacttggtgctataaaagagattggtttctgactggcatgatgtttgaggtacactgagaaaaaaaaaggcacctcagcatggttagtagctactctcaggactgtgtagcagtgttggtacaatggggcaaggtccctggtacaggtgcaaagaggtggaattttagatctgaatcttgcttttcaggtatgttggggtatccagggcttgctgtggtggaagaactgggttctgatgttgcctagtaacattggtttctgttgcttatattcttgcacttgcctctcaatatctgtttatctctggtgttagttgatattgctgtctctgactggatcctgttcccactgtgagcctgtgatacagggtgtgtcagaactcctgggggtcaatctgcatctgggtgtgggctgagtgggtggggattcagagcacaggctccactcccagatgcaggtgcaaactggaaggaacacgtgtctctggctcagcaggattcctgtgtctcctggttcttggaggttcccagttaggccaggtattgtggtgggggttggggcctcacctatgatccaggatgtgtcagaact

SEQ ID NO: 4877 - DNA, 1200 bp, mus musculus
aagaaggtccaggggccattaagcaggtacagataatgagctctgggaaggtataggtacagttctctttccatggagccctcaggattctttaatgcctaaggtacaaagaagtacttgatgccagtttacttggacaagaggaggcttgtatgccactgcttgtcacagattcttggtagttgtgccaaacttgcacccattggtaggagggccacatctggactccctttaacatttgtcagagtggtgctcaagactggctggctgggtgtggaagcctcttctcatctaggccttctgtgttatactcatctcagtcagaactggtggttttgggatagtcagccaggatttcagctagtgcaaggattcaaactggggcgctggttgagttgagggttctgttccctggacaaggtgatacagaacaaactgggaactgtagaaaggcaaaggaaccaaccccccatgcctggctcaagctgcaagaccaaaagatcagtgttcctcattggtacaaaatgatgtgaacctgtcctgactgagaggcataatatattccattagaaaacctttgtaaaaaaaaaaaaacaaaaacaaaaaccctggtgttacgtgtggtctgtagcaattgtggtggctctgctagtggcagcactggtgtcaggacatgtcccacccacacaggcaaacatgcagttccatatacagataccacaaacacacacacacacacacacacacacacacacaatcacactcacacatacaaacacactcatacaccacattcgtacacaaatgtagacattcactgattagtatgttggaagtctaccatgggcatgtgtccagcatgcatatgttcctgaagagtgtgagcctcaccacatatgttcctgaagagtgtgagccagggctagtccctcccctcgctgaggcccgtatcctgtaagctcatgtaaggtcactttgctcctccttattcttgcctggcctcaagcatgtcatctggccctggggttcacaagtgatcccaatgaagaaagtcgtcaatgtccccagttttacatggctgcacatagtgttgacacccagcagaactcaagtgtggacaggtgcttggcaagggtctaggtccttggatttgtcagtgtcttcaccaccacagagctcctgtgggaccaaagcactcca

SEQ ID NO: 4878 - DNA, 1200 bp, mus musculus
ggggccattaagcaggtacagataatgagctcgggaaggtataggtacagttctctttccatggagccctcaggattctttaatgcctaaggtacaaagaagtacttgatgccagtttacttggacaagaggaggcttgtatgccactgcttgtcacagattcttggtagttgtgccaaacttgcacccattggtaggagggccacatctggactccctttaacatttgtcagagtggtgctcaagactggctggctgggtgtggaagcctcttctcatctaggccttctgtgttatactcatctcagtcagaactggtggttttgggatagtcagccaggatttcagctagtgcaaggattcaaactggggcgctggttgagttgagggttctgttccctggacaaggtgatacagaacaaactgggaactgtagaaaggcaaaggaaccaaccccccatgcctggctcaagctgcaagaccaaaagatcagtgttcctcattggtacaaaatgatgtgaacctgtcctgactgagaggcataatatattccattagaaaacctttgtaaaaaaaaaaaaaaaaaaaaaaccctggtgttacgtgtggtctgtagcaattgtggtggctctgctagtggcagcactggtgtcaggacatgtcccacccacacaggcaaacatgcagttccatatacagataccacaaacacacacacacacacacacacacacacacacatacacacaaacacacacacacacaatcacactcacacatacaaacacactcatacaccacattcgtacacaaatgtagacattcactgattagtatgttggaagtctaccatgggcatgtgtccagcatgcatatgttcctgaagagtgtgagcctcaccacatatgttcctgaagagtgtgagccagggctagtccctcccctcgctgaggcccgtatcctgtaagctcatgtaaggtcactttgctcctccttattcttgcctggcctcaagcatgtcatctggccctggggttcacaagtgatcccaatgaagaaagtcgtcaatgtccccagttttacatggctgcacatagtgttgacacccagcagaactcaagtgtggacaggtgcttggcaagggtctaggtccttggatttgtcagtgtcttcaccaccacagagctcctgtgggaccaa

SEQ ID NO: 4879 - DNA, 1200 bp, mus musculus
gccacatctggactccctttaacatttgtcagagtggtgctcaagactggctggctgggtgtggtagcctcttctcatctaggccttctgtgttatactcatctcagtcagaactggtggttttgggatagtcagccaggatttcagctagtgcaaggattcaaactggggtgctggttgagttgagggttctgttcccctcaactgggtagcatagctaagtatgcctgtgaggaacagataggcccgcaacgcaacagtacatccttctcttggcctggatatgcctgtctgcccttcccaccagagcatggctggctgttacagctgctcttcattatctttgggaatagagcagtaagaacccagctggggcttctgttcctcagggagcaggcaggggtcttgtgctcagttgtcccccactagatccaggaattgcctagaattttggtttacaatactctctggagcagcagaggccagcttagctcatccttagtgtgtgtgcagcagttaaggctatatggaggtcaggatttgtgtcctgtgtcttcacagacaagaaggaaccaagaccattggctgacccttagaagtcatgtgggtcccctaaaaactcctatttctgtccttcctctgggcctgtggagaggcatggggaactatgccaagtttctctggccgtgagactttggagagctgcagactgtggtcatggtccttagggattggagaggaatattagagaccaggctctcctcaagcctcttctcaatagggtgcaatgggggcacagtgtgggcataagatgggcacaagcagaatcccagagtctccttactatatttgtctatgagacgggtgagagcaagccatcactcacaggccctctgttccctgaacagaggcttgaactctgttaactgtctctcatactgactggcctgctggtcctatgatagaatcaggctgaaggtacagctaggtgtccagccaagagacatctcctgggaacacagttatccagctacagccatggggtatttctgcatgattcacagggcctggagccccaaagcctgctgttaggccctggtacccactgggtacgggtgatgaggaactctggatggggtgtgcaggcaatggtagctatttttgtgacatggtcatcagagaagagtgactacacagaag

SEQ ID NO: 4880 - DNA, 1000 bp, mus musculus
cccactcttcataagaacaaaatctctgggctttttccaagaattcctttgttgatgcaattgctattaatctctttaccttagcttcaagtagactctttaagacaagaacagcctgctcttctgctttctgatgggatagactgcttgccaatctgctcccctgaggacaccatatcctgagtcatccaagaagatcagctgccctcagagaagttggtaagaaccccctgtccccatcccaagttccagagctgccactgggagcccagtggactttggactcatcacccaccaaaaccccaaccgaataccactacctttcctcccagtcctttctgctgggacagactgttcccctgaagacaccatatcctgattcatcccaaagatctcctacactttgagaagtctggccactgacatcacagcctgaggcatgccagaagatctgctacactcagtgcaactgagcaacaggccccacagtctgaagatttcctgggggttctgtggcatgcagggcaactgacagactgaaagcctccagggagttctgctgaacacagggaaacagaaaccacagttcttaggcccctttggagaacaccttcacacaggacagcagcttgactgctcttctgaagaccaaacagtctgaaggcatcccaggagatctactgcagccagggcaacagatcagcagtttctctgcctctctgaagagcaccgagttgaaaggccccacagatggtttgctacagccagggccatagataggcctaccgtgaaacctgaagaaattcagggacaattccagagtcacacagaccagcaaacaccagggataaccaaatggtgagaggcaagtgcaagaccataggcaacagaagccaatatatgtgggcatcatcaaaacccagttctcccaccacagcaagccctgaatacaccaacacacctgaaactcagaaagcagacctaaaatcctatctcatga

SEQ ID NO: 4881 - DNA, 1000 bp, mus musculus
atccacataagatgggggtggggaggaggtatgggatgtggaacagtcaaagggtggttcagcgttgagggaataaatcatggaatgtaaaaaatgaattaattttaaaaattatgattttccttcccagatcccgccaagactagtctgcacgggtgagagtgtggactacagatgttaacagcttctgggacatgtgggagccacagagtttctgtggcagaccccatttcccactccagacatctgggcaccttccctgtcctaggagagttgtccatctggcctgggaagccattgccagagcatctgccaaagaccttttggttcccggatcttgtcaagcctagtctgcacaggtgagagtgtgaattacagaatctaacagcttgtggcagacgtcttttcaggctccagaaatctgggcaccttccctgccagaggagaggtgtcctccccacccgggagggttttcctggagcatctgtgggaaccatctttgttcctggatcctgccaagactagtctgcacaggtgagaatggactacagaacctaacagcttctaggacaggccctgcttagggccttcatattcttccaggaggcaaatctgaataaaagatatctgtgcaccttctcttcaagaagatagcttgcctgcagagagtgctctaaccactgaaactcaggagagagctattctcccaggtctgctggtagaggctaacagaatcatgaaaggaacaagctctaaccagagacaactataaaaattaactccagagattaccagatggccaaaggcagatgtaagaatcttactaacaaaaagcaagaccactcaccatcatcagaacccagcactcccaatgcagccagtcctgggtaccgcaacacacccgaaaagctagacccggatttaaaggcatatctcatgatgatggtagaggacatcaagaaggactgtaacaacacacttaaagaaatacaggagaaca

SEQ ID NO: 4882 - DNA, 1200 bp, mus musculus
catctgaaactcctgacgaatttcctagcttttccatctccagggttgtgtccctttgtgatttctatatatattatatttccatctttagatcctggatgctttttttttcaatcaaacctgtttgactgtttggattttgttttgttttgttttgttttgttttgttttgttttgtttttttcctttttaaggtcttctacttatttacctgtgttctcttatatttctttaagggagttatttatttccttcttaaggtcgtctatcatcttcatgagataggagtttagatctaaatcttgcttttttagttattagggtatccgtggtttgttgtggaagaacttgcttctaatgtttccaaggggtattggtttctattgcttgtgttctcgtgcttgcctctccccatctggttatctctggtgttaaatgtcctttctgtttcttagtggagcctgtccctcctatgagcctagttatgctgtacctccttgggtcagattacctctggatgtgagtgtggctgtggcacacctcccaggagtctaactgactctggatgtgggtggagttgggtgagctagagcaccagatctcttcacagtcacagatgtggacctgaaagatgtgtctctagcagggtgggaggacctgtgtcctctgggcctcagggtgggggtggggtgttccagttaggccaagtactggggaagtaggggggaactcacctgtgagcctagtaatgtcagaacacctgggagtcaagctttaggtgtggaagggttagagtcagttctgaggtacatgatctgctgctcccaggcccagttgtgaaccagaaagtaggtgaataggtaaactatttaaacagtcgcaaacccctaattagaagtagtcatttaaatctcccatccaaaaaaaaaaaaaaaagtgactagggccagatggtttaggtgcagatttctaccagtgtttcagggaagacctaattgctatactcctcaaactattctataaaatagaaacaggagaaacatcacccaataattctatgagtccatagtcaccctgatatcaaaccacacaaagactcaacaaagaaagagaagttcagatcaatttctcttatgaaaaattgatacaaaagtattcaacaaaatacaacctgaatccaggaacacaacaaagacatca

SEQ ID NO: 4883 - DNA, 1000 bp, mus musculus
ggtttctctgtgtagctctggctgtcctggaactcactttgaagaccaggctggcctcgaactcagaaattcgcctccctctgcctcccaagtgctgggaataaaattgtgtgccaccacacccggctgttttctttcttttattttaagtttatttacatttcaagtgttgtcccctcacctggatccccccttccacatacagcatatcccatctgccatacctttccttctatgagggtgttcctccaccaacccacctattcccacctcctgcccttgattcccctacactggggaatctattgagccttcataggaccaagaacttctcctcccattgatgcctgacaaggccatcctctgctacatatgcagcttgagccatgtgtactctttgttgatgacttagtccctgggaactcagggaggtctggttgtttgatattgttgttcttcctttgaggttgtgaaccccttcagctctttcagtcctttctctaacttttccattggggaccccacactcagtgaaatggttagctgtgagcatccgaatctatatttgtaagactctggcagggtctctcaggagacagccatataagactcctttcagcaagcatttcttatcatccacaatagtgttggaatttgctgactttatctacaatgaatctccaggtgggacagtctctggatggcttttccttcagtctctgctctgcactttgtttccatatttgcttctgtgaatattttgttcccatttcaaagaaggtctgaagcatcaacattttatgttttctttccagagttcactttagtggtaccacattttccacacagtcatacaaacaagcaagcatctagaatataaaacttgagacacaaatgacgtctaactaggggaatgtaagaagattgactgcactttgagaggaccaaagttcacttcccagcacccacatggcagctaaaagtcatctcaaatatatgt

SEQ ID NO: 4884 - DNA, 1000 bp, mus musculus
tagtggcagatgccttttatctctgtatgtgggagacaaagcaggaggttatatgcaaaactgaggctagccttatgtacagaactggttccagaaagccaatgcttcacaaagaaatcccttttcattaaacaaaaaagggggtagggggaaggtcataatacataaaaatatggagtgacttcacaatatttattcaagagtacacagtaagcttctagaataataagaaataatcacatccaggagcagtacacagaaagtcataatcaaacagtaggattaaatcattaaaaataacatacagttataaatacaaagactagcccttccggtccactacagcactagggtccctggccaagggagtctctgggcacccgcaaggacccacacaggatccaccacgggatcctaagacctctggtgagtggaacacagctcctgctccaatgcaatctcgcaggaactgagactgcattaattagggaagcagaaaacccagcctaatcagggtcagaagtcccttccagtcaatgccagcaccagggttccttacccgcagagtctctggacacacgcaaggacccccacaggaccctccacaggatcttaaaacctatggtgagtggtacacaacttctgccaggaggcaggttcaaataccagatatctgggcaccttccctgcaagaggagagcttgcctgcagagagtattctgaccactgaaactaaggatagagctagtctcccaggtctgctgatagacgataacataatcacctggggaaaaagctctaaccagagacaactataacaactagctccagagaataccagatggcgaaaggcaaaggtaagaatcctactaacagaaatcaagaccactcaccatcatcagaacgcagcactcccaccccacctagtcctgggcaccccaacacaaccgaaaatctagacccagatttaaaagcatatctcatgatgatggtagaggac

SEQ ID NO: 4885 - DNA, 1200 bp, mus musculus
tgtccgcctccgggacctgggaggggccatcctgcggcacgcccggcggcaggcagagaacatcggctatgatcctgagaggggcacccacttgcccgaatcacccagattggaagacttttaccgattctcctgggaggatggtgaggagcctggatgggtagagaggagaaggaccaggaagagaggcacaaggacagggcccagacagcccaggatcagggtgggccttgggggtacaaaagctgtggctgggagcacactcagtgctgtgagacaggtgtttctgtgtatttggaaagccaaggcctctccaggcatcttctggatccctgcagtgtggctctggagcctcgggtgggaggaccaggaagtagagaacttcagagcaccgcactctgcctgtcccctcttgctgcataatcactcaggccagggattgataagtctctacgtggccgcaggcataactgggacttgcttcctgcacgtttcccaaattctgctctgtcccttctaggcagcagtgttgtagggccaaggcccatactgacactgctggaagtcactggcctagcccttccaggagcgtagtttacatccaaaagatgtcagcccttttcgctcaccctgtgctgggccggtccttcagcctctttgtcctccattctccctggcagtggacaacatccttatcccagagaaccgggcccatctgtccccagaggcacagctgaaggaactgctggagaaactggatctggtgagcaccatgcggtccagcggggcccgcacccgtcgtgtccgcatgctgcgcagggagatcaatgcccttcggcaaaagctagcacagccaccgccaccacagctcctgtcactgaacaagactgtgcccaacggggagctgccagcaggatctcggggggatacagctgtcctggagcaggctcagcaggaggagccagaagaggaaggggacagaggtgagagagtctcaggcaggcaggtgcggggtggtagggagtcaggaggaggaagaggctgaaatctctttagagtatcctccctgagggtaggcaaagccctcggaagtggtggtggtaggggtgtccctgtgttcccagggctgtggagaggttcagagaggttagggtgcccagcagctccccagtacacagttacacctgaagcatctttgcc

SEQ ID NO: 4886 - DNA, 1000 bp, mus musculus
caacaataattctctctgggtaatttttctagatttctcaacttgtgcagaattacatgttattttttttccttttcatttccatatgtgtgtccatgtgtatgtgtgttcacatgggtgtagggacacacgtgttcaaatacacacacttatgtgcttgagtgtgtagagaggttgatgttgggaagctttccctatcactcaccatcttattctctggggcaggtgtcaatcaaacctagagctggctaatgtggctatggttgctagcttgcttgctccctggggggtggggggtggtccacatcccccttcagaggctgctattacagggttaccgtgcccagtaagcatccgcgtggatccttaggacgtgaactgtggctctcttgcttgtacagtgagcactttaccactgagccatctcccaatggctaatatggttaacctaattgcgcatgcacacatatatttaagcatcagagatagtctttttgttttgttttgtttgtatttaactagggaaaattatttctgagactaagaaattatatgctgtgttttagggaggattctcatgtctgtctgagcaccgacaacactctttccctacccttcatgatgccggcatgcagctgcgtgtcggaggacctgtgctccatagccactttaccacccggtttcctcttgtctccctccttccctctaatgactgttctctcccaaagtctgcagcaaggagaaacaccaccctcaagtctcccgaatccccctgctgggaggtctcacaaaatccagctagccataatgatgcacacttttgatcaagcatttgggaggcagaggcaggaagaggagctctgagtttaaggccagcctggtctgcaaagtaaattccaggactgccagggttacatatagaaaccctatcttgaaccccacttaccatgtacctgcttttccacatgggcctctgcctctctctgcctctctccctctc

SEQ ID NO: 4887 - DNA, 1000 bp, mus musculus
tgtcattgggggtgggctttgaggtctcagatgctcaccagaccagtggctcaggatctcttcctgctgccattggctccagatgtggacctttccctggtccttctcctgcaccatgtctgcctacatgccactgcgcttcccaccatgacaataatggactaaacctctgaactgtaagccagccccagtgaaatgctttcctttgtaagagttgctgaggtcatagcgtctcttcacagcaatgcaaacaaaatgtccctggatttggaaatgagtagaggcgatgttccatatgtgtaaggtgggttgtgaggcagccttggtaatcctcactctggcaatgtacctagatatctattctccacatggaagagcccaaaatgcaggtcacggaatggcttgaactaactcatgatttatgcaaacacacatgctcgttcgatctgctgcaaatgcgccattgggatgagctcaggaaagagctatagggggagacaagagatgcaggctcagctctgccgcagagcttacatacaaggtgtatgcctggtgagagcaccccacttcctagcataatgagacatcacaagcaagtgtcggtcaccgagagttctcgaatgagtgtgcgccaagtaagctgactgctgcttagctattgccatacagagattttcccatgtgaatttttttgcctatgcttcttgctcttcttgtcttgaggtagaattattcatttaagacactgagtgctttcctctgcaagtgctggcagattgcactaagcaatggtcgcacagctacaacctgtggccttgctgtactttcgacacaatagagaacaacatcgaagctttgaaataaatgcctatcttaacttgacccataagagaaattgtgtctcttccattttcatttgttttgtgatgaactcgtatttggcgctatacgtcaatctttcttgtatttagagtggttttcttagctgggtgtggtggct

SEQ ID NO: 4888 - DNA, 1000 bp, mus musculus
tcagagccttagcaggactcagacatctgcgctactcaagccttcctgaatccatgtgccggatttctctcgccttgctttactgccatacatgtacttgaaccagtgcacaaccccagcacctgagcagagcaatcctggggatccgagacaaccaggagagcacaagctatagccagtcctgggcctgctaaggtggggcacagccagccacaggcactcagaagtctctgcttgtagactgtccttgctgccagggtctcaccctcctcagccctaatggctgggaagtgtagggcagaagggctatacttcagtttccaaaactgacccattttcttttcacaggcttgtacacaggcctaatatttaaagcagatataggccattaagcaccatgtctgaaatatcacttattttgcaagccatgtttctagcacttagtatagtattatcggcaataaggaagggcatgtgtggccttgtgtttggaattgggggcccaggtggcaactgtaggctcctgtcagccttggggtcactttgccttcatgcattgtgtcatggcagctctcaaattaagacaatcccctgtttggactaagatgatcctggctgtttagcttcttcaggcctggagaggcctgaatacctgtggacagtggcctgtgactcaccaggagagtcacctgggacactcgggtctctggaatattgaagatgtgggagctcctgaggtgtggactcacagggctccctctctgaattcagttcgaccattaggaacaccttgttgcaccctttggtctgcacgcccttgaggtcactaggcatgcacactctcaaggcccgcagtctttgtaaaacggtgctcagaccctgcttgcctccctaaagaacctccaaccctgctttggagtctgtgccttccgatgcctctcttcccttctgattttctctgggtccctcctgctcatacatacagtctccatgcccagcc

SEQ ID NO: 4889 - DNA, 1000 bp, mus musculus
acagagtgagttccaggacagccagggctacacagagagagatcctgttccaaataaatacttttttaaaaagcaaacaccttaagtttgggagcgggagagacaggtaagagcagcaggtaagagcaatggccgctctccctaggatgctttatctgcacgcacacaaatccacatatgcacacacgcctacacatgacccagaataaaaatccttaaaaaagaaattcaagaaccaagtatggtggcttctgtctataacctcagcactggggaggcagaagcaggtggatctcagtaagttcaaggccagcctggtctacataacgagagaccatatttcaataaaaggcccggagactgtgggagtgagaagaaagcaggctaggagtgagtcctggccagggaagcaagccctagccaaacagggcgacaaggtgatacagcaggaacagaagagctgggttagcaggtgtggggagtgggagtgcgggactccagctctggctataaaactctgggctcagcggttaagagcactggctgctcttccagaggtcctgagttccattcccagcaaccacatggcggctcacaatcatgtgtaatgagatcagatgccctctcttctgtcgtgcaggtgacatgcagatagagcactcataaaataactaaatcttaaagctaatgcccatcatcctgtgtaaaagtgctccccctcgtggaggggaagggaaacgctatggacagtctgctcttaccaattgctaatgcaagcgtaggcaagcctgagagtccctgtcccatgggtcctgataaggccagtgactaccgcccccaagtgagctaggtaagggaggggctagtgagatggctcagcacctagtgctctttcagaggatgcaaattccattcccatacccacaaaggtggtgggggatgggagtagtgctcacagctgcaggtaactccagctccaggggatctgacaccttcttct

SEQ ID NO: 4890 - DNA, 1000 bp, mus musculus; identical to SEQ ID NO: 4889

SEQ ID NO: 4891 - DNA, 1000 bp, mus musculus
cgaatggaactgctgcagggagacaacggggacttaactgctaatcaagcccctagggtggctctatctgtggagttgccttacatagaaggcaccaaacatgccctgagcagcctgggagagacagagcaaaggccctggggctggaggctcaccccgctgccccggattatagataggctgatcggtctgcacaaagatgtggcctcgtcgggaagagaagagcaagttgacaccctgagtctctgtggctttgaaagctgtgttccttagccacggagactgagctaccagctggatgtggggggctctgcgcaggtcaaagaggccacagctcctcacatcttccagtgggacctatcaagacagaaggagactatcagacagagcaaaaggaacccaatacagagcctaaggtagggacagcaaggccattgtgccagaggagagagaggcaggaagtcattgagggggatgggaaggaaaaggcaacagaagtgccaggcacaatggctcccggctgtaatcccaacacttgagaggcccacagtagggtcactgagcaatttcaaccaatctaggttacaccctgaaatcccatctcaaaagcaaaactaaacaataaaacaaaaggcaacaggcaaaccaggtgtacttgtaaatcttagcactttgggggctgaggcaagaggacagctgtgagttcaaagccagcctatgtcacataacaagctcctgtctgctgctaaataagcagacaatggggtgcagcagagagacctgagaaacagcaggggtgctggtactggttacctcaaggctgagcagcacaaagtcatctcccgagctcagcttaaagtccttctttggggagcaggaaccaccctttgggtttctgaggaacactgatccttttacctcctgtcctggaggggcatccaggagctgtacccccaccgacaggggggtccccaaattaaccacagaaggggaaaacagg

SEQ ID NO: 4892 - DNA, 1000 bp, mus musculus
ctggtcagtcttagaattgcaacagaaaacagagacacacctgtcaagccaagcagaaaactgaatatcccatgggaatcctttccacaggaaatcaaactgtcactgagtttgtacttcttggtttccatgaagtccctgggctgcacctcctgtttttttctgtgttcaccatcctctatgcctccatcatcacagggaacatgctcattgcagtggtggtggtgagctcccagaggcttcacacacccatgtatttctttctggtgaatctgtccttcatagagattgtctatacctccacagtggtgcccaaaatgctggaaggcttcttacaggaggccaccatatctgtggctggctgcttgctccagttctttgtttttggctctctggccacagatgagtgttttctgctggctgtgatggcatatgatcgatatctcgcaatttgtcaccctctacgatacccacacctcatggggcctcaatggtgcctggggttggtgctcacagtctggctgtctggcttcatggtagatggactagttgttgctctgatggcccagttgagattctgtggccccaacttagttgatcacttttactgtgatttttcacctttgatggtcctggcttgctcagatacccaagtggcccaggtgactacatttgttctctctgtggtcttcctgactgtcccctttgggctggttctgatctcctatgctcagattgtagtgactgtgctgagagttccttctgggaccagaagaaccaaggccttctccacatgctcctctcacctggctgtggtgtccacgttctatggaacactcatggtattgtacattgtgccctctgctgttcattctcagctcctctccaaggtcattgccctgctctacacagtggtcactcccatcttcaaccctgtcatctacaccttgaggaaccaggaggtgcagcaggcactaagaaggcttctctactgcaaacc

SEQ ID NO: 4893 - DNA, 1200 bp, mus musculus
aaataaattctatgattaaatcaccacaaattaactttcccctgcattaaaagatcaatacaattagatatatttgacattattcaatttgttcagtaatatatgtgtacatctactatacataagaacatatcttaattttagaaatatatattgcctggttatttacaccaaagcagagttatttagatttcttcaaatcagagccatcttctcacctttctattcaatgcactcctcacttccttgtttctcaaggtgtagatgagtggattgagagcaggggtgaccacactgtacatgatggcaatgattctgtcctgatccagagagctgcctgaggcaggacggatgtaggtgaagagaactggaacatagagcagaatcacaaccatgaagtgggaggcacaggtagacagagctttgtggagcatgctgcaagaacgagtcttgaggaaaagataggtgatgatgtagaaataggagagaaatgtcagaaaaaagggagtgagggcaatggtgcctgtgactgtattgagcagccaaaggttgagctcagtgtttccacaggccagatccaacaatggcttaatatcacagaagaaatgatggacatgattgggaccacagaagctcaaacgagatgtcattacagagtgaagtaaggcatggaaaaagcccagggtccagatagtaacagtcatgtgaatacagagctggtgattcatgatcacagaatagtggagtggtctgcagatagccacaaagcggtcaaatgccatcactggcagcagcatggcctcagtgctacccaggaagtggaagaaatggagctgagttatgcatcccaagaaggaaattgctttgcttgtggagaggaggttctgcagcatctttggcagtgtcacagtggagaagcagatatctagacatgctaggtttcccaggaagaaatacataggtgagtggagtcttgggtccaagatgacaatcatcaggatggctccattcccagttatattgacaaagtagattgtgaagaaaaccacaaagagaatagggtttaattcttgtatatctgttactcccaggaggagaaattcagtgactgaggtttgattagacatcacctataagaaaggacaattagtatataatactaccctgcatgttaaccagtcgttctagccatagattttc

SEQ ID NO: 4894 - DNA, 1200 bp, mus musculus; identical to SEQ ID NO: 4893

SEQ ID NO: 4895 - DNA, 1000 bp, mus musculus
aggaattagggaaacaacacccttctcaatagtcacaaataatataaaataccttggtgtgactctaacaaaagaagtaacagaattgtatgataagaatttcaagtctcgcccttccactcccctcgagccccgggctaccttgccaggggaatcgcccgacacccgcaagggcccacataggactccccacaggatcctaagacctctggtgagtggaacacagcgcctgccccaatccaatctcgcggaacctgagactgcattacatagggaagcagactacccggggctgacctggggcacaagccccttctgcttcactcgagccctgagctaccttgccagcggagtcgcctgacacccgcaagggcccacacagaattccacacgggatcctaagacctctagtgagtggaacacaacttctgccaggagtccggttcgaacaccagatatctgggtaccttccctgccagaagagagcttgcctgcagagaatactctgcccactgaaactaaggagagtgctaccctcccaggtctgcttatagaggctaacagagtcacctgaagaacaagctcttaacagagacaactataacagctagcttcagagattaccagatggcaaaaggcaaacataagaatcctactaacagaaatcaagaccactcaccatcatcagaacgcagcactcccacccaacctagtcctgggcaccccaacacaaccgaaaatttagacccagatttaaaaacatttctcatgatgatgatagaggacatcaagaaggactttcataagtcacttaaagaattacaggagagcactgctaaagagttacaggcccttaaagaaaagcaggaaaacacagccaaacaggtagaagtcattaaagaaaaacaggaaaacacatccaaacaggtaatggaaatgaacaaaatcatactagaactaaaaagggaagtagacacaataaagaaaacccaagcgaggc

SEQ ID NO: 4896 - DNA, 1400 bp, mus musculus
ttatgcatttctctcctcttcctgctgcccaatgcaaaaaccaaccaaaatcaaaaccaaaccaccagaagctggaaagaacccagatgtaaggaccaagggcctctccccccattgatgactgaataggctatcctctgctacatatgcagctagagccatgagtcctaccatgggtttctttgattggtcatttagacccagggagctctggggctactggttatcataaaggttttttttttttttttttttttttttttttttttttttttttttttttttttatggggctgaaaaccccttcagcaccttgggtaattgcggatgccaataagagcttgctgacaggagccggataaagctgtctcctgagaggatctgccagtgcctgacaaatacagaagtggatgctcatagccattcattggatggagcatggatcctctgcttttcaaatccgatgttccaaatccacatttgtccaaacaaaatcatggtcaggtctatcacaacaattccccactctcagtaccaacttcggtcttagggttttacttctgtaaacaaacactatgaagaaggcaactcttataagaataacatttaattggttctggcttttaggttcagaggttcagtccatctccaatatactgggatcttctgctggaaccaggcttcaccaatagccatttgtaggctctcttcatggtgccaaacctcaaaccttttgcatgacccctccagtcctggttcatcaactactactgaggctgcactttcaccaatggccttctacagcctcccaaagtgccaagcctcagctgctcttcatgaccccttcacgccatcaaaaccagtcccacctgggtgactcttacacattaccaagtacagctgtagtatgagataaaaccttgactatctctggaacataagcttctttgtactctcagaaaacacatcccagatttcacctcaatgatgctctttttgttttttgtttttattttttaattggattttttatttacattacaaatgatatcccctttcctactttcccctctaaaacacaccttccctctatccccttccccctccccctgctcaccaacatacccactcccaattcctggccctggcattcctccacactggggcatagagccttcataggacaaagggcaggaacatggcagcatccaggcaggcatggtgcaggaaaagctgagagttctacatcttcatctgaaagttgctagtagaatactgacttccaggcagctaggatgagggtcttatagcccacacccatagtgatattccgactccaacagggccacaccttctctaataaggccacatctcccaatagtgccacttcctgggcagag

SEQ ID NO: 4897 - DNA, 1000 bp, mus musculus
tgtgctttagagggacttgataggcagggacttgggagggagtggttttacctggttgtttctggtgtctgcaggcctcagagaatgcaggcagagttgagcaacagaaaataagagtgcagggaatagggcacaagtcatatcggctgggtatgcttcagcaaagaagcaacaggcaggggattggggtagggtcaagggtcttatcaggatgaccctggtgctgcaggcccccagggatgttgggagagctgtgggacagaacatggtgtgcagggaccaaggctcaacaatgctgtgacaagtaggagatgggagttgtagaggtctcacctggatgcctctggtgcctatatgtgaggagcgggtgtggccgcagtcccaaaagcgccagggactgcagctaagtcgtatgacttacacctgacttcctcatataagccacaaacatcttgagagctgcacaggtgtaccaggataccggtgaacccattttgatggagatatgcccctgctgccctgattagctgaagctgcgtgcctggtgaagtggcgtggcctgctgtgcgtggatgggaactgagagtataaaagattgagaggcccagggttcgggggagatataaacaagggagatataaacaagaagaaacaggactgaataaacgtgtgcagaaggatcctgttgcagcgtcgttcttcctggccagctgggtgtgcacaacacctatagacctccaggaacacagccagagctatgggttagaagatggatctcaggggatagggcactgcacacttttgctaggtgttctcctggtggatcttggaagacaggataatatggagagaggccccacttgcttgtccctgatgacattaggtctttggggatgcaggcagagctggatgttcctggtgctagcagggcctcaggaatgtaagggggattgtgggtcagaaaatggtgtgcaagggacaggtcacatgttactaatgc

SEQ ID NO: 4898 - DNA, 1000 bp, mus musculus
atcttaatctcttcagaacttaaggaaagaatatttgggggttgaagtttttgtatctgaattattgttccccaaagccatttgctattcttggctgggtacatgggttagtcacttaagtctccacacatcctattatagattctcagctggactcaccatcagagattcctggaattctccccagtcctaggcttccagctagatcaagagatgtttcccactggttgcctttctgtcttccagccttttcctgccacccttttacccatagcaagaaatatgaaagtgtgacaaaaatagaaaaatatttagaaatatagttaatctgagcacaaacaaatcaaaccaaaacaaacctgtaaactagcatggtaaaccgatactgtgaaaatagatgtgaatctcccctccctgtctctcatttgaaaaaggaacaaatggaaaaatccatgagtaaagagaagcagtagattgttgatccaacaacacatgaacagaaagtacttatggctaagatccaatgtcactgtcttatagtctgatgttcaagaatcagaagccaagagtaactcttcaatcaaaccactttgcttggaatagcaggctgtgtatcacatctgcatctgagttcaaacttctaaagtcaccacttcacaaggaaaggaggaatcccaaagaattagagaagcaaaggagagtgaagcagaaactgaaatcctgtgaaacaatcaatcgaggtaagactgcaaagcaaaaaaataagtttcaagatgataatttttacagtgaaaaatttgcagtggctagaggcacatcagtgcctcatatttagaaatatatataaagtaatgggactgccaagtaatcttcgagcatgcacctcatcaagtaggaagtagtatatagaaacaaacctcaaagatgactagaaaactcaatttttatgcatttcttcatttgtacaggataatagcaagaaaatcgtttccttaagttt

SEQ ID NO: 4899 - DNA, 1000 bp, mus musculus
tgtgagttataaatatctttcttgaaggaaactagtatcttaatgaggaagaattttaggtcattatgataattttcaggcatgttggggtatgcagggcttgctgtggtggaaaaactggattctgatttgtcagagtattggcttctgttgattaatgggtttcactggtctttgtccatctggttatctctggtgttaagaggcctgggtgtatctgtctggatgctaccttctgtgcctctgggttgtttcaggtatcctgggagacctgtggtcctggatgcagtaggtatctagggagactttcaggctgcagggtctcaaaaagtgcatatatgccaatcatctatggctcaggttgcaacaggtctctcagtaggcattcacactgtgtgatctattgcaatgtctgcagaattacacctggaaacttttcagactgtggtatcttcaaaggtgcagacacattgcatatctgccccagaggaagccacaggctatacaggaggtggaattccagcagaggggatgagtcctgagtctgttacttccacaggtgttgcaactgctgtggttatttgggatggtccttcacctgttgcactgggtgctgcagatctgctggaaggcttttagaagaaggcctgtggggtctgctgagggacagaaacactgattacctgccctggcagaaagtacaggcaggaaggcagtagagtttgagtggagtggatggatcccaattatgctggccacctaaggctattgtagctgctgcacttattgggaatgctcctttcctgttgcattgggcagagatctaacaggcctttagacttttgcatctgttgaactgggtgcaccagatctcctgagaggccttcaaactatagggtctacaaaggggcagaccccatatcattttcatacaccctacatttaattgaccatgtttcttccctttcttcaactcaatttttttcctgattgtactttt

SEQ ID NO: 4900 - DNA, 1200 bp, mus musculus
ccatatatgaattgaattaagtatatcctaagaagacttcaaaccttaactgattggtcaaataactctgctctcaaactactatgttcttcaacagccattttctattaactacacactggcatcagaggttacattttacatatatatatcatcccagtttctaacctaagtaaaggataaaaagagatggtgaatggcagcttgttttctagttgagctggttttaaacactggagacccagcaggtgttcctgcaagggatggaaagcatgtgccatgctcaaagacacaaggctcctgacatgaagccttagctctccataattctgtggccatcagtcacataggccaatgccccaagcccctccacaggtaaaggatatgactacagatcatatagcctcaagagagatctccatttcaatgaggtacctaaaggcctgaagggcttagccaattaggtactccttccaagacactcctccctgctaaagatatttaacctcaggccttccctgagaaagtggggtaacatttcactcatcacaactctctgtcatgacaataaatgtcttaaaactatgtactgcctcttgtcattgggacccactgtgagtaacaatggagcaggtcattctttaaagagcagcacctctaatatcctgcatgtggcctctctgtgctctcagccatgttcttcatcaagccaagcagcaaaaacaagtttaggacactctccctcctccccaccagaagcagctggggcttgcctgctacccttttccctttagcccagggtcagaacaagctccctggtcacctactccattctaagctcttctgggacaccaagcagcatctgtggtgtccaagagctacaatctgccctccctggtctttttgttgcctgaggacccacaagccagaccttagactgcaccttcccatccctggagtggtttttacagccagaggcctgcccagtggtggcatgggatgagcacagtcaaacttcccacttccaaccttgcccaatggcctgagccctgggctggaagtgggccaccattttaatccacagagggcccctttctttatgaaaaaaatgcaattgccatatgatatctgtatagaattagaacatccaaagacagagtagcactgtaatgttgtttaggttttttgtaccaggtatga

SEQ ID NO: 4901 - DNA, 1400 bp, mus musculus
ctcctaacagcaagaatataaaaattgaaagagaagtttgcagtaacttttccctgtgaaacttgaaaataattcacacagaattcttacacataaatcgtgaattatcataaagattatttcactgtgtgggctggacacttctagtacagattttctttaatcacatggtgtgtttttgttttgatatacttgcaaaatatctcaaaaatgacataatattttatgtaattttgtttaagaatttaaaaatagttaaagtctttgagatgtctttgtaaaatatttgtgccttggaataaagtatagaacaaagtattcagaattagagaaaaactattaatgtatattgtataatatattttgctcaaagagatcattatcatagttaactttttagcattacactttagtggtaaggtccatagtagtaacaacaacaacaacaacaacagcaacaacaataataataataatagctatccttattattattactattattataaaaagattacattttaaaagtacaaattgttgcatcccactcgaccagcaagaaagatgcaaccactggttcttctttaagcagtttactcaggcaactacttacttcaaatcccccagcctctctagttacgagtgtttttctccactccagccacaaccacgcccccaccaatcaccacaggtcacatcacctcaccaggcaggcttgctcagccaatcagggattaaggtgctatccacaaaacatgggcttgtttactaccttgagcagacttccgtcctgctgatcaggaagtccagaatggctccctacaacaaatgatttttctttctagacattcattagttttacaattattttacttacctgtgtgattattcttctcaatacaacaaatatccagcaaaaaattcattgttaaaaagttggataaaatactgagctctgatattcttttgcaagcttgcctttctttattccttccttcctctctctctctctctctctctctctctctctctctctctctccctctctctctctctccctccctccctcccctcttctctcttgctctctctatctctctctctctctttctttctttctttctttctttctttctttctttctttctttctttgttgttgtggtgtttgtttgtttgtttgttttcagttttaatttaaaagtcagtatttccctcagtaagcataactgttctgaaatttactctgtagtcttagcaagcatcaaacacccagtgatccatcagctcttttcaccaatgcactataattgaagcgatgcatgaacacccaaaatacctgtgtttcccagaaccctagagtacatatgtcagggtaagtacttgggcttaagaagggaa

SEQ ID NO: 4902 - DNA, 1400 bp, mus musculus
aaacataaagaaaaattaagttgcatgatcttcagaaaaatggaagaaccctgaataaattatcctgaatgatgtttcccagaaacagaaaagtaacaaaaatcacttctgatgaatgctgtttccttccttgtgtatggtgccacatttacccattatttgtgttaaaattagactaaaaatgaaggaagcaagtttaatgcaaaatgttaaggtatgtagtatttaatctgggacagtagaacaaacgtaaaatgaatttggagagggtgcatctcactgcagaaaggtacaatcgggaaaagatgtagttaaacaattggaagaatcatgaccagttaaatgtagggtgtatgaaattgattcaagttctgaaggactcccaggagatctgccccacccaggtcaacagaacttaaagtctaaaagttctgttaggggatctgctgtgcccagtgcaacatgtaaaggaacttcataagtaactggagcagcttggaacccctgaggtggccagcaggattatgatccatcccctcccttggaattccacctccttcctgcctgtgccttctgccaggacaaatcatcagtttttctgaaccttagaagaaaccacactctgaaggtcttccaggagttatgttgcatcagagcaacagataagggacccttccttataaccacaacagttggaacacttgaggagcccagcagactcatgacccatcccctctgctgggactctacctcccttacagcttgaggcttcctctgtggaagatatacaatgtgtctgaccctctgaagataccacagtctgaaaacttcctaggagtaatgctgcacacagagcaatagaccacacagtgtaaatggctcctgagagacaacctacagccagggcaatagatcattggcatacatggagctctgaagacccggcagcctgaaagtctcccaagatatctgcagtgtccagtgctacaggtctctcaggatacctgaaacaacctagggacagagtagacagcctctagacagacacacaaaggccagttaacaccggagataaacagatggccaaagacaagtgaaagcgaataatcaacagaagctaataccctttgacacaatcagaacccagttagaattgtgaaaaactttgataaaatactaagctctgatgttgttttgtttgcttgctggctggcttctctctctctttccttctctcttacttcctttatttctttgttcttgtatattttgtttgtttgtttgtttgttttgtattatgcaagacaggatttccatatgtaggcataactatgctactctgtggtctataggatcatcaaaatcacaaagatacatctgcacttaccccaagggatggt

SEQ ID NO: 4903 - DNA, 1000 bp, mus musculus
aacttgagacacattccataggcaatcaccagtccctgacactattaatgatattctctgatcatgtttgccttctgagtggttccacatatcagctgactcaaatagacgccaacttccacaaccactaatcaaagagcataaactatctgaacctaaatctccctgcaaatgtgcagcatggtcttcatataagcatgaacaattgtagcatgggttatccaaaaaatattgtttgcctgtagcatatgttcctatatctggactaccttttctggcctcagtgggagaggatgccaatagcatcccagagaattgatgtccaaaggttggggaatgccgaaggagaccaccctgtaataggagaatgacagtggggctgggggaagggttgtgggagagggtgacctggaggaaagcagtgagtggaatgtaaactaaataaaaataaaaataattaaaaataacaatggtgtggatattgctggtgaaagagtaaatcagtatagccacttcagaaatcaatgtagcaatttctcagaaaatttggaatttgcctacttcaagacctagctatataccactccttgtcatatacacagaggatgcacctaacataccaaaggacacttgctcatttatgttcatagcagctttattaataaaaaagaaactcaaaacaacctagatgtcggtcaactaaagaatggataaaatatctggttcatttacccaataaagtattactcagttattaaaaacaataatatcataaaattggcaaagaaatagatggaacaataaaagataattctgtattgtaacccaacctagaaagtaagacatggtatgtgctcagttatatgtgaataatattagtaaatttaggatggacatgcaccaatatatagaaacaaagaagctaagaacaggtaggtcacaagtaggggacataaatatctcacttagatggggaaacagagtagaaatgatgggtgaa

SEQ ID NO: 4904 - DNA, 1000 bp, mus musculus
catctattcattgactatatattacacagtgatggcttttaatcttctacttggttaaccaatgtcaactgctaaatccactccagtagtgacaaacacaacaggccccgaaaacctgggtgctgtcccaaggcaaaatgttcatggaaacttagtctcctggaattgtggcatcctgtataaagaatgctccaatgtccttgctttagttggtaaaaggatctgtgtgctttcccttaatattgctttattataagtgctcctaaggattgatatgttgacatatagctgttagattctaggcagtccttgatctcaccttgggcctggatagctaagtcactgccctacacagaaatttaccattatctaggaagaagcaagtttgtgacctaaagaggaaccagagtagatacttagaactgtagatagctgagttacacctataaacaaacaagtatttacaatggcctagcgggaaggtggactatacaatagactagagtaggaactatggcaagggcacgaagcccttgcccctggcttctaagactaagtggaccttaggtggagctgctttgatcccagttgttaacattgagttttatccgatttggttcctgccagttcttccagtttgcagtcctctgttttgtgtaagaatccagtaaactctttgtactttgccatcctgtctgtctgtcaattcccaccgactcctttcccacctgcaccagagactcgttccaggcagacaagggaccaagagggtctgcagcagtcaacgtcttgtgcatagggctcccaagggtagagtttcctcaatcaggcctcagggaaagcacagcaacagtgagccagggcacagtctattgaatgtttcaacatcttttatagacaagcagaataaatatttcccacattttctaattttcaacagcttctgtttctcaaataataatttatctagattcaaggtgacccatacatccttgaagac

SEQ ID NO: 4905 - DNA, 1000 bp, mus musculus
tactaccttaataaggaaaaattttaggtcactatcataatgttcaggcatgttggtgtatgcagggcttgctgtgttgggaaaactgggttctgattgtgtcaaagtgtataggcttttgacggttattgggtttcactagcctttggcaatctgggtatcatggagttaagaggcctgggcttatctgactagaggctacctcctctgcccctgggttgtttcaggtatcctaggagacctgtggcactggatgcaggaaatatctagggagaccttcaggctgcagggtatcgaaaggtggatatatgccaatgatctactgctctggttgcagcaggtctctcaggaggcattcacactgtgtggtctattgcactgtgtgcagaattacacatgggaagttttcagattgtggtatcttcagaggtgcagacacattgtatatttgccccagaggaagccacaggctgtaaaggaggtggaattccagcagaggggatgagtccttagtctgttggccccacaggagttccaactactgtggttatttggcatggtcctttacctgttgccctgggtacagcatatctgctggaaggcctttagactgtggggttttctggggggcagaaacattgattacctgccctggcagaatgtacaggcaggaagtggctagagtttgaatggcgtgaatggattccaattcttctggccacctaaggtgattctagctgctgcacttatttggaatgctcctttacctgtggccttgggcagagcagatcaaacaggcttttagatttttgcgtctcttgaactgggtgcagcagattttctgggaggccttcaaactatagggtctactaaggggcagatcccatatcattttcatacattgtacatttaactgaccatgtttcttccatttcttcaactctattttttcctgattctacttttctgaagtgagatataccctctccaaattcacttt

SEQ ID NO: 4906 - DNA, 1000 bp, mus musculus
ttcattaattttttcattttaacctctgattgaagcactcctcctcccagtcctgctcatagagctccttaatccatcttccctccccttctcctgtgattaagggaaggtggccctggataccaacccaccctagcacatcaagtcactaggccagacaaggtagcccagttagggaaacaggatccacaggcaggcaacagaatcagggacagccctgattccagttgtgggggaccctcagaaagaccaagctgcatttatgtttttaacagctgagtaatagtaccttttataaatctaccgtgttttatctgttcattcattgttgagcatctacactgtttgaaatttctgaatattatgaattgagcagtaatgaatgtaggtaaaaatgtatttgtagttgtagaatctaggagcagcacaacacgaggaactgtagtaaagatttgtagcattaggaagtttgggaactactgacttaaggaaagaaagagtgtgataataattttaaagtgatgctaatacctttgttcatggtacatccacagattgctgagaacagttttcttgctctaagtggagacactaaatatcatagtttataaaatttatttacactccattcctcttgtgtttatgtggttaaataaatatgacataggcttgacagagagtataataagcaggacaatatttaggacactagaaagatcccagtctattgacttaatattcatttatttcaagaatttgtcaaaagtgtttttaaaggagagattagaacagtttttggtgtctaatactagtctcttgaattggacatgctagtaaagatttctgtgtcaattccttatattaaaaacatagtcttagcttatttcatgtatgaaatcaaatctcaaaagaaatcattgaatgtgccttgaaactgtatttctacttccttggagctttgtagcatctggtcagcatcttttaagttacatcttatatt

SEQ ID NO: 4907 - DNA, 1200 bp, mus musculus
ttttgtaaaagaaaaaaacattttacatcttattgggaagatattgaaaatttgctttcagaaaaaaaaatgttttaatttaagatcaccataagaagtgatgatactatgttccaactctgcaacatttatctacagcatacagcaattgtggagagccatgccacgagcaatcgccattataagaaggcgctggcctccactgtgcctaactagtaaacaagccttgtatgcaggtgcgagagtgaactcactgccctagtcactgcccatcccggggcttagtaatgggctgatgggcgagcaaagaatcaggtgctgtcaggacacatcaggtgctgaaacatcacactgcgggctatataagcagcaccattttccggggtcggggtcttccttatgttgaagcaataaaagctttgccgtagaaggatccagttgtccgagtgaattcttgctggtgagatactagctcgggcaagaagcaatgtaactaattaactgtattcagcaatgtgatgtttgtgaagtattataaggcactttctctagtgtactttatttaagagtttaaataactattgggtcactgttaatatacatgagccagaaaagaaatgtttgaaaatccccacattgcatattttgcctattgcttccataatttatttaaatattaagtaacttaaatccattttgttattttattttccctgattatacagtattggctttaatattggaacacttgatttttaaggatattactattttatttttaaagaactgtgccattaaaatataactctcatatcctataattagtgtatgtccatgatatagttagatttttttattaaaaattttactctgtctctgtctctctgtctctctgtctctctgtctctcctctgtctctctctctctccctctctctctctccctctctctctctgtgtgtgtgtgtgtgtgtgcgtgcgtgctgggtgtgaacggggatagaggccagcagagagtattacactccatagagttgcagtctcaggtggtatgagtcatatatcttgatagatgtggactctataagagcagcaaattctctttatccttgagatatacctctgtcccccagatagctggaatctttccatattttaaaaaaatataggttttcgagattatctagtaatggtgatagtg

SEQ ID NO: 4908 - DNA, 1000 bp, mus musculus
tgtcatagtattttatcacaacagcagagaagttaagaaagataggtaggaaaactgtaaaatggaggataataacatatattttcaaactacttttttcatatttcctaaaatattgactacagtatatagttttctagttttttaaaatttagcatgtttttgaacatgggagatagactgcaaataaaataggaaggagagaacgcacttatttctacattaagctgggaggttttgtaaatcaatgcatcagatgctacagaaaattgagataaccgatgtatatcagccttcctggcagaagattatttctttttcttcattttttacctcataaaatctatttttattagatattttcttcatttacatttcaaatggtatccctaaagccccctataccctacccccatcctgctccccaacccacccactcccacttcctggccctggcattctcctgtcctggggcatatgatcttcacaataccaagggtctctcctcccatttaaattatttcttcttcttcttttttaaattttatttattatatgtaactacactgtagctgtcttcagacactccagaagagggagtcagatctccttaccgatggttgtgagccaccatgtcgttgctgggatttgaactctgaactttggacctttggaagagcagtcgggtgctcttacccactgagccatctcaccagcccaaaattatttcttcttatctcagcattccttagtgtaattctctgggtaggattgaagtctcccggacctcctgttgtctactttgtcatgtctcttgttcttattcagctcatacttaggaagtcactactttataggtgtagtttctgacatttttaggagacaataaattcccctatcctcttgctcttccaaactttctgctctctcttctacagtgtccactgagccttaagggtgagagttgtttggaagatgtattcattggaactgggctcca

SEQ ID NO: 4909 - DNA, 1000 bp, mus musculus
atttttttattaattctttgtgaatttcgaatcatgcaccccaatcccactcattcccctaatccctctatatttgccctctgctttggcaatctctcagtccaagaaaaaaataaaaacaacaaaacaagaggaaaaaaaattaaaaatttcttgctctgagagctgcagtgtgtcacacagtacatccttttgttcaaacagctttacttgcaaaaatgttcattgcaatgagtcattggtctggctccagatccctggcttctgctacaccatcaattctggatcttcacaggtacttgaatatcttattgttgccctgtattgtggaggtccttctgctttggttctgcaggaccagctccttcgtgaactccagcagttcatagatgaggttgatgttggagtgggccaacaaataaccctgcatatgaccctggatggttcttgagttttttagcctgacagttgcaggggagggtcaaggtgggggcaactctcctgttttatccaaagggtgggccagctctcccttattcaacagtgcctgttagcaatagaagcactctcccaaatgttgcagtcaaagaacagggacagctcacctgctctctcaccctagatccagctatcctatactgctgagataaagggtgggaagctggaaggttttaatttgtcctgtttcaagagagtcacagaataagaacttgggagtaggggaaacgcctttgcttctgaaagctaagagccagtaagagattggtaatctcagattaaaatgacaaaatctgccacagccatcaagctttgagtggacatctttaactacagatgataaaccacattcctggtcaattgttgaactatagtctcatgagaccatgagcagagagctttgctaaattgtgcccaggcatcaaacccaggaaaacagttatgacagtttgcgatatagaaattcaaaaacaatgtgacttgatctagaactggcaggtta

SEQ ID NO: 4910 - DNA, 1400 bp, mus musculus
tctatttacattttgcagttagtacacaaatatggaagggacctcccactgctgacttaataactttctgggcatttttgatacttttggaaaatcacaagtatgagcaaaatggcacttaatgctataaaataccacattgattgcttttcctcaacagatttaacattaatcctttctaaatcttttgttgatcttacaacttacagaaagtagacttactcttcatcacttctgtccagaactcataagaaaagaacaacttaccgattgactaaactttacattttttttctattttgctccactatatgtgtgcatgtggcactgggcatgtgttttatgttgtggcatatgtatagacaattggaattcagaaatggatgtggggtgccttttcttgactcctcttgacatgatggctctgactcaaactgaaaatgaagattgtgaattcagctaagcagtgctgacaggagcctgatatagctgtctcctgagatgccctgccagagcctgacaaatacagaggtggatgcttgcagccaaccattggactaagcacagggtccccagtggagaagttagagaaaggactaaaggagctgaaggggtttgcaacccataggaagaacaacaatatcaaccaaccagacacctacccagatctcccagggactaaaccaccaaccaaggagtacacatggaggagcctgtggattaaaaatggagtccagtgtctgccggggggggggggttgctagggctgctggatgaggcaggactcaactgtgcacaccccaaggccaccattgggctgtgggatgccgaaggaccctgttcagggcatggggaaggcacagacctgaagaagtcgggttcagactctggggcaacacagacgccactgggtgccgtggcagagccagttctggagcccttgggctgcacagaggccagggacgtcgggttctcagtcttggacacctcagatacttgatggatgtccctgaaagcaggctgactctgtccctggccaaaaggaaaagggcaggagaagggctctggctggttactgcaggttcaagagtccttggattgctcagtccatggcttgggttagcagaagccatggctggagaccagggaggcctccgcacaggaagctccttaggggcagacctgctccattgctccagcatggcagatcccaaagagaagaggctccatggtttttaggcgtttattgtagaaaggcagagggggttagggggagagtagcaaaatagaggctgatcagggccatggagaggggagaaggtagggggagcaagagagtgagagcaaaagagtaagagagtaagagagagagaggaggagccggccatggtggcacacac

SEQ ID NO: 4911 - DNA, 1000 bp, mus musculus
tacatagaagaacacacacacacacacacacacacacacacacacacacactaaaaagaattataaatacatgggcataaggtggcaggaccttgagaggaagggggacatcacagagttcaggttcaagaaagggtgagaggtggcattagggtgtgggtgttgacaggtgggcatttcctgccacagcggatgtggtgttgtattatttggagtcaggatggaaaccttgtatacgttatcattctgggcaggcaggtatcaagaatagactgtggtttaaaactcagaggtcattgtctacagcaaataaagggatatttagtaaattagccttttgtttatgatttgattcaaagttatttggagttgaacatgcatgcctccactccagcttcttgtgggctacttgctggaggaagtagttcagagttcaagggatgtgactcattattttttcccatggttcacttcaaaccagtcatggggaattttcaacaacacttgctataaacatattcctattccataaagtcatttagaaagtcccacgggaataattttctttaaaacccaacacagagaccactgcttctttcttatagtgaacctgtatcatagattattttcttttctgtgccttttctgtcattgaactctgagatgaacctgagatccaatcccagtgactattccattcaaaatctgaaaaggtgtgatgatgtatgcttggcatcctactgcttagggtgtggaggcaggaggattgctattatttcatgactgaccgagagtgcaacatgaatacaagggtagcctgggttacccaggcagaccttgtctcaaaacaaaataaatgatcggtaggaaaatagtagagaagcagtatggggacgggacattaaggcaagagcaccaagagtttgcacttggcttccaaagttctcattctcccaatcttgcttctctttgtgtctcgattcctcttgtttaaattgaa

SEQ ID NO: 4912 - DNA, 1000 bp, mus musculus
ctgctggaaccggaattactaggaactctggtcaagtggatgaaatctataatgtttcccacctaacacgccattttgcaggaagtcttttgtttagtgcgctcccccgccctccattctacacaccccctcttccacccagagagtcccctcacagtgtctctttcaggcaatccccacctgattttggtttttcccacttaatccctctttgcgtgccatcacactgggctgcccactgagaacgcccctacagcgcttgaagtactgaggagcaaccagtgacctgactgggagaggctacttcacctctcagttgagagcagacaaaggcccctctgcatttgtccttcctcttaacatctgtcccctgtctcaagagtacccctttaaaacaagctccatccaaggaaacgccattcccattactccctttctcagcttatacacctgcagtggcccacacaggtcccagccccgtggagccaccgagcacaggacacaccacgcaagctctgttcgcagccttgtacatgactgccccagagctgcaggttcgcgggctacctaatcttccgagtcatcatagctaccttttacccccatcatcccacagcacgcgaccaagtttactcagcttcctctgcttgtcccatgagaggaacacataggttagtgattcatagaaacaccctgcaaagctcccaagagtccatgaaaaaacctgcttaatgtttgatgagtgaatgaaggaacgaacaatcgggtgcccctgtgccaccctagtgaaggctctctctgtcctgactggatctctacttagccatcgatcactgaatcatcccctaagctgcatgtaccccaaagtgcgctctcgagtgctgtgcacagaatgagttcttagtatctgatgggggaagaggggctcgtgaggcggttctggggtaaaggcacctgtctccaagcctgataacttgaattcaatccctaggattcaaat

SEQ ID NO: 4913 - DNA, 1000 bp, mus musculus
gcctgggggttgggaaggctcccggggtcttcgagggcatctgcagagattactgagttctctggctgatgaatgttaggaagacatttaggaagggagtaagaaattggaagcagggcctgtttggaggaagtaggcactgtatcttttccttgccccatgctgtaaggcctttcctctccttcatgtctgccttactccaggcccagagatatggagtcaagagaccatagcccaagccccctcaactgctcaccacaaccaaccttcccttcttgttcctctcaagtagtcagtctctcatagcatcatgttaaagaaaaagaggatttgtgaagagatgcttctggggaaagctgggcatctcaccccagttccctgcaaggaggaaaggctgagctcagacaaggaagaaacccagtggcttgaatgacaagaacccattcagctaacaagtctgggctagcactctaggtcacatgtcaagggcagggcagtagattagtcatgctggtcctaacttgatgctcctggatatggaatggagctgactggattttcctggtgctgtctctcatcataggctgggcttctatataccatggtagcctaggctcatgcagcaagcagccacatacaggactttgcaggactgagattgttgaaggcatgcccatctgtctgaagcttcttgctggtcaaagctagtcactataccagccctgattcagggaccagtcctcctttatcccagcgggaacagcactgaaaacatactggataggagtgtggctattggagggatgaggatccaagctgattctctaagaatctacggaaagctgaaatggtgcagttcctggcctcagtggatttcataacctgataatttaataatgttgtgttgaaagactagggctattagaataacacacacacacaagctttagagtatgaaaaaaactccaaactcataggccagtctcttcctttgtgaccc

SEQ ID NO: 4914 - DNA, 1600 bp, mus musculus
ctcattgggaaagtcaagaaatccaagttaaatacataaacactgtgcagcatatgtaataaccgattgatactacctataataggctatactaacctctgaaaacacaagctctcaaaatcatcttactgccaaaaggagttcccaggtgcccgtgcttgagtagcggtacatacatgtgtaatgtcaaaggaattagcagtacatacatgtgtaatgtcaaaggaattagcggtacatacatgtgtaatgtcaaaggaattagcggtacatacatgtgtaatgtcaaaggaattagcggtacatacatgtgtaatgtcaaaggaattagcggtacatacatgtgtaatgtcaaaggaatgcccacttgtataattcagttagtgttctatcaataggtgtgaataatagtgtaccctcagtagactatcatgactgataatatatactttattcagcaatagagaaagcaatttttttcttcaaaggaccacacaaatatattcaagaacatttcaaaatagaatttcatacctaacagtgtatcaagatttttatctctagagtacaaaagtcacttctaatctatgttacataaatcactgtagaacatttttcatgacaagattagaagatattactggaacattttaattaaatattaacatattcaatagttcaaaataggaagtttgcatgtatgtgcaaattgacagttctgttacagaatctctctatagaagtcacagcatctcaatttgagatatacaacgcagctactatcccagtgttgagactgtaaagcacacagtgtaaggatggggatgaggccctgctgcacacatcgcatgcctttgttcacacgactgtctattcataagtcactcaagcaaagccctgctgctttccaaatgcccacataataagactttaaacaaaaaaagaatccaaatctaagttgcaattcaattccataaactttcctaaaagcattccggtggtaaaacagacttgccactataatcaaataactccaccatttattctaaaacaatatgcagacctgcctttagagagacataaaataatgtggagttaggtttaacaagttccatttttgtttacacatgaaacactgtatcattaatcagcacacaactcacaatgaccacatacacaatgccctgacacttgatcacattctggtaacctagaagggtaaatgtaatgctgtacagcaaagcatagctaaaatcttaccactgtcataaattacccacaaactaaaaataaaagacgtctatggcactgggatgaatatactctctgccttagagctaatactttaatttttaagaaccacaaagaaaaagatcaaaactagtcagtaacaatgcagcgtctaaaagcaataaactcaaaattaagttataaataatttaaagcatgtcatgaagatatattaataattcatcagataaataatttactaaataatcaaataaataaataatgaaatacataaataaatcagcaaataaataattctgtaaaataacctaaacaataagccacccaaacaaatcacaacctataaaat

SEQ ID NO: 4915 - DNA, 1000 bp, mus musculus
ccaggcacaaacactgtaaaaaatccaggtactgcttaaggacagaacctgacttctggcagaaagagaccagactcttgctcattcccctcttctgtcttgggaaagttgggttctctggcctccaaggatacaaacatggaaccccagccaatcaatcgggagcagaaaaggttctctccagggaattgggtgtcttccggtccctatggacaagtgaaatccacgtcttaaccctgggaatcctacatgcctcagagaaagttctcccagaaagggtgcagaggtcaaagttgtcaaccggacattttaagagatgagcctgtggttgacatcttgttaagtaaaacctggccctggtggaggccagggtcaaaacctctaccctgagctctaagctgctgtcctcttggtcttctgggatcatcccagaagggacctgtttagcgccttttgctgggccaagcacacgcacgtgtcaccatctggacctgccgcttgccccctcagtcccttgcattcgagctgcccaaccccagttcggccaccctgggagctctgcaatggaggaacactgtagaaggccgccgctctcgggtgtgtactgtcgcagggaaatgaggagttgccccctgggctgcacctgtggggccacagtcccagctaagacaccatgtacctccctcggcttcccgcccaagcccaaacccgaatcaccctccaggaccgacccgcgatcgccggcgtgggctgcacgagcgctgttcttcggctctcaaactctgggctccaacttgagcgcccagcgcccgagtggctctcgggatagagaagttgccacaaacttcccaggcccctctccacctccgctcgccaccagcaaagtagggctggccgggaaagaacagggggagatgagatgggagaggatgctaagtgaactccagatctggcgcgcgacctttccaactccaccccgcacctcgcctccttccccgca

SEQ ID NO: 4916 - DNA, 1000 bp, mus musculus; identical to SEQ ID NO: 4915

SEQ ID NO: 4917 - DNA, 1400 bp, mus musculus
acacacacacacacacagagagagagagagagagagagagagagagagagagagagagagagagagagagaagccttctatgtccctttttagctgtgagtctagctcatcaacaccatggatagctttcttgcccttcatcattagtagggacatgggtcatggacttacaatttctgcaagagcatagaccatggacatccacatgaactcctgcatcagcacagacctcagaaaggttcccaatgataatacagactgtggacataaacatagccctctgtgcccacacaaatcatggaccatcctcagcagcacaggccaatgacatctgtatggtcttcatcattaactctggccaggaacatcaacactactcctggatactgtaggaccatggacatcctcatgaactcagggcttcaacacagcccaagacagcaaaccatggataccaaaatggtctccagggacagcacaggccgtaaatgcctttagagttagtccattccagaaaatgtcctattcttcatcttggacatcctgttgtttctcagagacagggcaatcctgtgctgggcagaatattgggggtgcagtttccatctgtacccagagctgaccttgtgccacagctctccatacccaggtcctgccagggcttgtctcccaggagtgttgacacacctgtgagcacagataggaccaccacttctgctctgagggacccacccagagtccctagaacacaggaactgaggagcagccaggaacaggatccttccagtttccatctatacccagagctgaccctgtgccatagctccccatatccaaattcctcccagagagaactggtctctcaggagtgctgacacatgggcttacaggagggacaagctacactcagagacagcaagaacagctaacaccagagataaccaaatgtcgactgacaagggcaagagcataagcaacagaaaccaaggctacttggcatcatcagaacccagttcttccaccacaccaagccctggataccccaggacacaagaaaggctagactctgatttaaaatcacatctcatgatgatgatagaggactttaagaatgaaataaataatacccttaaagaaatacaggagaacacaagtaaacaggtagaacccttacagaggaaatgtaaaaattcgataaagaattacaagaaaacaaaaccaaacaggtgaagtaattgaacaaaaccattcagaatctaaaaatggaaatagaaacaataaagaaatcacaaagggagacaactctggagataggaaacctaggaaatagatcaggagtcatagatgcaagcatcaccaacagaatacaagagatagaagagagaatctcaagtgcagaa

SEQ ID NO: 4918 - DNA, 1000 bp, mus musculus
tgtgatagctaaagaaataatatggagtaaagtatacctttagggccattgaccttcactcaagaatgacagggagagcctagtggcctgcagctgagataagaatagaaaaataacttcccatttccatctgtgcccgagttgatcctgtgccacagctctcaataactgaatcctgctgggaaagagctggtctccagaaagtgctgacacacctgagaggacaggtgagaccatcacttctgctctaattcatggccgaaaggggacctgcccagagccctcagacacagtaccctgggtcaggatacttccggtttccatctgtacccactgagctgacgttgtgccaagctctccatacacaaatccggccaggagagagctagtctctcaggagtgctgacatacctgagagcataggtaagacttctgctccaatgaacacacctagagtgctcaggtcacagaaacaaaggagccggctgagacaggatgcttcaggattctatcagggcctgaagctgaccatgtgccacagttctccatactcaaatcctgcctggaaaaagctggtctcccaggagggctaacacacctgagagcacagatgagaccatcacctctattcaaattcctggcccaagggggccagaaccatcaggacacaggaaccaaggaaaagcaagggacaggaactttccagtttctgtctgcaccctgaagctgaacatgtgccacagctctctgcccaaatagcaccagcagagggctagtggcccagcagtgctgacatacaagcctacagtagggaaaagccataatcagagaaagcaagaccagctaacaccagagataatcagatggcaagaagcaagggtaagaacacaagcaacagaaaccaagactgcttggcatcatcataatccagttctcccaccacagcaagctatggataccccaacacaccagaaaagcaagactgatttaaaatcacatc

SEQ ID NO: 4919 - DNA, 1200 bp, mus musculus
agtcagaagaggggatctgcagatgtcctggatatggagacatagtcagttgtgagccacctgactgactaggtgctgggaactgaactcaggtcctctggaactacccttaaacactgagctgcatttccagccctatcttaacattcttcactgaaaacatccaaatacactgggcacccagtgtatctgcacccaggagctgatgaagttccaaagccatctgtgcataggacctgccaggagagaggtgttctcccaggagtgctctcactcctaggctcagaggtaagatagccactttcactccaataactgtccggagtagggccggctaggagaatgcaggacacagaaagaatggagaagctgggacaggatccttcctgtcaccatctgcatgtagaacctggactgttccacagccctgtgtacataagttccctcaggtgggagatggcctcccaggagtgctgacatagacttacagacccacgggagggaccagctccagccagagacagcaagaccatgtaacaccaaagataaccagatgatgaaaggcaagcccaagaactttaccaacagaaaccaaggctacatggcatcatcagaacccagttctcccaccacagcaagtcctgaatatcctaacacactggaaaagcaagatttgtatataaaatcacaactcatggtgctgataaaggattttaaggacataaataactctcttaaagaaatacaggagaacataggtaaacagataaaagcatttaaagaggaaacacagaaatctcttaaagaattccaaatgctgacaccattgcatacactagcaagacttagctgaaaggaccctgatatagctgtctcttctgagactatgacagggcctagcaaatacagaagtggatgctcacggtcagctattggatggatcatagggcccccaatggaggagctagagaaagtacccaaggagctgggggaatctgcaaccctataggtagaacaacaatatgaactaaccagtacccccagagctgtgtctctagctgtatatgtatcagaagatagcctagtcagccatcagtggaaagagaggcccattggtcctgcaaactttatgtgcctcagtacatgagaacgccagggccaagaagtgggagtgggggactccgcggtgggcggtctgcg

SEQ ID NO: 4920 - DNA, 1400 bp, mus musculus
acactttgctgtggattagtgttgcttctttggttggtctgtaagcttaaggcccaaactaggagagacaaggtggttattgcccaggcgcttgcagctctagaacatggtgcttcccctgatttatggttatctatgcttaagcaataggtcgctggccactcagctcttgcacaccacgaggctagtctcattgcacgggacagagtgagtgtgcttcagcagcccgagagagttgcacggctaagcactgcagtagaagggctctgcggcatatatgagcctattctagggagacatgtcatctttcaagaaggttgagtgttcaagtgtccttcctccaggaaaaacaacacgggaccagaccaggacccctctaggtgatgagcctgggaggaggttatgtgtacggctcctttacctgcacactggggatttgacctctatctccactctcattaatatgggtggcctattgctcttattaatagaaaagggggaactgtgggaagccgcccccacattcgccgttacaagatggcgctgacagctgtgttctaagtggtaaacaaataatctgcgcatgtgccaaaggtagttctccaccccatgtgctctgccttccccgtgactacaactcggccatgggctgcagccaatcagggagtgatacgtcctaggcgaaggataactctccttaagagggacggggtttcgctttcgctttgggcttggggcttgctctcttgctcctaaagatgtaaacaatagagctcttgctctgcgctctgcgctctggcgctctggcgctctggcgctctggctcctaaagatataagcaatggggggcttgcactcttactcctgaagatgtaagcaataaagttttgccgcagaagattctggtttgctgcgtctttcctggccggtcgcgagaacgcgtgtaagaatgggtaattcaggtagcatagtaacttggtgtcctattgtcaaacgttcagtttccactaaggcccaatagcaggccaagagctgtttttcaaagggagaatagttgtctgcagatgatggtagagctttgctccaaaatcccaaaggtcttttctgtgattcacctacaggggcctgccagaggctccaaacagcatctctatcagccacagacacctcaagtaccatcgggtctgctgggtcatatggtccaagtggtagagcagcctgcacagcagcctggacctgttgaagggccttctcctgttccaggccccacacaaagctagcagctttccgagtcacttggtaaataggcctaagtaacacacccaagtgagggatgtgttgtctccagaatccaaatagacccactaaacgttgtgcttctttcttggttgtaggagggg

SEQ ID NO: 4921 - DNA, 1000 bp, mus musculus
acacttacatttgtagttcatggagccaatgtaaagctttagccatggtgcgcccatcattaaagtgaggtgttgggattccatacaagttaaacctatggaagcttgccgggttatattttcgattctttgcttctcctgtgggtggtaggagcatggaagaagacttctgagttaagccacacagagagagagagagaaaagtttattttagggaaagcacactgttttctcattggcacagaactcgtggggcaaaggctggaacatacccatgcaggcagctgttcatacgcagctacagatggcaaaagcccttccctgcacatgctgggacaccacagaatgttacatacagagctccttgtgttcatgtttgtaagatgtggtggtttatgtctgtaatctcagtatatgggaagctgagaggaggatggggagttccaggcctgcctgagccacatagtgagacgaagtttcaggaaaaaactctaagcaaaacaaaacaaccattgacatcacccaaaactgataagattaataaatgaattcaagaaagctgaatgatacaaaaaaaatcaatattaaaaaaataactggagaggagaccatctgtgactaccagagctgacagaatgactgtccacatgaggcaaggagatctggttcacaatgcctcagtagtcagtgctggttcaaactttgacagtctgacactgggcagtttattgtaggcacatttaaatatagtacaagttagaaaaagtatcttagtatgcttcagaaatttatattccaaaaggctagaaaacttagaagaaatggagaagtagcattatttgcagataatatgattttatgaataaaagaccctaaaatctccaccaggaaacttctacaaatgataaacacttttggcaatgtagtaagatacaaagttaacacacacacaaaaagaaaaatcagtgaccttcctatttacccaaaacagactgagaaa

SEQ ID NO: 4922 - DNA, 1000 bp, mus musculus
gtgttttgtctgcacatatggatgtacaagaagtcatcaggcttttataagtaaccccacatggatgaaaggtttggattcttgaattctctttcctcccctagtactggggattgagtctagagtctctcatatactaggcaagtgctctaccactgagctgcatctccccttgtaaaatgtcttatcttgagggaaccttactactaaactacccaggatggccttgaatttcctctgcagctctgttgagcttgaattgacaaccctcttgctctgtctgcttcctgagaagctgacgactcaggcatgtgcaaccaagcccaacctggtgcttcagctcccttttttgttgttgtcaaataaatcttgtgtgtgtgtgtttgtgctctgtgtatgcatatgcacacttatgtaagaaagccagagggttttatcactttcagcctttattctcttgagacagcctatcactgaccctggagtaggctggtgactcgaaagatctaactgtcctttatttccactccacctcaacatctgactttgacatgggtgctgagaatttgaattcaggtcccatgtttacacaacaaagggtcttacttgctaaatcatcccccagttcctggatccttgaattctgtttggggtgtgtgtgtgtgtgtgtgtgtgtgtgtgtgtgtgtgcttgtttgagacagtgtctctctttgtagccctgagacatgctgtatagaccaggctggcttcggagttagaaatctacccactcctctgccttttaaatgctgggattaaacagagacatatgccatcacgcccagctttgaatcctgaaatttggtgcttgacagtgatacagcctcttattctgcactgtcagcaggatgacagctgctagtaaaggttggctttgttctcttccatccagaatttccaccagtttgctctctgccctgagcagccatccaaggaagaggatctaggctatgtatggc

SEQ ID NO: 4923 - DNA, 1000 bp, mus musculus; identical to SEQ ID NO: 4922

SEQ ID NO: 4924 - DNA, 1000 bp, mus musculus
agagggggaaacaaaatagtcatcagtggagggagggaaggaactgggtaggagaagaagtgaggaggtgaatggggatggagatcttgtgtaaggagggaggcagaaaaggactatggaaatgggtgggaggcatctcagggactagctgtagtcctagaatagcagagtctataaagatatccctagctgagattcttaccagcaagtaatatggagactgaggtggccacctcctctagccaggcaaggcttcgggtgggacatcaacccattcacaaaccttcaacccaacatttgtcttgcctacaagatattcaggaataagatggaacaaagataagaaaagggccaaccaatgactggcccaacttgagacccatgctatgggagagagtcaacccttgacattattaatgatactctgctatgtttacagatggaaacacagcataactgtctcctgagatgcttcattcagcagctgatggaaacagatgcagaaacctacagccaaacatcaagtggaaaatgaaggataaaattgaataagccagaggggtcaaggacagcacaggaaggttttagagtcaattaatcttggcctgtgaggacttgcagagattggactacaaactgggaagcatgtaaggacttgttctagctccccccactgccaccctgcacatttgtagctgatgtgatggttggtctttatgtaagtaccctaaaatattgtagcaggggatgtctgactctgttcccctagatagactacatggatgggcctcagagggagacggacgatgtttattcatgctgcgactagatgttcccaggcaagatgacacccaatgcttccccttctctgaggagaaggagattggtaatggcaggagggatttgtaagggtgggatggggagaaaaggacctgaggtggggctgtgatctgtgtggtctgaatataaataaatgaatgaaaaacaaaacaacaacaaa

SEQ ID NO: 4925 - DNA, 1000 bp, mus musculus
tctggctattataaataaggctgctatgaacatagtggagcatgtgtccttcttacctgttggggcatcttgatgttcataagggaaattggtctgaagttttctttctttgttgggtctttgtgtggtttatgtaccagcataactgtagagaccatatccagaggctagccatggcccctggttgagggatggggccacccacccatctccaaaattttaatccagaatagatcctgtctaaaggcaatacagggacaaagagtggagcagagactgaaggaaaggacatccggaggctggctcacatggagatccataccatatgcagtcaccaaatccagacactattgctgatgccaagaagtgcttgctgacagaagcctgatatagctgtcttctgagaggatctctcagagtctgaacaatatagatgtggatgcttgtagtcaacatcagactgagcacggagaccctaatggaggagttaggggaacaactgcaggagctgaaagggattacaactccatagaaagaacaacaatatcaacctaccagacccccacccagaactcccagggactaaaccaccaaccaaatagtacatatgtagggacccatgactccagctgcatatgtagcagaggttgcccttatcatacagcagtgggacccttggtcctatgaagactcaattctccagtgcaggggaatgctaggatggcaagagggtaatgcatgggtagatgagggagcaccctcatagaagcagggggaggatgatgggaaaagggctatcagagggggaacctggcaaggggaacctggcaaggggattttattttattttatttccaacatttgaaatgtaaggaaataaaatatccagtaagaaagaaagatggcatattttggttaacttttctaaaaaaacaaacaacaacaacaaaaataaaaaaacaaaaataaaaatcaaacaaacaaacaaaaaaaacaagat

SEQ ID NO: 4926 - DNA, 1000 bp, mus musculus
ttaatctatatcctcaagaagaaaagaggaaagtaacttacacaaaaatgaatagatggccaacaaaagacttggaattttcttatttattttcactttctgtcacttctgctctcagaaaaatcaacataaatgtgttctatattagtaatgctatttatcatttttatgctacttatcatatatttattatctaatcagttcatgttatttctgtcatcaatgcctgttgcagctggctttttgttaacaaatgggaggagatgtagcctccccacccccagcctggaacctgctggctcaggggtggagtttcctgctcattcgttctgccatgcccactgctggactgtgccgctttgctgcttggagccacacacgtgttcaccctgctactggacccggagaccagttggcgggaatcgggttccctcccccttcctttataactgaatgtcggaactagtaaaattgagctttgaacaggatgaacttgtcttggctccgtttcttctttctccccgtctagttcctcccttagctcgagtggccatctcagtcgaaccattcacgttgcgagctactggccggccgcaacaaatgcccatgaataatcagcatttttgtatttctgtcttctacttaaactgtgtcttagttagggttttacaactgtgaacagataccatgaacaatgcaaatgttataaaggacagccctttttttaggctggcttacgggttcagaggttcagtctattatcatcaaggtgggaacatgtcagcatccatgcaggcatggtacagacagagctgagagttctacatattcatttgaaggctgctgacagaatactcgcttccaggcagctagaatgagggtcttaatgcccacacccacagtgacacatctactccaacagggccataccttctaatagtgccactccctggcccaagcatatacaaatcataacgaactatatgtttattttttatta

SEQ ID NO: 4927 - DNA, 1000 bp, mus musculus
cacagtacacagaacgaagactcaagactcagaaggttgtggggtgaagtctccgggatgcttgcctctgcccttagttcaggctgggggcgccatggccgtgggcgcaggtagggtgcaggcgctgtgtagcgggttttccaatctctgtgtagccagcagttctgtcggtgtgagcagggccgcagcgcccgagccgcagttgtgattgctttatttccctggtgattaaaccttgtgccattctattcctgttaaatccgtagaaaatgagaaaatactcgacattttgggggaaacttgtaaatctgagccagtaaaagaagaaggttcggagctggagcagccctttgcccaggccacgagtagcgtggggccagacaggaagctggcggaggaagaggacctatttgagagctgcggccacccggaagaggaagaggaagaggaggaagaagatcaggaagaggagcaggaggaggagggagatttagctttggccagcagcagcaagtctgagtctccaagcactcggtgtcagtggagcgaggcagatgccccgttagcagtagtgaaaagggagccggcagatgcgcctggcggaggcactgggatggaccgcgagcctgtagggctagaggagccagttgaacagagtagcacggctgcccagctcccggaggccaccagccaggagctggtgcgagcgcccacggcagccctgagccctgagccccaagatagcaaagaagacgtgaagaagtttgcttttgacgcttgtaatgacgtccctgcgcctcctaaagagtcctcagccagtgagggcgctgatcagaaaatgaggtttgttgattctcagtcctagaccagacgctatctcctttcattgtcactaggatacatatgagctgttagagcctgcagtcggcagccactctgcccagctagctccttcaggcagcttcttatttattttgcactggttctgtaacctttcccc

SEQ ID NO: 4928 - DNA, 1000 bp, mus musculus
agcctcgagtctctacaatgtcagataacctccctcgcaggaggtgatctccaaaacccgagagccccggacttactgactactgaccaggaagggacttgagttttgatgggggaggaatgttgcttctatgtcaataaatctgggctggtagaacaagatgtgcagacctcaagtagcttcagggtaacctccaggaatgttatgctaccagcactgataccccgtggtactctaacccattggtagcttggctttttcccctctgtggccctaaatgagccatcagagccttgtttcctttggcaccttgcccaattcagtttctaaagcagcagataagtagcattgcaaagatcactattaatcaggtcttggttcaatatcaaactgttcccaaattaggagacagttattgtgatgacacctctcttttataaaaagaaaaggggtagttgtgcggcagaggaccgtgagaggaagtctgctaaggtcaatctaacgtttgaagctccaggtaccctgaaaagatggtaggaacttctcttgctcccagccggaggtccctgtcatgtagccacagccccctatagagagaattgtgaccatcagtcatgtagaggcagtgctcccaagcctctcctcgtgcagatgaggcttctcaggtcaagccaatgggaagcatctgctgtcagactcaacccactcccaaactgtaaataaatccagaaggaataaaggagtatgagcattactctgtcttctgagagcatctgtcacaagagctggaacagtgcccaggaagagaatgttctgaagctttcgccataagaagcccccgtgcaccctgctcacaaaccagatgactgctggctcagctctgttcagctcaactcagtggcagcagcagcaacagtggtagaggggacccctccctgctcatgccctttccccttagcttgaactctcctgtcaggctgatctcaaaagtctttgcagt

SEQ ID NO: 4929 - DNA, 1200 bp, mus musculus
cccgtctctacatagaagctatcttttctgtggtatcagtaagattaggaattcctttaagaaacagctatcttttcatctttacattttaagatgtgtctaacacttgtcgtatcctacacagtatgtcaggttgtaagggaaaaaagaggaagggggaggaaggggaggggaatttaataggtaccttgttaaggggtagtagacagggcccagggctcaatgcttaaaggtgcttgctgccaaggctgatgacctgaatttaatccttaggattcacgtgttggaagagaagaacctatttctaccagttgggcttttacctttacatatgcactgtgtcatgtatactctctaccccccaaaaaggaacatacttaacaagaaatataatataggcatttactggtagaagtgtgatttttaatctacatctttgtggttcttgcatgatcaatggtaaatattccaggaaggaaacttcattaattacttaccagtactaatcgttatgtaaatatttctttctcttggcttaaaaaattctttttgtattgacagcttcattgtcgttatttaaaaatagtatttttctctcatcatacacttctgtgctctacccagctccttggccaacagtttatgtatatagatccaggctgttctcagtcctggttaaagaggcttgctcttgtgatgggccacagttagtagagggaagcaaaattggtccaaatgccaagaaaaaggaactgagttctctgtcttaagtgaggcccagacattcagtccctctcccggggctcaaggagcactacagaggaggaggctggaagagtggaagagctggagagtgggaaggaatggtgtgaaatgctttcttctcaacatgacatgggtatcaaatacagggactagctttagtaacctgcacaggacctacacattgtcaagtcggtctccttgcccctcccccacacctgctgaggacatattgtcagcatatagttgctggatgagagaaaattattattgatgatgatgatgatgatatggccactagtagcccatggtctagcgatggcctcatactcatgaaaatacctgctgtactagctggccttataggctatgaaaataatacatgaaactgggagaaaggaatgttgtgtatggagttatgtgaagagatggaggtgg

SEQ ID NO: 4930 - DNA, 1200 bp, mus musculus
ctttctccccttctcctcccctcccctcccctcccctcccctcccctctcctcccctcccctccccttttctcttctcttttctcttcttttcttttgtcattttccatggcagggtttctctgtgtggtcctggctgttcttgtacttgctctgtaggttaatctggtctcaaatttagagatcaacccaccactgcctctcaagctctgggaataaaagtatcctccaccatgcccagtattttccaccacacccaacatttctgctcttttgttcagtgtttacttgtttttcatttggccttttcttttcttttttttttctccataaaaagacattttaccttgaaatgttatgattgacatattttttgatattttctttatatacatttcaaatgctatcctgaaagttccctatacactccctctgccctgctcccctacctacccactcccgcttcttggccctggcattcccctgtactggggcatataaagtttgcaataccaagtggcctctcttcctagtgatggccaactaggccatcttctgctacatatgcagctagagatacgagctctggagttactggttagttcatattgttgttccactaataggtttgcagaccccttcagctccttgggtgctttctctagcttctccaatgggggccctgtgttccatccagtagatgactgtgagcatccacttctgtatttgccaggcactggcatagcctcataggagaccgctataacagggtcccttcagcaaaatctttctggcctaagaagttccaactgagaacatatgctccactatgttcatagcagccttatttataatagccagaagctggagagaacccagatgtccctcaacagaagaatggatacagaaaatgtggtacatttacataatggagtactattcagctattaaaaccaatggatttatgaaattcttggacaaatggatgtatctggaggatatcatccttagtgaagtaacccaatcacaaaagaagtcattagatatgcacttactgataagtggatattagcccagaaacatagagcacccaagttacaatttgcaaaacacaagaaaatcaagaagagggaagaccaatgggtggatacctcattcatccttagaatagggaacaaaatacccatgaaaggagttacag

SEQ ID NO: 4931 - DNA, 1000 bp, mus musculus
tattattcaggcagctgagagatttcatgtgttcaggatgcctgttactcatgaatgaatgtcatagcacagttcctgtttctccagctcttacaatgttcccaccccgtcatctgtgataatcctttgaacatgaactacagtggttgtattttatatgcatcaattggagctgagactgccccccccccagtgacttttcctctgtattgtgatcaggtgtgaccttctgaaatgatacatcttccattaaaaaaaataaagttttttttttgctgagagctaagagctgagagctacccttacctgtgggtataagaatgacaagagacaactcatgctggccaggatatacattattcgtgagagtgcaaattcacatatttatatttctggtggaagtcaacatgattgtttctcagaaagatcagaatgtatctacctcaagatccaggtctatcaatctttggcatgtacccaagggatgcttcatttttaccacaaagtcacatgctcaggcaagtgtgttgttgctctaatcaaaatagccagaaagtagaaaatatctaaatatctaaatatcccccagaaaaagaataaatttaaaaatgtgataaatgaactgtcccctgacctccattgtcttccaaggtgctatctctaccttcctgaggaggcctgtggggcctcaggtagatagaggttagacccgttcccaccaatcccctgcctgctagatgaacttggggcacaaccaaaaaaagtgaccagcatgttgttctgtagatctattgtcagacccatggcattgactgcttccctgaggagtgttgctggcattaagaacaccaagccattaccacggatagccatatgaataaaggatagcataaaaatacaattaacaagagccagggcaatatcacagcactagagtccagatatcctgctagagcaaacccttgatattctaacacacctgaaacacaagaagatgacc

SEQ ID NO: 4932 - DNA, 1200 bp, mus musculus
gtcgatccaataatgatgaattaatatgcattgatgaattaattagaaaaaattttaaattaggcatttagaaatatatactcagagattaaaatcaactattgaaaaatatcactaaataaatatgtagacatctcagcagttcatagaactgactgacccccagaggaagtataaaatgcaaaataatggttatcaaatattcagtcaattagtaaattgttaaatataaaccattctctgttcatacatgtgtgtggtgggctagagaaaagcaagaatttgacaatacttagtcatactatcacaaatacaggaggattttcacattcaaaccaaggatgatgaaagccatttgggattattattgacagttttatggtcataaatttaagtatttgcataaactatgaaggagctagagaaagtacccaaggagctaaagggatctgcaatcctataggtggaacaacaatatgaactaaccagtaccccccggagctcgtgtctctagctgcatagctatcagaagatggcctagtcagccatcagtggaaagagaggcccattggtcttgcaaactttatctgcctcaatacaggggaacaccagggccaagaagtgggagtgggtgggtagggaagtggggttgggggaggacatgggggactttttgggatagcactggaaatgtaaatgaagaaaatacctaattaaaaaatgctcaaatcaaaaagaagaaatgaaatgcatataagacattctaaaaataacaattctagttgcaacgatccattcttaagttatgggaagcatttaagtttgaacaaatagcagtagtgaaatcattagggaaactggacaaaagggtgtccatataatccatttcatgcatgaaagtgattaaagcatcgaggaaaaagtttcctttgatgccccagaatatgggaatttgagggcagggaggcaggagtgggtgggtgggtaggggaacaccttcatataagcagggggaaaggggatgggatagggagcttccatggggtggggaactggaaaaggggataacatttgaaatgtaaataaggaaaatatcaaattaaaaaaaaagtttcctgtgaagatcctccacaaacacagaattaaaagtttcaaaagaatacaagttcctgaaaaaataaatcgaggaagacctcagaa

SEQ ID NO: 4933 - DNA, 1000 bp, mus musculus
ggagtgcccacaggaggattcttgaatctcattcagaagaggaaataaaatagacatcatagacatcggaagtggaaagagggagggaacaggtgggagaggggctaaggagaggaacagggatttggatgaggtgtgagggaggaagggacaggtgagaaacataacagaaagcctggatagggacatttctaggacgagtccaagaccacagactgggagggtcccaggagtgtatggggtgatgactctagctgaatctcctagaagctgggaatatggagattgaagtgatcacctcctgtatcaaggcaggacttccagttgtgaaagggggacatcaacatatacacaaaaccttcaacccataatttgttctggctacagaatgcaccatgataaatgtgaaaagagattgagggaattgtcagtcaaccaatcactagcccaaattgagacccactcgattggagagagcaaatccctggcactattaatgatattctgctatgcttgcagacaagagcttagctagcataactatctcctgataggctccatctagcaactgatggaaacagatgcagagacccacagacaaatttcaggttgagctcagggggtcttatggaagagtaggggagaggattgagggagccagaggggtgaaggacaccagaaaaagaactatagagttaactaactttgtcccatggggctcacagagactaaaccaccaaccaaagagtgtgcagaggctacacctaaaccctctacatgctgataccatacatgcagcttggtcttcatttgggttccttaacaattagagagggagctgtcgatgactctgttgcctgccattggatatctttcctcagcattgtgaagcctcggtgggagagaaagtgttaaatcctgctgcaacttgataggccatgatgggttggtacccatgggggacttctttttctcatagaaaagtaagagaaaaggagag

SEQ ID NO: 4934 - DNA, 1200 bp, mus musculus
gacacaaggagaatggttgggtcaggctttttctagggctgccagggtaaaacatatgaagttattatagccaaggtctacacgaagtcataaagaagcagagtttagaaaaatgaaaggcgcctgtgcaacttcttgtcctatttgttcactgggaagaggttggaggatgatcactgacctctgagcaactggggagagagcgcatcctcagagcccatccttcacttctgaatgagctccttgctgtaattgatggcatctcctcaaatggctgcaatcattagggctccggtgactgaattaaaagaaaatgaaggatgcagatggctgtaataaagcaggagaatgcatttcttcctgctgacagatacaactgatcattttacaaggaagtgctttactaaaagtgtttcggcgatgtagttctcagggaaaatgaagagtaatgtaaaaattggacaagatgaaactagctgtttcatttcagatattgactgcgccagtcacttttaataaatcagctgcttattgtacctaagacagcagggtgttaatatcagggaagcactgtaaagtgttcccttccctaaggttttctgtctatggcttaacatcattttattcaatttctcttttctgtatgctttctaattggtaatgtctgaactgcaaggcataataatttgaaaatatctttatttaaaacaaccaagatacaccaggctttttctaaggatcaaatactatgtgttgtacatctttgcaggacaaatacttcctctctaatcaatgtccaattttgtattgttaagaggaaacattatagatgacaaatggtcaagcttggtgaataaatgaatatataaatacaaggtgtagctggattaatcgtcattatgtaatttacatatttcaaatcttaaaacatatattcatatcacttgaggatattgtaaatacatataatcagaaatcttaatatgctacattatataaaatgataggattgaatatataatttatcagaaaatgaacatttatgcaacaatgttcttaaaaatctattaagccaatggcaacatatatttcatacatacagaggtcaaaacatcaaattaaagttatcacaatgtaaccttaatgaacattttattaaacatgttgaatagtactgcatctttaattttgtcttctaca

SEQ ID NO: 4935 - DNA, 1400 bp, mus musculus
ctctaaggaaatccacatatttacattgccaaagcttgggcattgtttacaaataatattgtctctctgttaatggtcattcccaaattttctctccattagctatatcattttatggagtatctaccactcatcaaatagggaaacactttgttctatttttataactttaattctttatttatttcatcaaagaaaaaatacaatctaattaaatgacttaaatagactctaaaggcccttaaggtctttctctgctctccaaagtctttctctaacactcattcctagatttgggttcattcatttatttattttcccttttaaaagaaatgcaataaaattgtttaaacaaagaattttacatcccggtctcccttttgtacccctgagccaagactgatccacagactgctgtgcactggtcctgccaggacagcgctgttctcccaggagtgcttttactcccaggcttgaaggttagctagccactttctctccaataactgtgtggacctgggggatggggcaggtgaggaacacacggggcacaagattcttggagcagcgggaacagattgcttctgtccaccatctgtagctgcaagctgaggctgtgcatggttcccaccaggagagacccgttctcccaggagtgtttcactctgagaatcagaggtgagatagctactttctctccaataagtgtttgaaattaggaggcaaggagaacacagggctcaagaacagtggaatagctggtacagggtgcttccagtcgccatctgcacttaaagcttggggtgttgcagagccctctctacacaaattctgccagggcagagctggtcttacagacccacaggaggaacaagttccagccagaaagagcaataacatctaacaccagagataatgagatgggaaaggcaaatgcaacaatcttaccaacagaaacccaaactacttggctccatcaggaacttctcccaccacagcaaatcctggattaccgaacacaccagaaaagcaagatgtggatttaaaatcaatcctcatgatgctgatagaggattaaaagaagaacataaataactccattaaagaggtacacgagagcataggtaaacaggtagaagcacttaaaggggaaacaaaaaaaaaatcccttaaagagttataggaaaacacaaacaaatagctgaaggaattgaacaaaaccatctatgatctaaaaacagtagaaacaataaagaaatcacaaagaaagacaactctgaagatagaaaacctaggaaagagatcataagccatagatgcaaaaagtcaccaatagaataaaaggcacagaagagagaatctcaggcacaaaagatactatgcaaaacattgacacaaca

SEQ ID NO: 4936 - DNA, 1000 bp, mus musculus
ctgggattgagaagtcctgcaccattctaaatgcattctccactttaatactctgtttctagtattttgatacatttatgtaggcaatgcagaggatgattttttcttccttttatactccactttctgagaacagatctcattgttttgttttgtgttgtgctgttttatgttgtggtgttgtgttgctttgctttggtttgttttgccttgtgagacagggtttctctgtgtagttttgcctatcctggaacttacaatgagactgggctggtctcaaactgagaaattcacctgattcggcctcccatgtgctggggttaaaggcatgtgccaccaccacctggaacttccaaaacctagttaaaagagaagtaggaagaaagggtgattaattagttgttgttgaaaatacttgtaaattaatttgtttcccattatttaaaaatcacaaatatatatttttatatttttacataaatatataaagtgaacgtttaatctatgataattgtaactctccaatgtatgaaaatatgagattagagtctaacttgtgtaattaggatatgggcaaaactacagtaagaaaatgaatacaaagcaggtttatctcagaaaaactggaagtgtgttaatctcaacactgtgttttgaacaggcagctattagtttacgacccacatgcataagaagcctggaatttaatcttttgtgttatccatgcaattgtaataaccttccaaataaagtacatttgtattttctccactattatatttacctattgatagcctgctgggtgtctaaatcaagaatcttctctctgaagcaaatcgaaattgctacctgtgaatttttaattttccagttccaatgcttagaagaaccaataagcatgcaatcaattttaatttaaattgaaatccacagctgtatttactgtagatggcctttcagggaaatgaatttcatataatttcttcacttatctgatcat

SEQ ID NO: 4937 - DNA, 1200 bp, mus musculus
cacgcaaatgaaacttgaattttcctatgtcaataaggagaattactgaggccagagcagttaagaccctcagagagaagtaggttctgataggttatctcaagaagtcatgaaagaggagcctctattgaaatggagagcccaagacttagaaataacagggaagtatttcccaaggagtgctgcacacagagaaaggaatgaccacagagacagagacatatgttgcagaaatttagcctgtgaggaaggaatgttatatgacctttggcattagacgtgatgctataatgtttggagatatctcttgcttgtttttcagtcttgctttcgtccatatccctcccttttggaatggttgcatattctgttctcttgtatgttggaaatatgtaggttgctttttgagcattacagaggtttagagttaagcgatttccttgagttttagaaaagaatgacatcttgagtcccaggtccctcagagactagtctacacaggtgagagtgcagactatagaagcaacacagtttctgggacaggcagaagcaacacagcttctgggacagaccctgttttggcctccagacatccaggcactttccccaccaaaggagaggtgtctgcctgggagggctctgccagagcaggtgagggagccattttgagtcctaggtccctcagagacaagtctgtgcaagtcatctcgctgactgtgaagaggcaacacatcttctgtgacaggccctgttccgggccggccttcatcttcagccaggaggcaggtcttaatgccagacctctgtgcaccttctctgcaagaggagagcttgcctgcacagagtactctgaccactgagactcaggagagatctagactcccaggtctgcagacagaggctaacagaatcataggaggaataagttccaaccagagacaattataacaactaactccagagattaccagatggcgaaaggcaaatgtaagaatcttacattcataaaccaagaccactcaccatcatcagaacccagcatgcccacctcagccagtcctggataccctaacacacctgaaaagcaagactcagatttaaaatcatatctcatgatgctggtagaggacatcaaaaaaaggcattaaaaactcacttaaagaaatacaggagaacactgctaaagaggtagaaatcctt

SEQ ID NO: 4938 - DNA, 1000 bp, mus musculus
cagtacaatcagagctcacatatgccccaaggtccctccttgcattcaaaattccaaatgtcttcaagtggacccatagaaatcagttttcaaatgcatcagaagcctgcaaggaatttgtctttccaaatgttccagagtcctctagtgatcccaagaagtccaatgaaatcaagtctttcagtccctgaaagggacctatgtccgcaagagtcccaaggtccatcaggaaaatcaagtatacaaatgcagctaggtcttgtaatggacccaggtttaccaattctgagaagcctcttaatgcattcaagtcatcagataccttcaagatcctcagtgagatctggtttccagggttctctaggacctatggtgtggtcacctagttatggtgaccaacgaatcagccttgtgactccaaggaagcaacggaaaatacgcactgtatacgccgaggaacaaaagtgtgtgctgcaaaaacattttgataagtgcacatacccaaaccgggagcaacgcatggcactggcagttttggttggtgtcacagcaaatgagatccagatctggttcaagaaccaccgggctaagtccaagtgggagagtctccagaatgttccagcagcactgccagagacaaatgaaagctctgaagctgtttcttagtcagtccattttcctgattcctcacctgttgttgcttctgccaatggagagtccatgtggtcaggcccatttggtgaggattccagtcgcaacctcaactggagccaggaatcttctctgccttataatcaggcctgtgatagtgccaggtgttgtccacaagaatacctgcttaatggccatgcccgtgttacagcttggaactctggtcaatcagtagcagttgaagtccagattggcctagcagtagctgaagctccagtcgtcatggtagcttccacacaaggtccagagtatgctgaagattcaggtccatctacagaggagctctggc

SEQ ID NO: 4939 - DNA, 1000 bp, mus musculus
gacagagtgagttaggctgaagcttggtgggaatgttgatctcagaacaaaattcaacctagctagctattgtttgtgcttacaaaggcaagctgatctctgaattcatttgccttgttaaaaaaaaaaaaatgcttgctctcttttctaagaatctaggggctaaggtcataaaatactaattcatgggataatctgaaggaaacccctggtggacaactcatttgatatgcaaataaaagactaggctttgttctgaaataggtcagctctctagagatctctggagagctatttcaagcagaacacagatctgtcaacttgtacccaatttgaattgttcttttgaggctcccaaatactcatgcctcaggacccccctctccaatctggtccttggtgtagggggcctaggttcagcccatgcatgttctttggttgatgtttagtctctgtgcaccaccataggcccaggttagatgactctgtaggccttcttattgcatccttggcccctcagactccctcagtccttgcttctactcttccaaaagactctgcacactccacctactgttttgctctggatctctgcatctgtttctaacagatgctggatgaaactcagaagacagttattctaggctcctgtctgcaagcatagcagagtgtcattaatcctgtcaggagttgacactcttgaatgggataagtcaagttgggtcagtcattgaaagaagtcccccgcccagttccaggtccccgaattgtcccagagatgcccctcaccctcacacctatttccactctctcccccagccctctctccccacacacttttctcacaactgttcccctccagatcccctctcccacccagtttctttcctctatccagctctgatgtctattgagtgagattcaagaatccttccttgggctctccttgtttcttagcttcttttggtctgttgattatagcctgtttatcatgcacttt

SEQ ID NO: 4940 - DNA, 1000 bp, mus musculus
gctattataaataagtctgctataaacatagtggaacatgtgtctttgttatattttggagcatctattgggtatatgtccagtagtggtacagttgggtcatctggtagaatgaattccaattttctcaggaacagccagatatttttctaagatagttttacaagcttggaatcccaccagctgtctaaaggaaattcaaggtcaaaaaaatggagcaaactgacagaaaggttatccagagaccacctcatccagggtctatcccatctggagacacgaacctcctccctcccctgacactatttctgatgccaagaagcacttgctgacaggagcctagtatggctttctcctgagaggctctgccatcaccttactaacagatgtagatactcacagccaggacccaaatggaatagctagggggaggtctgaaggagctgaaggggattgcaactccataggaagaacagtatcaactaactggaacacccagatctcccagggactaaaccaccaaccaaagagtatacatggaggaatccatggctccagctacatatgtagaggaaaatgctcttatctggcatcaatataaggggaggcccttggtccagagaaggcttaatgccccagcatagcgggatgtttgaacggtgaggcaggagtgggtgaatgggtggaggaataccctcatagaggcaaagggaaggggattggctgtaggctttgcaaaggtgaaatcaggaaggggaccaatgtttgagatgtaaataaataaaataaccaataaaaaatataaatttgtgtttttccataaagtattctaatcacactctgcctttcctttaattccttccttacccccataaactcctaacaagccatctctccctctctctctctctcgcacacacacacacacacacacacacacacacacacacacacacacacctcacaaacacaaaaacataacattgcaaaccaaaatata

SEQ ID NO: 4941 - DNA, 1400 bp, mus musculus
aaatattttagaaaaattcaggaaaatactacaagtatctccattgacatttgctcaaataaggaaatgctgtaataataaattaatgaaaatacaatcaactttctcttctagtctatatattttatgacaatttgtgttctttcattcagcactttactacattatattgatataccatatacatacacacacacatatatatgtatatatataaacattttacatataacatactactttgatatttgagtttagttttaaaagtaatcatatttttcttaaaaagacttttaacgttctcttttcgataattgtttcaaaattatatgaactctaacttttaaacttggcttttggtccactagatgcattaacctgtctttctccataggaccattatttggtgtgaaggatttttgtttgtttgtttgtttgttttaagtttctttttttcttttttcttagatattttctttatttacatttcaaacattatcccctttcctggtttcccctctgaaaaccccttgtcccctcccactccccctgctcaccaacccacccactcctgtttccctgtcctggcattcccctatactgggacatcccatatatggttaccaaacccagacactgttgtggatgccaacaagtgcttgctgataggagcctgatatagctgtctcctgagaggctttatcagtgcctgacaaatacagaagtagatgttcgaagccaaccattgcactgagtatagagtccccagtggaggagctgaaggggttttcagcatcataggaggaacaacaatatcaaccaatcagaccctgccctgcgcagagctcccagggactaaaccaccaaccaaaaagtatatatggaaagactcatggctgcacccgcacatgtagcagaggatggccttattggacatcaatgggaagggaggcccttcgttggtgtgaagtcttgaacatggtaattattaataaatgttttaaaccatagctgcaaattgctttaattaattgttttaataaaactatcttgaatatttatagatcacttatttacatcactgcaattgcaataccaaagttttatttaattttcaattggcaagtttgaaattaattgcttcctcaaataaacaatcatactaatatagaaaatactattacacaccaacacactaaatgttccattttattaatacatagaatttaagaatatcttaccattatttttaaatctgaaagataaaaaaatccttcactatctctaattgcagaacttgggatattactcagaatcatgaaataaattctattataaaatggcattgagtgtaaacacaaatttctatgctttcaggtctttgattttataagtgcttt

SEQ ID NO: 4942 - DNA, 1000 bp, mus musculus
gaattctttagtacatgcctttaattccagacaatgatatctaattgagaggcagacagaccaagtgataaatcagagaaagatttgacagaatgagttagagatagaatatgcccaacactaagaataaaaagtatttaagagcagtgcaaggagagggaaccaatttagacaattcagttgacagggcttgtgttgagtcagtcagttgggagtcagtatagcgagtgcagcacaatagggttgagtttgttcctgggttcatgcatttcagtgcaggtcagcagaggcagatgaagccatagaataggaagaagctagaagattcgaacaaattgacagagttagtttgtggccaagcagacctttcagtgaaggtgacaacccagaatcaatcagtcagcttgaagagaagtttgaaccagaatagctgagttgaactagtaagtcagagttcagagagagctaagagggagctttttcagcagtaagccttcaatatgacaattactgcaagtgaataaaagtctattttacagtaaagttatcattatacttaagttttagaagcaataaaagagaatacatagtattatgtaacataatctgtaggaatattcatattattcagacataagtacatgtaaagtcattgtttatcataatgattctgtaccaatagatatcatttgacaaataagttgtttacattttaaaagagaattataaaatcaaagctcaatgccaggcagtggtggtgaatgcctttaatcccaacacttgtgaggcaggggtggcagatttctgagttcgaggccagcctggtctatacaaggagttccaggacacagagaaaccctgtctcgggaaaacaaaaacaaacaaacaaacaaacaaacaaacaaaatcagagctcaattattttaatatcaactattaccaaacattactttataccatttagagtaacatttagctgatatttttattaagaaaagaa

SEQ ID NO: 4943 - DNA, 1200 bp, mus musculus
gcacagagtacctccacacaaccatgaattgcacaatatatacctagaagggggcaaatattaactgtactcataaggccaaatgattttgatagaaaatgattttaaaatctctaattattttatgctttttatgaaagacttttcaagtggaaaaatgacattttacaataaaaattagttttaagtattcctctaaagatttcttgctgtggctgcctctgtgaactggttccctgcacatgcactctgcacatcccagctcacagatcatacatgcactgcttaaatgcattatttttgtttgtttttttgagacaaggtttctctgtataactctggctgtcctggaactcactttgtagaccaggctggccttcaactcagaaatctgcctgaatctgcctcctgagtgctgggattaaagccgtgtgccaccatgcccggctttaaatgcatttttatattagtcccccaataacttgtaaggcaaatttgggagctattaattcatatttggaattggagatcatgaaaatttatgttattaacaaaaccaataaaaattaacaggaagaaaaactcatagagccttgttgagaaaatgacagcagacaagcccctcaatgttcaaagttttgtggcaatccataggaatccagggattgcgaaatgacaacaagccccaaggttttaatggattatgtgtgccacagaaacacctgaaagaatacttttcttttttatgtctgtccccactacaaagagcagagcatgagatagacctcaggaaactaaggtcccacttgccatacttcacaaacattgcattaagagtgctagggttccttcctagcactcttgacttactaagaggtacaataaatgtcttttcatacttcacatcactgtggcttcaagtatgtttatatacaataatgatgtatgccacactgtcttctaatattaattactttaaggaggctaatttcaacacatagtaatttctatttgtcaacaagatatttatctctttcatactgtactcttgccctgcaaaaaaaatagatttatatcatcttatgtctgtctatatgtggcttatacctaccaatataaatgtgatggcctatatacagcttaggcaggaaatagatggtggaacttcctggaagcagaaaggattctggaataatgcca

SEQ ID NO: 4944 - DNA, 1000 bp, mus musculus
gttggagtatctttgacttgcttttgtgggaggacttggtcctgatggtgccatgtaactttgatttctgttggtaaggttcttgcacttgcctttcaccatctggttatctccattgttagttggtcttgctgtctcttccttgagcttgtccctcctgtgggtaatataagcctgtgtcagcactcctgggagaccagctttctcctggcaataccagtgtacagagagctgtggaacagcctcacctcctgggtgcggatgatagcagaaaggaccctgcctcagctgctctgctgcctctctggcctcctggctggtcctgcctaaggccaacttaatttcttattattttatattatagctatagaggtaagatgagttgtgctactttgtgctcccaggtaatgtgcttccagctacctgcccaggaactcttttgatctgcaaatgaaagacacagacacacacacacaaagaggcagacagacagacacagagacagacacacagacagacagacagacagacagacacacacacaaatacacacacacacacacacacacacacacacactagtttatttttgaaacactttggctagttcagaggctgggcactcctaaaccttcccctgaaaccccaggcccaatctaggaagtggccagtggtcacctacccgaattctcataaagctgatttgctttctctcctgtatcacctatgtcctatccttcttcccccacccccgagtcacagattctgttctctctctttcccctgatattagctgctgacatatttattaatttatcaaaaaccaattggggattaagaccttcagtgtttggacattcggattcctgattaaatcaaagcattagaatcaattcctaacatatacttataagatcttttaataaaatttacaatggacatatcattctacactaaattttctataaagttagcatatatttagttttattattaaatg

SEQ ID NO: 4945 - DNA, 1200 bp, mus musculus
atatttataacttaagaaatgacagacttgaattcttaaattgctttctcagtaagaaatcaattatttttatgtttgctataagagggaacttttaaaatcttccattgttctttccatattttatttgcttttaatggatttttttttaaaaagcgacttattacaacagaaagaaaaatgttggcagcggcacatggaaagcaaaggaaagacttgcatctggtgaacaactgcttcgtggcactgcatgcttatccctataattttctattatttgaatattccctgatgtcttattttgtgtgatgaataagataatccctttccttgtctatgactgaacacataaacacgggctgcaataccacagtcacaaaacttggcagaaatgactggtccatcatcagtaccctaggagtgaataaagagggaaagcttgataggaagaaggctaagcttccaagtgaatttcttaacgtaaggcatgtgaaggccattttgttaatgcctgcagctagcaggccagagtgactgaaagatgacgcatgacacccaggggttactggtgtcaccagaactgcaagattcccacatttctgatctatgcctggaaaacttaagattgttacaacaattgtcttttgcgtttgagcaactttgaatcttgttttgcttcactctccaattattccattaaaactaaccagatgccccagaactcccaaggactaaaccaccaacgaaaaaatacacatggagggacccatggctccagctgcatgtgtaacagaggatgaccttatcttgcatcaatgggcaaggaggcccttggtcctgtgaaggcttgatgttccagcttaggggtatagaggaatgctagagcagtgaggtgggagtggttgggtgggtggaagagcacctcagaagcaggaagagggaggtgggatagggtgtttgcggaggagaaaccaagaagaaggataacacttgaaatataaataaataaaataaccaataaaaaataaaatctaaaagaaaataataaaatcatttcatggcaaatacctacacatagctttctttcttctgtgctaaagatgaagataaagtgtaaaaccagcgaggctttaaacggtgtcacaaggcacaaggagaaacttctcaattcagagaagagctgagcttaagaatcaagtc

SEQ ID NO: 4946 - DNA, 1000 bp, mus musculus
ttgctatgtagaatcatgacacacgtgaacttccaaaggcatgctacatttaataccattataaatttgcatgctttctaccacattgtctatattgagtctgaacaaggctgagaatgtgactagtccatttgagtcaaacagtgaaaaggatgatggcagtgctactcacataaaacatagataaatttatgtctcaagaaatttaaaaggtctgtgttgttagatgacagacacttcagaatggtgcgatggtgggggttaaaggtgcttaatgccttgaattcaattctccagacaaggtgttagaagtagagaactaactccttcaagctgtgttctgacctctgcttatattctgttttacaagagtaccagcagagacatatgcacacacacaaagagacagacgcatatgtgtgacctacacatacaatcatgcacacataaacagacaggcatactcgtgtgacacacatctacaaccatgcacaaacacagatgtgcacaaacacagatacagaggcacaacagtgacacacacacatacagatatgcacacacaaagagacacatgcacaactataacatacatatacagacatgtacacacaaaaaggcacaggtacatatgtgttgaacacacatggatatatgtgacataaaagaacttaaaacatgattacctgtaaccacagtcacttttacttatgccccagtttctgagtaatgactctgagatgtaatcattttgaataaatgcttgggccataagcttgggcttgctccctgactagctcataacttatatgacctgtttattctattctatgtgtgccacggggctgattcctgctcctcagttgcatctcctgagttctggtggcaaatttttgatcacgtggctagctccccgagtaccaatctctcaactggatgtctagttagatatccaataacaggtggtcatacctaaaacttatacattccaaaaacacca

SEQ ID NO: 4947 - DNA, 1200 bp, mus musculus
ccatcttctcccatgtccctacctgagccattctcaagtttataaccagcttttctttaattattattgtcataaacacacatgcaaataaacatataaaataactttctgagtccatttggtgtttttggaatgtataagttttaggtatgaccacctgttattggatatctaactagacatccagttgagagattggtactcggggagctagccacgtgatcaaaaatttgccaccagaactcaggagatgcaactgaggagcaggaatcagccccgtggcacacatagaatagaataaacaggtcatataagttatgagctagtcagggagcaagcccaagcttatggcccaagcatttattcaaaatgattacatctcagagtcattactcagaaactggggcataagtaaaagtgactgtggttacaggtaatcatgttttaagttcttttatgtcacatatatccatgtgtgttcaacacatatgtacctgtgcctttttgtgtgtacatgtctgtatatgtatgttatagttgtgcatgtgtctctttgtgtgtgcatatctgtatgtgtgtgtgtcactgttgtgcctctgtatctgtgtttgtgcacatctgtgtttgtgcatggttgtagatgtgtgtcacacgagtatgcctgtctgtttatgtgtgcatgattgtatgtgtaggtcacacatatgcgtctgtctctttgtgtgtgtgcatatgtctctgctggtactcttgtaaaacagaatataagcagaggtcagaacacagcttgaaggagttagttctctacttctaacaccttgtctggagaattgaattcaaggcattaagcacctttaacccccaccatcgcaccattctgaagtgtctgtcatctaacaacacagaccttttaaatttcttgagacataaatttatctatgttttatgtgagtagcactgccatcatccttttcactgtttgactcaaatggactagtcacattctcagccttgttcagactcaatatagacaatgtggtagaaagcatgcaaatttataatggtattaaatgtagcatgcctttggaagttcacgtgtgtcatgattctacatagcaactattgagacacacacacaaatgccttcatgttattttgtctgtcttttgatatttgatattaattttctttctcaacttt

SEQ ID NO: 4948 - DNA, 1200 bp, mus musculus
ttttacactttatcttcatctttagcacagaagaaagaaagctatgtgtaggtatttgccatgaaatgattttattattttcttttagattttattttttattggttattttatttatttatatttcaagtgttatccttcttcttggtttctcctccgcaaacaccctatcccacctccctcttcctgcttctgaggtgctcttccacccacccaaccactcccacctcactgctctagcattcctctatacccctaagctggaacatcaagccttcacaggaccaagggcctccttgcccattgatgcaagataaggtcatcctctgttacacatgcagctggagccatgggtccctccatgtgtattttttcgttggtggtttagtccttgggagttctggggcatctggttagttttaatggaataattggagagtgaagcaaaacaagattcaaagttgctcaaacgcaaaagacaattgttgtaacaatcttaagttttccaggcatagatcagaaatgtgggaatcttgcagttctggtgacaccagtaacccctgggtgtcatgcgtcatctttcagtcactctggcctgctagctgcaggcattaacaaaatggccttcacatgccttacgttaagaaattcacttggaagcttagccttcttcctatcaagctttccctctttattcactcctagggtactgatgatggaccagtcatttctgccaagttttgtgactgtggtattgcagcccgtgtttatgtgttcagtcatagacaaggaaagggattatcttattcatcacacaaaataagacatcagggaatattcaaataatagaaaattatagggataagcatgcagtgccacgaagcagttgttcaccagatgcaagtctttcctttgctttccatgtgccgctgccaacatttttctttctgttgtaataagtcgctttttaaaaaaaaatccattaaaagcaaataaaatatggaaagaacaatggaagattttaaaagttccctcttatagcaaacataaaaataattgatttcttactgagaaagcaatttaagaattcaagtctgtcatttcttaagttataaatattatgtgaccatttctctacaattcaattttgaaatgaaaaagcagttgatcaccgtctcacagggtttatctcaagttctg

SEQ ID NO: 4949 - DNA, 1800 bp, mus musculus
ttcagataagactattctagaaggagtaggatagtcctagacttttaagtgaaatatatcataaacaaaaagagaaatggaacgtgtcataaacaagaactttcataagccatgggttaaggcagaaagagacagcatgaacatatgtaaatggaccttgccagacttacaagaactgtagtgttgtgagagcattctaagaccaagtgaagaaaatagacaacttcagacatgtgactatgggattaataccagtccttgagttgactttttaaaagtatttaatttactgtaaattaaattatttttaaagtattgataaaagaaatacattagaatacaaagggtacaagtaatcacctagaaggaattgtagtagtcccaggtaataaaaataaataaatgtatcatgaaattgaatatcttatactcaactatgatatgattgcatatttattttaacatgcagagcgctgcctcaaaataaaggataccatctacagatttaatgtctggtgtgtctagattggaaactaagatcagaaatagccactggttaatgttttctattccctaatcaccagaggactatgttcaatacaaagtactaactccacaattggcaactgaggcagtgcaattagtcaccacaaagtcctatctgtcttccatggactccaaagtaagtgtgtgcctgatttttatggttattagatgtaacctccccctagcctgaagcagactgagccagaccttgaccttgctgccactaaggatattacctagggtggagccttcctccctagatcactctattgttcagccactgccactattccccttcaagatactgttacctgctgggaggccaaggagctatttcggagactacaccctatcctgcacatcctcacctgcagctggttccaggctccaaggatgaattggcaggaatgggcctccccccaccacctttataagtgcatttgccattaaacatttgagctttgatcaggaaccttgacttagctccatttttctctcgaccgcctaattcccctctctttcagctcccgtctgccacttgggtgtaccctgtccatgtgagccactggccggttgcaacaatctggcgccccgaacagggacctgaggaatggcagaaaaaagctggaggaacgctgcttggtatggagctccacgggaagaaaaagaaaagaatcgaatcgggttcacgttgagaataaaaggctttgcaattagatatcatcattccggtcttaagtcaaatatcatctcccctaacaggtcttactaaatcattactctaagaaattatcccacgtattattcattttgaatgtcttccccccaaaattctaagttccacatggtcaggaacatagtcaaagacttttttttttctgtacttagaaattaaatttttaacagctattcaatataagagtgaataatttcaaatggatattcaaagggaataaagttgataaaaagtttttacttctctaggtcccctagaagggaaaataaaaacagaggaaaaaaccctaatagtatctttcaatatgcttatggattcttcttgcaaagaagcctagaattatattcagagatgtcaaacttattacgtattaaacatcaatatgtatgttggcatgcagtatgggaattccttatttgtgcagttcatctcataagttccagtgtcattctttgcaattaataaatatttactactaacattgtctacttcaaatgctgagatgcatatttaaggtt

SEQ ID NO: 4950 - DNA, 1000 bp, mus musculus
agcactgtactggccagttttgtgtgtcaaattgacacgagttagtgtcgtcagagataaaggatcctcaattgagaaaatacctccataagatacagctgtaaggcattttctcaattagtgatcagtgaagaaaggctcatcccattgtgtttggtgccatccccaggctggtcatcctgtgttctataagagcaggctgaacaagccatgggaagcaacccagtaagtagcaccctccatggtctttgcatcagctcctgccttcaggttcctgccctgcttgagttcctgtcctgactttctccaccgatggacaatgatctagatatgtagctgaataaaccctttcctccccaatgtgctttttggtcgtggtattttgttgcagcaatagaaaccctaaataaggctcataccatcaaaaaaactacatgaaagtttcaacacacagctgcctggtaccctgaagtttcatccaccactcttcaccaggaagcaataaatctgctactcataagcaagacatatgtaaaagtattccaggcatctttatttataaaaccccaaagctatgtctaatatgtattaacaaatatattgtgttctagtcgaacaacatactactagccagcaacgatatttgcaactacatagtgcgtaggctacatgatcccaggtgtgagaagccttagaactgcaaactaaaccatggcatctttcatgataaattgtcgttgtcaaatacactgcatttaagttcaccagggaagcacagatctgaggaagagggtgttcccgataaagtaaaaagggaaaatacaccctggattcagatgataccatcttatagttctcaagtccacgactgagcaaaatggagggagcaatctaggcacaggcttttgcctttctacttgcttgcagtggctgcaatgtgaccagctgcttcctgttgctgtttaccacaattagaaccatgctcttggcattgccttcc

SEQ ID NO: 4951 - DNA, 1000 bp, mus musculus
gtcctatccagtgtaagccaaagatgacttcatagtcacggctgagacttgagacaaggcattgttttacaggttcctggtttggggctgcccaactgcaactttcagtcatgttcctttttcaatgtccaagtggcagtcctccaaaaggaagtttacctgccatcaggcatgccgccagcctttccaaagctctttccttcggccctacgtccagatgaagctgccctgtcatctattttagcctcttcgttggaggcacttggagaacagggaatttctcatagcaatcgcttgatccccaggggcccgtgctatctacaaggaggctgaatcacaggcttctgggttgagagaccttgaacaacactgtgaccttcccaacacccgcacggccactcacaagacaaattcgcaaatgctgtaggtgctattacactttaaatctctctctcaattccttccctcgggaacagttccctaaataacaccggctcagagtctaaatggaacaactttgttaagacactttttgctctccctggcttttactgaagtaaaatcgggaagaatgttctttgttatagtgattttcttacaatattttaaatgttacctatgctttgaggagttcatacacttgtacactaagttgtggtcataactcctccctcctcacccctcatccaaatcctaccaatcactgcctacttcacctctcaacttcataccctcttttcatttctcccctgtgtaacctactgagtccagttattgctgcctgtatgtgcatggaaataagatagtttactggaacatagaccacctacaagaggacacaatgactgccagaggacagagaattaggtttggaaggacattgctaaccataaatttccatcttgggttggagaggtggctcagcggttaaaagcactgactgctcttcctgaggtcctcagttcaattcccagcaaccacatggtggctcacaaccatc

SEQ ID NO: 4952 - DNA, 1200 bp, mus musculus
tattattaagtgttattaaagtaaactggaggcaaagcatgtaataaaattgtccctgtggcaacaactgaggtatgagtacagttccacagtgcttatgtcatgtttaactgtgaaagcacctatattaacatggaaaatgctctagtgaggtttttcaatcagcgacggatatgtttgatatggcattcagtttttaattgcatagcatatttcatagaaggtattgaaatcgtatactataattctgtgtattaattactaggtgtcaaagctacaataaacggaaggaaggaaggaaggaaggaaggaaggaaggaaggaaggaaggaaggaaggaaggggaagagagagaatattttactcattgaggctacaagaaaaagcttactgggcaatggtcctatcaaggacatattgatgaaaactagattttcaaattgccagtcacccttggcagcccaggtttcaagttctattccgatcagctccgacctgttctcatccatgatgagggagagagagcacctgccagtctgactttcatgttttcatatcagaacaatcagagatcggctagtgatgtgcaaatctggaggaaatcatggtgtctaaataacagagaagacacagaagaggaaactaccctggggtggtgatatcacatgtgatattcagtaacaggctcagcatggccagagaagagttgggcttcagaaaccctacctgtcctaagggctccaggtgctctgaagctgcatgcaggtatctgagttagttcttgactgtattcgttggctggacactttttcctaaatgtgattatcacgacaggtgtgagggttacaaaggaaagtaatcaacataaaagtagatgacttaagcacaatggcgttttctgattctagaaacatagctcaatggcacagtaacttgtcttcatgaggcttggagttcaacacctagtgccataaataaataaataaataaataaataaataaataaataaataaataaagtggtgaatgtctttttcttttcattacacaatgtgaaggaaaaataatcccatatgtaagagataaattctgacatcagcttataaaactatatgtacccaattggattaattgctagactcagtaaatactcactgggtacgtatagttgagcacgcagctagacagccaattttcaca

SEQ ID NO: 4953 - DNA, 1000 bp, mus musculus
aggctgaaagaagcactgctgcttagaggggagatagccaaagaagcaaatgcaagacggcagcatgcgcactgggcctcgtaactgatgaagtaaagtcttagagagcacactcagtaacacaacagccctttgtatctctacacgctgtctggagctgtggaacggggatgaggtggaggagaatcagcctgacagcctccctagctctgtctcttcagtctgttgtttaaaacacagctttctccatatgaccataaaattttctcatgtataatttagtattttacatggtttcatggtaagcagaaatgggtactatatgcttagtagcactgcagtaaacacattgggtttaatataagtgaatagtccgtctctcaaaatacttttaagatgataagctaaaataacactaggatttatctcacaactcagaattttatccacataaggcagtatttccttattatctctttcatgtgtgatataaccagaaccggtattttctctttattatgaactacatgaaaacatttgttaagtaataaaacatcagccaatcactgacttaacttcactatcagtcagtctcataaaaagccaaaaaattccctgaacttatgctgggtggcctatatcatttaataattcaattaggatataaaccaaacgttttacagatgcaaagaatattgagactatttaaggatccgagaacatgtcataaatcttaattactccagaagtgatggtgggaagcatcatcctttaactggacaatagactccatccccacaccctcagtgggcaagagtgctgctggagagtaactgcgtcgctgcccgccacgctgcccgagatgctgcctgggcagcagaaactgctcaggaggctgtctcgggctccatcagcctgagcagctacataatgtctgctcagactgcttttgaactatgtgtatgtcaaaaataagtaagaggtaaaatcgaatgaaacg

SEQ ID NO: 4954 - DNA, 1000 bp, mus musculus
agagaccagcatcactgaggcaacatcttctggtaagtgtttcctgagcgtcatcacacagaatctctggtgacagcacagcctcaatggtagttgaaggcccaggactgaaggggtcgtgcagagaagtcgaggcttggcaccatgaggagagcctctgagaggctattggtgaaggtgcagcccagttgcagaagaccctgtcattttggagatgccagtactaggggatggccaccaagaacggcagcagcagtggaatgaagccagctggagcctagaagaaagctgcgtgtgctatagagggaagagtgacccaagctctctggaggggtccagaaaatggtgagtgaatcccagacgttgaatggtgaggtacttataatgttggagtttggttttgcgttgttcaaaaccatgccctggttcttccctctcgaaatgagaaggcactttaatttaattttgatttttataggagccacagctgaattgcttggaatatttaaaagagatttggggattttttttaaaaaagagattggatattttcaaaagacttgagttttaatgtattggagtttgtaagaactatgggactttaaaaagttatttatatttataatgcgatatcactattcacgtgccatcttgagataaatgagaagggaaaggttctcattgaaaagtgaaggatttgggtgtcatgttgacaaggggtccactgtcttggctcattttatattgatgtgacacaagataagagtcatcagagaggagggagtctctgctgagaaaatctctccataagattgggctgtgggcaagcccgtggggctttggaaatgcgttgctccaggctcttccagctttcaaagtttccattgagaaatgagctcttaatctgaggagttttcctttgtatgtgacttgcattcttttcttacagctttcaatacactttcattgctttgcatgcataatgttttaaccacgatat

SEQ ID NO: 4955 - DNA, 1200 bp, mus musculus
tagagtcagaatgcacacagcagaatatgcttgtgtttggcttctctcatccagcatgttttgagttgtattcatgttatcttgtattgcagccagctgtggaatgtgctacctcgaggcaggtggccatagatgctggtaagaacatgaggtgagcaaaacatgaggagtaagctagtcagcagatctcctcctggtcctgccttcaggccctgccctgctttcctcatgatggatcataactgtatgctgggtggtagagtctatctcagcagaagccagggaaaacagttaggtttagtgctgttgctctagaaccctccaggcactttgtgaatctcttcccctcaagcttggcgcttggctctccagaactcccattctttattgcctacttggtttcattaaggcatgcccaccagggagaggcctctttctatcgtggccactggctagtctgtttgacttgtggtgagacaaaacagacaggtgtttctgccactcttctggtcttgccttgacatctcataaggtatctgatgtcatcatcttcttaggagtctccaacagaggcccttggagaggagctagcatgtttgtgaagaccccctccccccatcttgtgtttgaaacttccagttcaaattgttatgctttggtcatacataagaatttgttcgccttctggttggcgccagcgctggtccaccttgggcccgaactcagcggacagtcccacggtctctagaggactgtccacctcacaggtgccctagcacacccaggatcttagggtcactggcgagtggaacgcaacatctgttctaatagaactgggggtgcctggggccagctggagcacagacacaggaatcccgcccaaccagtggctcaggttccttctggtcggcgccagtctacttggttttgaactcagcagacagccccatggtccccagaggaggtaccacttccagctgctctaacacgcccaggatcaccaggatctcagggtctcagaggaagcttgaccaccaagaactctgacagatccaaaatctcagcatcacagggtcccagaatcacaggatcacaaagaaagctggactccgaggagttatgactcaactgggattacaggaaggacaggctccaatcagatatatcgaggccagggagcacttgagataatcagatggc

SEQ ID NO: 4956 - DNA, 1200 bp, mus musculus
gtttgtgtgtataacttcatggaaagggaaagaaataagaaaaaagaggaggagagggaggaaggggaaggagagagagcaagagggttggtacattagttcacacaaagataatcacaattcaaagatgtttagtgaatgcccttctttaaagcacctccatcttttttaaataacattttaaaaaatgtgtttggctatttgcctacacatgtctgtgcatatatgcagtgaccactgaggtgggaagagggcgttgggtcccctggaactggaattccccacagtactatgccaccatgtgggttctgggaacagaacatggatcctttggaagagcagccagtattcttaagcatggtgccatcttgcctggcccggacactcacatcttaaaatgaagcagcattcccccttaacttaaaggaatgagtcagatcctgcagagccaggctctgaggattatccagtgcctagcaggctacaggctaaaggatgggaagtcagacagttaagagtgatcagtgggctgcggggcaggggagagagcacgcttgcctagcaagtgaggcctgggttccaaccaaacactaaaacaaagaaagacagatccacactgctttgtcaacctccatgcctctagatactcatgcaaagccccatgcaggcaagcatggaagtatgggatctggctgtgggcaaagctgggctacctatggaagaggatgaggatggtcaggaattaggcagagacttctcctgtgcttattctcttagtggtaaatgtcagaggacgtttagaaattcaagttgtggaataccaggctcagtgtggagcccagctagatgggttggcttactccctgagcacaggcgggggtgacccaggctgagggtgcaggtgctttcttaatgccatgatggggcggttgatgggtacctccttgtggagagcaaacagcagaaggcaggggctctctgtgccctttagtacggttgttttacatctggggccatgtcaccaggcaacaatttgacacctaggcggatcttgtccaaaggcaggcatggcagtgttactgataatggctaggaagaagacacaaccttccttaactctttgtcttttgggaataattttcatagcaatgtaaatagtcacatatgcctgtatatgcttttggtctttgttcaaaatgt

SEQ ID NO: 4957 - DNA, 1200 bp, mus musculus
cctgctcactaccccctcccacaatccttcccccatttccctctccttctcctctgagcaggtgggagtcccctttgtctctccccacccaggtccttcaaatctctgtgagactaggcacttctcctactgagaccagaccattccacatgcaggcaacagctttgcggatagcccctttccagttgttcctaacccacacgaagaccaagctatacatctgttatatatgtgcagtgaggcctaggtagtctgtatatgttctttggttggtggatccgtctctgagagccccaagggtccaggttagttgattctgttggtcttgctatggagtccctatcctcttaggagctgcaatccttcctcctattctttcataagagttcccaagctctaaccactgtggaactatggatgttggcaactgagtcaattggtcagtggagcctctcagaggacagccatgtctgcaagcataacagagtatcattaatactgtcagggattggtacttgcccatgggatgggtctcaagttgggctggttattgattggccgttctctcagtctctgctccatcccccgttcctgcatttcatgtagttagaataagttttgggttgaaagtattgtgggtggcttagtgtccctatccctccaccacagttcctgcctggctgcaggaggcagcctcgctaggctccatatcaccagtgctgcgagtcacatctaaggacacccccactgattcttgggtgcctccccaatcccaagtttccatctcatcctggagatgcccattaccttccccccatcagttgcatatttacattcattctcatggccatctggccatcccacagcccctatccctctccatacctaaccccaaactgacctcagcttccctcctgatcccccttccacccaggtccctccctccatctgtctcctgtgaccattccacatgccattcccccttccaaatgagactcaaacatccttgcttgtgccctttttcctgtccaatttccttgggtctgtggagtgtagcatggccatcctgtatcttatggctaatgtccacgtataagtgaataaatactatgcatgtccttttgggactatgttacctcatttaggatgacattccaaaaatctatccatttgcctgcaatattcatgatgcctttgttt

SEQ ID NO: 4958 - DNA, 1800 bp, mus musculus
ctttgtgtgaccccttcatgccttcaaaaccagtaccacctgggtgacccttacatattaccaagtcccgctgcagcaggagtacaaccttggccatctctggaacacagcctctttgtgctttcagaaaacacttcccagaagatgtcacctcaatgatgctggtcttttcttaatcaccgctaatttcttagctccagctaaccagcatcaatagtcccagtaatgtaaagtttttgctttagtagttctggtatcttgttaatcacagctgattctttagccccagctaaccagaactacagaatcttcacaatcaaaacagcaatggccctgaaaagagtctttaattttccctccgaaatttcacaaaccagacctccatcttctgcagtgttctcaacattatctcccaagctcctacacaacatccgacagagctcttaacaacgaatggatcttcaagcccaaagttccaaagtccttccacagtcctccccaaaacagggtcaggttgtcacaagaataccccactatgctggtaccaatttctgtattagtcagggttctctagagtcacagaacttatggatagtctctagatagtaaaggaatttattgatgacttacaatcggcagcccaattcccaacaatggttcagtctcagctgtgaatggaagtccaaggatctagcagttactcagtctcacgcagcaagcaggcaaaggagcaagagcaagagctagactcccttcttccaatgtccttatattgtctccagcagaaggtgtagctcttagaccatagtgagacaggttagttttaccctactgatgatgtgttgttgccatggtaatcctgctcagtacgagaggaaccaaaggttcagacatttggtgtatgtgcttggctgaggagccaatggggcgaagctactatctgtgggattatgactgaacgcctctaagtcagaatcctgcccaggcggaacgatacggcagcgccgaaggagcctcggttggccccggatagccatccaaccgaggatgggaatatggaggcttgcgtgcagctggaaagaggaaacaggtcacattccaagcaggaagtttctagtaagtccttaaaggcaatgcaagccttctgaatggtcaaaacctaaacagagatagttatcacaaccaagctgtgatttggagcaagccgatgaaccatgtgaggtcagccaggagatccgaggcccaggcttctgtctcccatggtgtctgtcttagtcatggtttctattcctgcacaaaacatcatgactaagatgccaagagatgaagccaactgaagcactcatcaactgataagtgaattttaaaaaaaatgtagtttaggatgatagttcaggtgataaagtgctcaccccagaacccacataaaaaagttgtgtgtggtgagagcacatgtgatcttggagctggggcagagacgggcgcatctctgggacttctactgaccagtcagcctaagaagtaagctcagacaatggaagaaactgccttaagaatcaagatgatggcatttgaggaatggcatctgaggttcactgttaggagcgggtgtggcggcagtcccaaaggcgccagggactgtagctaagtcgtatgacttgcacctgacttcctcatataagccacaaacatcttgagagctgcgcaggtgcaccaggataccggtgaatccagtttgatggagatatgccccttctgccctgattagctgaagctgcgtgcctggtgaggcggcgtggc

SEQ ID NO: 4959 - DNA, 1400 bp, mus musculus
cactacccaattctttctatgaagccacagtgacatatgatacctaaaccacataaagacccaacaaagaaagagaacttcagaccaatttcccatatgaatatcgactcaaaatttttcagtaaaatttttgcaaactgaatccaagaacacatcaaaacaatcatccatcatgttcaagtaggcttcaccccaggggagcagggttggttcaatatactgaaatccatcaatgtaatccaatataaaacaaactcaaagaaaaaaactacatgataatctcattaggcgtcaaaaaacatttgacaaaataccaacacccattcatgttaaaagtattggagagatcaagaattcaaggtgcatacctaaatataataaaggaagaacagggacaaaaaaaatggaacatagactgaaggaagagccaactggggaatagcctcacctggggatacatcatgtctgcagacacctaacccaatactgttgccgtggtcaagaggtgcttgtggacaggaactaagaattgcagctcctgaggaggtccggccagcaactgaccaaagcagatgtggttgtttggagccaaccatcaggctgagctcagggaacttgttgggggagctgcagaaggacaagaggagcagaggggaattgcaaccccattggaagaacaacataggctggctgaaccacccagttctcccagagactagacctccaaccaagggttgtacctaaagggatctttggctccagatacatatgtagcagaggatgggccttgcccaagagcaacgggagtggaggcccttggttccggggaggttttatgtcccagaagggatatgctggagcagtggggcaggagagtatgggtgggtgggggagcactctcatacagacaagaggagaggggagggtagatgtgggatgggggttggtggaggaggtgaccgtgaagtaagatatcatttgagatgtaaacgaatggaatggttaataataataaaataaaaataaaaataaagttcatgaagaaataatggatcccctttcttaattgaatccagcaaaagaaattgaggaagacacctgatgctatgttagcctctggccttcacatgcacctgcacttttacatatatgtgaacactcacagaaacacacacaatacagagacttaaaataatattcacatttaaaatatttgtatttatattttctttaccagcaaccgagacagagagagagagagagagggagagagagagagggagagagagagagggagagagagagagagagagagagagagagagagagagagagagagaggagagagagatatgtttactccttctactgtttgtgaagcttcccacaaattgacctcc

SEQ ID NO: 4960 - DNA, 1000 bp, mus musculus
tagaaccacagtggtttatacacatctaggcatgtgtgtgaagtttctagagtagaaactgagtgtggagagccgtgcagctagcaatcgcaagccgcgagcaaccaccattataagatggcgctggcctccgctgtgcctaactagtaaacaagccttgtacgcaagtgcaagagtgaattcacacccagtcactgcccatctcggggcgtagcagtggggtaatgggcgagcaacaaatcaggagctgacacgccatatcaggtgctgaaacgccatggctgagggctatataagcgactccattttctggggtcggggtcttcctgagaagtaagcaaagttctgctgcagaagattctggttgtcctgagtgtgttcttgccggtggggacaaaagctcgggataggtggtgccaaaatccgggaactaccatcacaccggtgcaagggagataccccccttaacggggcggaaccagaactgcgggacatgtaaggctctgcaaggtacatacagtcttgaaatttctccagagttagacgcccttttcattgtttgcactgcgattgtactttccctttcggtttcattttgcttccacccctggaactgctgactggttcccagtcgcagtcaggcctggacagcgcctggacagcgaccagttttagtcgcggtcaggcctggacagcagcagtatgggaatctcccactctgtagaaacggcctgaaaatcgccactaagactatagagggatttgtcagggagatagaccatgtggcaccatggtataacctgcctcataagtcatcaacacttcttaggggtacatactgtctatgcttggcttatctaacttgtattagggactactttcagtatacatacaagtgttcatgcatcagaagccagtttcctttaacagtacgttcaattttggtgagctaataaacacttcaacttaaataatggcattgttaaggatcaaattccac

SEQ ID NO: 4961 - DNA, 1000 bp, mus musculus
ctcccccgaaatctggctatctatgctcaagaattatttaacattgatggctggcctcttttgtagagtttgccctaggtcatttagtagttactgtcacatagcactgcagtatccagggacgggcaactttcctcatgcacagatcaacctaagacacggggcctggtggggcctggtggcgatagggttaccctatgacaggaaaggctgtgacattggaggaatgacctaagacaagagccacagcagatgggcataattacacagacctagtccagcctcattttaataaaataaaaagggggagatgtggagagccgtgcctcgagcaatcgcgagccacgagcaatcaccattataagatggcgctggcctccgctgtgcctaactagtaaacaagccttgtaagcaagtgcaagagtgaattcacggccagtcactgcccatcttggggcgtagtagtggggtgatgggcgagcaacaaatcaggagctgacacgccatatcaggtgctgaaacgccatggctgagggctatataagtgactccattttctggggttggggtcttcctgagaagtaagcaataaaagttttgccacagaagattctggttgtcctgagtgtgttcttgctggcagggacaaaagctcgggataactgaggtggaaatattcatgttaattttatttggcattatttgatggtctgaagcatgggactgggtaagaaaaagaaagtgatctgaccagcaacagtcctctctctctctctctctctctctctctctctctctctctctctctctctgcttccctactgtgcatatgttgcgagcaaccgaataatgttcctgctgccatatgttccctggtatgatggactgctatcttgaaattggagccaatttttctttaagttattttttattagatattttattgcagtaatcaataaaaattttatttgttgttctaatgaattttaaaacagcaaat

SEQ ID NO: 4962 - DNA, 1000 bp, mus musculus
ttaccaccatatactaaacagttcttattaatgttctgattagttgtgcctcaaatctttatcatgttttgacatttaatgatgtttattattttgcatttaggttacttctttctcatatattgcatgccaacaataatttcacctccatcttctcctcccataccttacctgtctcttctttatcccagatccactcatctatttcacttcagaaaactgcaggcctcccaaagaaatcaaccaatcatggcatatcaagttgtaatgagactaggctcctccttttttggtaaagcaagaagagttaacccattaggagaaaagaaaccccaaagcaggcaatggagtcagagacaaccttgttttccactatgagaagtctcatataaagacaaagctacacaaccataacatatatggagaggacctagattatagactctctgatcattggttcaatgtctttgagcccctatgggcccaggtgagttgattctatgggttttcttgtggtgtccttgattcctctggctcctacaacccttcttcccgctattctacaggattcaatgaactccccctaatgagtggctttgggtctatgcatctgcagttgctggatgaatcctttctgaggattttcatattaggctctggctaacaaaatagagcagattagtattactatcagtaattgttacattgacttttctttggcagttgtgtttggttctatgataggtgtctgggctactcagcctctggttctcagtactccaggaagtgtcaggagttagcttattcttgtagcatgggtctcaagctgacccagtcattggttggccactcccacatggtctttgaaataaaatgatggtagcaaataatagattactttctgaaaaccttgggttcacttaaatacaaaatgtagtctatctagaatttttatataaaatatgaaagtaattcaatttgctttcaagcccacataatt

SEQ ID NO: 4963 - DNA, 1200 bp, mus musculus
actcttgatctctttcctaggttttccttctccagggttctgcacctttgtgatttctttattgtttctatttccatttaaagatcctgtaccacttgttaatttccttctcctgtttgattgtgttttcctatatatctttaggagatttctgtttcctctttaagagcttctgttttcctgtgttctcaggtatttcattaaggttgttacctatgtaacaacctccttatgattctctgccatcttcctaggtcagaatcttgctttccaggtatgttggggtgttcaggccttgctgtggtggaagaactgcgttctgatgatgccaagtttctgttgtttatgttcttgtgcttgcctctcaccatctggttatctttgctgttacctggccttactgtctctgattagtttttctctcctgtaagtctagttatgatgggcctccttgggtcaggctgtccctggatatggaagggggtctggagtacctgatctgtgagcatagttgtgacagatctcctgtgagaccacttgtgtcataattcctgggagtcaaggtgtctctgggtgggggtgggggtgggggtggagctgagggctggagcacacaatctgatcccaggtacaattgtagacagaaaagatgtattttcagcaggccaggaaattatgtgttctctgtgccctgggggttcccagttaggccaggtattggtgcagtgggttacaactgtgagtttgatggtgtcagagcttctggggttaaagctttccctgggtgtggaaagggtttggaggtgctggaacacaggacctgctaataggcacagttgtggacaggaaggaagatgtgtctgtccttaagtcttattcctggaattttggcgaaatattaatatagcaataaaatccttgacaatatttgctttgctgtgctgtgaaattcatatatttatttttcaatagtgaatggaactcagccactaaatattttgttgtttataaatgtttttatggtaatttattctttgaccactttgaatgatagactcattttgaaaacgtctttgtggcttcctgattctcctgaaattcccttgggatctgcaaataatttttagttaatttagtaaaatttcttgttcttctagatgcattgggttaccatcttatcagtatgaaattcatgagcca

SEQ ID NO: 4964 - DNA, 1400 bp, mus musculus
catcccatttaacatttgtatgaataagagctactgaattttttaaagtcaattttctatccaggactttgaaggtgtttattggttgcaggagttctttagtaaaatttataggtttgattatgaatactatatcacctacacatagcaacactttgacttcttctccaatttgtaaccccttggcccccttattcgtcttattgctctagctagaacttcaaggactatagtaatcccttccgtgattcctacccacagggtaaacagaaactgtaatacctaccccctctagccagacaggacttcagttgaggaaagggaaaatgaaccaatctacaaaccttcaacccaaatttaacctgactacaagatgtgcagaggaaaaagacaggtcagagactgaggtaacagtcaactaatggctgttacaacttgagacatatcccatgtgagagggccacctctgacactattaatgatactctgttatgcttgcaggcaggaacctagcatgctcttctgagatgcttcatcttgaggctgatgaaaacagatacagagactgacagcaaacattaggcagagggatggagtcttgtggaagagtaggggatagaattgagtaaaccaaagacataagaagacctactgagtcaaataatctgggttcaggatggctaacagcgattcaaccagcagccaaaaacgcaagcgggtgttggtcgtagagcccttaaacatttatagcagatgtgcagcttggtcttcatgtgggtcccttaacaactggagcagtggagtctctgcctctgttgcctgccattagatccacaccactacctggaatgactggatgagtctcatttgaatagggtatgcctagtcctgctggtaatagctatcactggatggggtggtgcccaatgggatctatccctactctgaggagaaggggagggagtaatgggggaggaatctctaaggatgggactgggaagagaggagggagtgagcactgactgagatgtaaagtgaatgaaaaataaataattgggaagaaaaaaatgaaaaaaagaaaaaaagacttgctgtgatcatatttctttattgatggaaactgtatgacaatttatttcactataatctgtcatttatttatttatatattcatttatttatttatgtcaatttccctttaaaaaagtgacactcagagttcagtatactgctagttgagagtttgactagaagactggcacagaatacaaaggtaatgattctgcattctgttctctttacttgtgttcatgaaaggcaaatgcacatggttttagtgatatatcagagcgcaaatatgtggtttgttttttaacattgtatttaaatgtcattaagac

SEQ ID NO: 4965 - DNA, 1600 bp, mus musculus
cagtttcagggtgtttgtttgtttgtttcctgaactctattgcctaatctgtcaagcctaaaatttcaggaattttgtttggccttcctaaagaaagtgatatagtataatggagattccttttaatatgggaatggatctcaaagttattcattattatatttaatttcatattgtgaccacttccacactaatgttaatgcttcctcacatgcaacttgcaatttagttaatgactccagtatttaatttctttcatctgctaagtgtgtctctgagtgtaatatgacttttccttagatttctgaagccatccctgaagtttatgtgaagcacaaaatttatccattttgacatgtgcacttttgacatgtgtacctctaaaatgtaaaatttgatgccataaaagagagtctgaagtaaaaaagtctcaatgtaaaagtaaataaataaaaaggtctcattgttaataattgaagagtaacatgcagatttcttttttctctttctttaatttattatttaattaagtttatatcctgattggagctcctcttccctcctcttctcccatgcctttcctctcctttcctcttcccctatgacccctgctacctttcacctcagtaaaggggagacttccatggatatcaacttccctaggcatatcaagttgtagtaggactgggtgcttcttctattgagattagaaaaggccattcagacaagagaaagggatttaaaggcaggcaacagatttaaaaacagtccttgctcctgctgttagaggtcttatatgaggatcaacctatacagctgttacatatgtgtagggggtctaggttgccccatgcctactctttggtgggtggttcagtctctgtgaggcactatgagctcaagttaattgattctgtaggctttcatgtggtgtcctgatctaggtttttcaagctttcctccccctccctaacttccacaagattccttgagttctgcttaatatttggctgtgcatctctgcatctgctttcatagctgattcatgaagccattcaaatgattgttatcctagcctcctgttgacaagcatatcacaatattatttaatagtgtcaggggtggactttatctcatcgcatgggactcaagttgggccaatcactggttggttattaactcaatttctgctccattgtttgtgtgagagtaaacaattataatcactttggaaataaatttggtggtttctcagaaagttggaaattgttctacttcaagacatacccatatcactcttagatatatgcccaaaaagtggacaaccataccacaagaatccttgcttgactatattcatagtatttgtaatagtcaatgacaaagaacaacctagatgtgccttaactaaagagtgatattgaaaagatgatatatttaatcaatggatattatttagctattgaaaattctgacatcataaaatctgtacgccaatggatggaactataaaagatcatcctaaatgaagtaactgagacccagaaagaaaaccatgatatgtaatcatttataagtacagaaatatatggatattagc

SEQ ID NO: 4966 - DNA, 1400 bp, mus musculus
cattgatttcatttacatgctattttctccagaaataaatagataaatcaaataatcgaatgtaccaatccctgttgcgcaatagcaaagaattcagctggttgattgccctctaggccaccaaaacaatcaaaatactatctaaaactagcattaaaagaaaaatcacatttgctaaaaatgtagggcttataaatatgttttagtttgaggtggggttttttcattatatttaatctttaagaatggaaatatctgctactatgtggctgaaagtgtaatagtaaattaatattagcaaaattggaattgcccattaatttatagacttaaccatttataggcttaaccattcagcatagaaattgggctctgtctaaagccatctgggctactgagggagagaggaatggcatggggaactatgggaagggggtgtatgcagctgctgagaacctgcttctacttcaccctgattggtaaataaagatgttagcacacaatagctggggagggagacaggcaggatttcatgattcctgggcttggaaccagaatgagaaagaggagaagaaaaggatccactatgcctgggaattgtggaggagagctgagatgccagagaagagtgcaggagagaagcatggatggcatatgaaggagccaggaaagcacaacccagttggtgagccctctaggtccagaacaactgagatggaacacagcattagtaagtaataactttgggttaacttcgtggtagttaggctgttgaccagctattgtgctgtttaagacaaatttaaatataaaggctgcttgtttctttcatttcaaagcatatactattggggcaggtagtgaacccactgccaagatttcatagtaagaatataacttcttcttctcagcacctaatagtgcctcttccaaaactgaccatatagtcagtcacaaagcaaaactcaacagaaacaagaaaatcgaagtaacacattgtatctcatcagttcaccgtggactggagtagagttcaacaatagaaacaccagaaaccctacacactcatggaaactgaacagctctctactcaatgaactctggggcaaggaagaaagacagaaaggcattaaagactttctagaattcaatgaaaatgaaggcttaatatacccaaatttctggaataatatgaaagtggtgctaagaagatagttcatagcacaaaatgtctcaataaaaaatttagaaagttctcataccagcacacctttaaaagtacacctgtaaggtctagaaaaaagaaagaaagaagcaaacctatcaaagaggagtagaaagcaggaaacattcaaaatgagggctgaaatcaattagttagaaacaaaaaatacaataaa

SEQ ID NO: 4967 - DNA, 1200 bp, mus musculus
aaaagggaaaactacaccatagaaaaagcaagaaagtaatcttctttaaataaacccaaaagaagatagccacacaagcataattccacctgtaacaacaaaaataacagaagacaacactcacttttccataatatctcttgacatcaatgaactcaattccccagtaaagagacagagactaatggaatagatacataaacaggacacagaattttgtcctgtttaggtgcatacaggaaatgcacctaagtgacaaaaatagatactaccacagagtaaatgactggaaaaatattttctaagcaaacggtctcaagaaacaagctgaagtagtcattctaattttgaataaaattgactttcaaccaaatgtgaccaaataaataaggaaggacacttcatactagtcaaaggaagaaaatataccaagatgaactctcctttctactggggcagactcttggctggtctgcttcagtgaagacaccatatcctgaactatcctagagaactcactgcactcagagaagttgaggatccactgcactcagtgtagctgaggatcagctggactcaaggcagttggacaacagattgattgctccactgaagtcctgaaagtctgaagacctctcaggagatctactacagcaggggcaatatatcagcaacttctctgcccctgtgaagaacccccagttggaaggccctagaggtggtctgctacatccaaggctgcaggcctatcagaagacctgaagcaacccaaggacaaaagaagcagactccagagagtcacccagaccaacaaacattaaggacatccggatggcaaaaggcaatcacaagactataagcaacagaagccaatatacttgggtattatcagaaactacttcttccaccagagcaagccctaaatacaacaacacacctgaaaatctggaagctgaactaaaatcctatctcataacagagtcctttaagaaggatttaaataactcactaaaagaaatacaagaaaatagaggtaaacaggtgacaggattgaaataagcaatccaagaccaaaaagtagaagtagaaacaaaaaagaaaacacaaatggaggaaaatctggaaatgaaaaacctaggaaagaggtcaggaattacagctgtaagtatcaccaacagaatacaagagatagaagagaga

SEQ ID NO: 4968 - DNA, 1200 bp, mus musculus
aaaaatgctaccacattttcctaaaggtacagagataatatgtgcatggttgacttcaaggcacacaaataaaatatacacaaggtaatacattaccttagatttacatctcaaaatagaaaatacatttgtctctttaagtaaagttagatgacttgaggttgtaatgccacccctcccaaagaataaaaggcaatctagcaaaaaccccaatgctaagcacaggaaacctgtcctcaagttgttgggcaggaaggatcccaagagactttcaaaaccacttaggatattgcttttgcccttggttgccttcaagcgcttgaaggtaagactctattaatgaagacacttgagacacagagcttgggaggcttggagagcttggaggacttgcaggacttggaggacttgagccacaatcctctcccttgaggactagttctcgtagtatccaaacgtgacgtgtaaggtgacgaggagaaaagcacacatctcagctatgaagcctgcaaaacaccacagtgaccagcctttcaagacacccccaaaggtgggacagtgacacatattttgggggtaagtgacatctgtcttattgtctttgttgtagttgctaacttgacacaagctagagtcatctgaaaagaggaatataaattgaaaaaataaatgcctcctaaacattggtctgaaggtaaccttgtatgggattgtcttagttagtgattggcatggtagggtccagcctactgtggctggtgtcaccctgagcaagccatagggagaaactggtagtagacagtgttgctccatgacttctgcttcagttcctgcctctgcactcctaacttgagttccttcctgacttcctttgaagatggaactagaagatgaaataaactctttcctcctcaaattattttggtaaagcacagggatagaaactctaactaagacaccaagtagactcaagttctgctcaatatgagagaattcatccttatattgtaaatgtagcaaacttaaccatggctgaggaggtcatggaccctcaaggagaatctgctaatgccattttcctaaaccactatgagttctaataccataagcaaggtctaaatatttgctcgtatatacagagaagtgtagctctcaccattcatcaagtatgcttcttttaacagcagatatagattacta

SEQ ID NO: 4969 - DNA, 1000 bp, mus musculus
aaaaaaaaaaaaaaaaacaaagcaaaacaaaacaaaactactctctgtgtgtatgtacatgtataaatacaaatacttcatttccataggagagtgtgagcgcccgactcgccagcaaagcagacgccacaacaggatccttctacacacgtttattgggaaagcttgattgcagaggtgaaaagaccccgagcccagaactggtgctgcttatataggcctaggagaggcatgtctcacaaccggattcattatgcatttactacctcatttacatatctacatccgattggttatgctctcagaacctcacagaacctcattaacatgcctcatttacatatctacacctgattggttatgctctcagtacctcacagagcctcattaacatgcccgggccaggcagtgactcggcaaaaaactttactgcacattggttgtttacccaaacttatatgtggtggccagcggtagccagcgccaccttgtaatggcatatgtggcttcccacatctccccctttttgttttaataaaatgaagctggactaggcctgtgcaattatgtccatctgccgtggctcctgttttaggtcgttcctctagtgtcacagccttacccgtcatagggtaaccctatcgccacaggggcctcgtgtcttaggttggtctgtgcatgaggaaagttgcccgtctatggaaaccacagcactgtgtgacggtaactgctaactggcctagggtgaactctacaaaggaggccagccaagttttagataaacaaacttgaggggaggagccgttttcaatggctaagagtgcctgagttataatcaccttgtcacgttttttgtggggttctgaatttgcaaaccaaccaaagcatgaacaccagtccacagcatatggcagcaccaaacaaaatcactcccacccattccttaaagtaagaaaatgcagaggtaagccaaaaggtaagcaatgcctcagatgttttt

SEQ ID NO: 4970 - DNA, 1000 bp, mus musculus
ttgtgatacttgcctgcctttgcccctgttgagcatcttccgacctcaggagcctcctacatctttggcgttttacagccccttattgagatttgaaagagctcttagtcatcaacagttgccagccaccctgttgcatataccccctcctctttcatgagctgactggagatgccaccaaaacggacatatccaacaaagtcactcagaagtcatggctttggcgggaggttgaccaaacaaagggatccaaacggtcacatctctctcgccaccgagggtctgctcacccggaccaccagagacatcagttccccagcaaccgcctggctgttaacatttttccacacccaaggaaacacttgcttatccccgctctttagttcttatctcagagtggtttccctatttgtcaccagacattctccccatccccatggcgacagctctgtggaccgggcttttggcgcggagctctctaaggattctgggatgtgtaaatagattgtgcctaccacttccccttatccacactcttgtctgacccttcaaagggctctggtagattatggagccctggtttccccttagcacagccaggctgccttgccacaggaggtggggttcgctcaagtgcgctttaatcctgcccttagcgatccctggcctactccctggctttcacgctggtgggcggtttcccagacaggccgctggtgtctcgggttcttcgcaaaggagtcaaccacaagaaaagcatctaactttgtcgtgcctcatcgtgagagcggtctcttcgtttatgggtcacgaggagtcgttgggtacaagaaaggcaaataaataaaatcccaccatgtggttggctttccacggcttagggatttaaagtgctgcgttcatctgaacttgtgcaggaggcagtgcaaggctatctgtatcccatttcatttaatggtacactgctttgtttacaccattctccgggctgtatatagga

SEQ ID NO: 4971 - DNA, 1000 bp, mus musculus
cttacagccagggagcggagcggggggcagtactcccctatctacatacctcctcagcatgaaaaaactccaggtttgtacgttatctgactgacggccaaggtctgctcagagggtgtcacggttctgtgctccagagcaggtagaggtaggcagggagtggccccattccttctgttctggattctgaggttggccgggtttgggctccctcagtcttggcaggtcagttctcctgttgtacagcccacttgccacaagagttacttttgtttttgttatttgaaagagtttctctgtgcagccctggctgttctggaactcactcagtagaccaggctggccctgaatgctcatggatccgcctgcctctgcctcccaagcgctaggattaaaggtgtgcgccaccacagcccagcatctaacaattattcttaacacctggccacatggcatttctttgctcttgttttcacccttaaatacttacacacatctcaaaatttaaggacactggcttataaatgataactttataatcataattaacaaattcattagtatagtatgttgatggaaagtataaaatgtgcgtgtgtgcctgcatgcccgggctctggccgtggccctgtggatactcacctttactcttctttagtttgcagttagacaacaacgtcttctcagtaacgtcctctcctgctgagcgtgaggatggactcagggaaggtctgtcatctccaaaccacaactttaaaacaaaattactcagttcaacaaaaatggttaaacccagcaacctttgaagtataaaactgagctaagctaagtcctggaagtcttttaggctcacgctaatgacaagttacctccggaacgtcgaaaggaacttcctggttgctggttttcaagatctcggctaagagccgcagtgtccgctctcgagggataatgttctcttcttgcattttggtccacgcagcatccgctctttgccagt

SEQ ID NO: 4972 - DNA, 1000 bp, mus musculus
tgaaaaacaacaaaatgcttagaatccttagccatcaaggaaatgtaagacaaaactgctttgatatttcatattccctctatcagaatggctaggaccaataaaacctccttgagctcatgctgccgaggaagtggtggcatgccaatgtgtgcagccagggtggggatcagtgtgcttgttcctcaggtagatggaaatctggccaccttgagttcaactacacccctctgggacattggactgactgagtcgttttaggtcactttggtataaactaatgtcacctgcgaacaggaggcctcaataaaggaaatgtcttcatatggtagggtagtaggcctgtcgggtattttcttaattcgtgattgatagatcgcccagaccatcataggtggtacagttgttgggctgatagttctacgttctataaaaaaagtaggctgagtaagccatgagtaccaagtcactaagcagtacctcttcatggcctctgcccctgctcctgcctccaggtttctgcccaggcagaattcctgttctggattctttcaacaatggattgctattttgaagagtaaggccttttaaaaaaaatcaaaggagagtactaataatttttgccatgtaataattctgtaaatgtgaatggaataatctatgtcattactaaatggtaatgcacaatatacagcagattcctcatatagagtcacccacaatcacctttccaactcactgtcgtgaaattaaaggatttgacaaatgtctgggacttggggtgagctctgttcccgcttcacctcgatgcagttcaatactatttttaagtctatttaacttagtggatgtaaccttctaaggaaacttcatttccgtaaagcacaggcattttctaactgtgaccattttgcctcttttcagccaagtcacctgtgcatttttaaaagcttcacttgtttgtttttattctaaccatagaatgtactattttctaaat

SEQ ID NO: 4973 - DNA, 1200 bp, mus musculus
atgggaacattttttggagatcttaatctttaatggtagaagctagcttgtctcttacctgaatgctgagaaatactaggaaatgctagattctgaaccactttcctgcttcaacaagataagctatacttgcatggattttccacactggctctatatgatttgggcttccgtttttgtttttgtttttgtttttgtttttgttttttggttttctttgttttgtttgtttgtttgtttgtttgtttgtgtgtttgtttgcaggaggactggagaaggccttcctgctgtttaaaccatgaaaatgcacacaggaacctagaaacagcccaggacaggatcattctggtttccatctgtgtccagagctgatcctgtgcaacagtgcccagagttgattccatgttgcagcgctccatatccaaatactgctgggatagagctgatctctcaggattccagacatgcttgtgagcacaggttaggcaccacttcttctcagaggccttgtctggagcccttaggacacaggaactgagtgaggaggagcctgggacaagttttttttccagtttctgtctgtgcccgtgttgatcctgtttcacattgctccatacccaaataccaactggagacagctggtctcccaggagtgccaacacccctgtgagcacatttctggtcaaatttctggcccaagagggccttgcccacagtgttcaggacacaggaaacaaggaaaagccggagacaggatccttctagtttcagtctgtacaccggggctgaacctgtgccacagctcttcatacccaaattcctcctggagataactggtctctgaggagtgctgacaggaaggcttgcaggagggacaagccacagtcagagacagcaagaccaactaacaccagatataaccagatggcaagaggcaagggcaagaacataagggacagaaaccaatgttacttggcatcagaacccagttctcctaccacagtgaaccctggataccccaacacactggaaaagcaagactctgatttaaaatcatatctcatggagatgatagaggactttaagaaggacataaatctctcccttaaagaaatacaggagaacacagctaaacaggtagaagcccttaaagaggaaacaaaaaaatcccttaaagaattacaggagaacacaaccagg

SEQ ID NO: 4974 - DNA, 1400 bp, mus musculus
aaaaaagattatgaccctgaggtgaaaaatgacagaaaatcgactatagccctacctgcaacttgtacattactgataagccatcttataaatgctaggtagaatgatctggtaacaaagcattaaagtcaactgtgcgtggaggtctacagaactatgatctttttgtttgttttaggagctcaggataagagagaagagcttcctgtttttctttccttttctttccttttctttccttttctttccttttcttttcttttcttttcttttcttttcttttcttttcttttcttttcttttcttttcttttcttttcttttcttttctttcctttcctttcctttcctttcctttcctttcctttcctttccttttcttttcttttcttttcttttcttttcttttcttggatattttctttatttacatttcaaatgttatcccctttccagatctccctatcccatcctcccatccctgcctctatgaaggtgttaccccacccacacactcctgccttccagccctgtcattcactacactagggcatcgaccccctcaggcctaagggctgctccttccactgatgtccaacaaggccatcctttgccacatatatggcaggatccatgggtctctccatgtgtactctttggttggtagtccagtccacaggagctctgggggagggggtgtctggcccattgtcactgttgtctcccccaggggcatgaaaaccccctaagatcctccagtcccttctccaactcatccatcagggatcctgtgctcagtccaatggttggctgtgagaatccacctttgtatttgtcaggctctgccacagcctctcaggagacagccatatcaggctcctatccttccaggtttggtaactgtatatggcatggattccccaggtagggcagtctctggatggcctttccttcagtcactgctccacactttttctctatatatccttccatgaatattttgttccgccatctaagaagcactgaagcatctacactttgatcttcctttttcttgaacttcatatggtctgtgaattgcatcttgggtattctaaatttttgggctaatatccacttaacagtgagtgttcttttgtgattgggtttcactcaggtatcactcaggatatcctccagattcatccatctaagaatttcataaattcattgtttttaatagctgaatagtgttccattgtgtagatgtaccatattttctgcatccattcctctttgaggaacatctacattcctaagagagcaagacgagtttctctatgttatgttaggtaagccttataacttgaagaatatccatgagcttaaattaattaattttactcttaattcatttaactt

SEQ ID NO: 4975 - DNA, 1000 bp, mus musculus
actttgacgttttcaacatttctgggtttccaacacaacccaggattcactgtcatagtttcatgcaacagcctttccagggcctccatgcaggactgtagaggaaggttccacaactcttttattatacttcttgactctaaagccagaactatgtggctaagctttgccactgggacttgggcctctccttgacttgcatttgtataaactttccattgttgatggtttccttaaagccttaagttttcctttcttttcacaagttggaagcttaactgggtgggatactgccctggggtaccattcacttaattacattttcaatcaggtcttttcaaaaatctccctaagcacaacacttggctccaatatcatatttcctggtgatattttatttctaaaattgtacattctgtatttctctgtgccctgcttgctgcttttcaatttctgatccatgtaagagtggtcactgataaccacatgacacagatttttatgttaggcagatgtttacatgaggtcagaaggccattcatcagaatatcacaggaacaatctccaggattcttgctaatattcttcccctctgaacgctacttagcagtgcccacattgtccaagttgtttttaacattgtcttccatgatttttctaggatggcacagtaagctcaacttaaaatgttcaaagatttttctagtccaaagtcctaaagtcttccaaagtcctacaaagaaaatatggtcaggcctatcttaacccatagcatcaatttctgccttagttactgttctactgctatgaggagatgccatgatcaagacagctcttataaatgaaagaatttaatgggaagtttgcttagagtgttatacttttagcccattatcatcatggtgcgaagcatggcagcacgttggcatggtgctggatcctcaaagcccaaacccaagagacacactttctccaacaaggacttgcctactccaataag

SEQ ID NO: 4976 - DNA, 1200 bp, mus musculus
caaaatatttactgaccatttaatttttttcaaagaattttatctttagataatttgtttatttttaaactgattgcttttattaaggtttaaaagttctttatgtatttgcactttctggttatcaaggctatggtagctgtggaattaagatgcatctctttcttttctgtagacctacatgaacaagatgcatctcttttttttctgtagacccacatggaacactgtctgtgaatgaagaggatcatgtgactcccacagacactcccagctttgtgattggaagacgcatcatccaacagaggcaaagggaagagatgcaacatggactcaaggacggccagcatggctaccttggatttaccttggacactaaatgatggtagataacttattgataaagtaaaatgaagaatgaatgagccacgttgttcagaattacatcctttcaatttttgactattattcatattttaacataaactattatgttacaatattttctgatgaaagcagagattaagaaaaaagcttagacggtatatttatgaatatgggctctagaaaaaggggttagggtgaagagtcatgatcatggatgttggaaaagttcctacagccagctgcatcatgtaattcactgctacatctgtagtcacacacaatgattactgagagaagttaagagatacatctaaaacctgcccaattgcttggtactctcaatgactaaggctggtatgcctatgggtgatatccaataaaatgttccctgatatgagcagcttccagtgaagttagagaaactaactagaatgaggatataaagttgtagatagaggttagactgactgcagcatcagctcacagctgcttagttcccgtgcctacttctaaatggcctctgtgaatctgaggaaatgttacagcacaccagtactctgcttgcaaaatctacttcaccctctgactaactaaggatgtgcacagcctgcgatgattaacaacaacacttaatctgtcaactgtttactcatcctaagatagcacacattccaagagagtcataaataatcacatcctgtgaggcaaagacaaaagtcagatgtaaattgagatatgtgtcaccttttgtctttgcttttatacaaagagcataattctgccatgaaaaggaatcagaacagtccaatataa

SEQ ID NO: 4977 - DNA, 1000 bp, mus musculus
aatctaattggtcctaatatgagaagaacaaactatcagttaaaaagtaaatattagaccttgggcacaaacttggcagcaagctccacacccccctgaggaggctccactcgaacatgctctagcacacccaggatcttaggatcaggggtgagtagaatacaatatctgttccaacaccaccaagagtaactgggaccggcaggatccagggacacaggaaccacacccaagcagtggctcaggttccttctggtctgccctggtttatcttgggcacaagcatggcagtccaggatcccaggatcccaggagcttggtcacaccaggatttcagggtttcagaggcagcttgacttccaggaactctggacacacccagaatctcaggatcacagacagctagactgaggagttctgactcaaaaaggattacagaatctacaggctctaatcagatatagtgagggcagggagcactagaaataatcagatggtaggaggtaagcataagatcataagcaacagaaaccaaggttacttgattcttgcgcatgtccgactcgccagcaagaacaacgctgcaacagggtccttctgcacatgtttattgggagagcttgattgcagaggcgaagtgaccccaagcccagaactggtgctgcttatataggtctaggagaggcgtgtctcacacccggattggttatgcatgggttatgcttaccaactcatttgcatgcctacatctgattggttaacttctctctcatctgattggttaattctcaaaacctcatcgtggcaaaaaaaaccctttaccgcatatgtatgcatggtggccagaggtagccagtgccaccctgcaacggcacatgtggcttcccacacttgatatcatcagaacccaattctcccaccatgacaagtcttggatacaccatcacactggaaaagcaagactcatatctaaagtcacttctagtgacaatgatagaag

SEQ ID NO: 4978 - DNA, 1800 bp, mus musculus
ctattacgaattagtcataaaaatagaaagaaaaatactttacctctcttaatccaagaagaatttacattaagtatagaacctggtttacatatctccttggccttccatttttttctgggtatttttccatttagtaatatcttatatttgaagcctctttgcaaaaatactgtactttataaaatgtttattcttcatgagtctcttacttatttactttaataattctcaaattcacaattttgtgttaagaatacttagtgtttaataagacagatgttgcttaccactatggtatgtgcaacactactagacttttagcgttattaagccatgttggtcattgttgtggttcatagattccatatccaggtagtcatattggtcttcctttttctggaagtttgtatggcttctcctgttattatgagactttattcttccttcttacctagaagtctatcagaatgtaacagtgtttagagctatattttccatcaggattctaatataaactgctacctgtaaggtttttgtttgtttgcttctttgcagcatgcatagctaatgttcagatgtgaatatactataatttctccaacttaaccatcttataaatatatgtatctcaaaacatgtcacacatcattaaaacatatattattttagtaggattgggagacaaagtaatgggacagagttagtcaaaatgaagaagatacgagtaaaccatgtaaaaaacttactatcatgagatcagcatgcctgcacaccaaaccccatagcctgcctatttctcaggaggtctactcaaacctagatcactggtgagatgcctggtcccatacctacacaggcagtggcccccattgaatgaagtagaggtgggaacaacccctttctgcccaagccccatcaccctttggactgcacctctacctgcatccatggcagattagcattcctggtcccttgaccccaccggctgcctgtctcccaggagttcttaccctaaccaggaacagaggaggtcttctctaaccagggaaacaggagacctgctctaaccagaaacagcactacttgcctcccagaatggcagctctaacacaagtcactctgcctgcctcttaggaggcctgctccaatttgagaaacagccagttaacaatagagataaccagatagtaaaaggtatggtcaagaaaataagctgcagaagccaatataatttggcaccatcagaactcagttctaccacactatagatattggaacacacctgaggagcaagattttgacctaaaatcccatctcatgaagattatagatccctttagggaggattcaaataaccttcttaaagaagtacagactaacaggagaataataaaaccatccatgatgtaaaaattgaaatagaaacaataaagaaatcacaaatgtgggcaactatggacatggagaacataggaaaaagaacagaaactacagattcaaatattaccaacagagtacaagcgatggaattgagaatcacatgtgtagaagataccatggaagatattgataaaatggtcaaagaaaatgcaaaagtgaaaaagttcctaacacaaaacatccattgattttgtgacccagtgaacaacatgagaataataacaataaaagagagtagagttagaaggactagaaaatgtctccaatagaattatagatgaattctaaccaaaagacagaggtggctataaacatacaagaatgctacagaataccaaatatattggaccagaaaag

SEQ ID NO: 4979 - DNA, 1000 bp, mus musculus
aagtactgtctaaaaagagccctgtgtaagcaaataaatatgttgtcatgcagtaatttaagttatattaattgattagagttttgatgtatagaaagaaattttaacaagtgtaaggcacatttacataattgaagagatgatatttacacaggcttccatatgataactaaggcagaaaacactacctatgtctattgtgacaattgttcaagatgatataaaaattaatgttaattccaaacttagaaatatttgcagcaagtgctactacacaaacctacaatgaatcaaaatacagagttgtaggaacaaggcccagtagatatatcttcaaaacactcctgcaactaaagctcagggaatgttgcagaaaaaaatcttttaagagccagattagggtgtttgctctaaaggtattgggggcaggggaacaggactgaagccctgagggacagaagaaagaatggaaatagttcacctcgggaggtaggatctggagggaccatctcaaatgtactgaagacctgaaaggtgagagactctcaggactcaaagggagcgacctgcgataaagtgctctacagtgggagaggggacttgtagagtccacctctagtggagggtcagaacatcaagtggagggaaggggtattgccatcccatagtcaaaaagagaactgttcccgtctagcagaactgcagggacaaaaatggagaagagcatgaaagaaaggaggtccagtgacagggccaaattgggatccagctcaaggggaggaaaccgggcctgacactgttactgatggtgtggtgtgcttgcagacaggaacctagcatggctgctcactgagagaccaaacaagatgctgaaagggtcagatgcagattctagcacccaaccaaaaggattgaagctggggacccttgtggtttaactggcagaaagctggaagaagcttaggaggagggcggccccatgggaagaccagcagcctaa

SEQ ID NO: 4980 - DNA, 1600 bp, mus musculus
actgcaaattgtaaaagagtttttaggtatcagactgtgtgttaagttgatataacagataaatgtccctgctcttgtgagggtgggtttgagtcatttgaaagaatggattaagttatttgtgcttatctgatatttaaccaaaattatgcaaaaggacatttcctataatcttaacagggtggtttttttttgcataactgttttatttcctaattcaactgacatggtaatatgcttgtcaatgactatagctctgttttataggggtagtttctgtatattatcagagaaagctaaaacaacaacaacaacaaaaaaaaaaaaaaacaacaaaaaaaaaaaccaaatttcatatgcgaaggcagcacagggatgatacacgagccttagtgcaggctatggcagccttggaagcaggaacatccccctaatgttggctcaacatgttggatcagtaatcaatgatgggtaagaccctcttgtgcacataccaacctaagacaggatggcaaaagtgaatttgtcactcccatgacaggtaaggatgtggcagggatgggggaaacctaagactgatgctgatcccagagctactaataaaactaaaagggggagatgtgggaagcaggtgtggctgcaggcccagtgaaacccacttgtttattgccttgcctgagcatgcgcagtgagactgcctgccaggctggactgttccttgtgatcgggacctgtcagcctatctgtgaacgacctgagcttgttccttggagcatgtgttagttccgattgaatgggtggggtggagctagaaggaggtcagtcggctgagtagtgaggagtagagttgttttttagcccttgccctaggtagaagccagaagtagaataagagtagttttagcccttgccatgagtagaagcagagtaagagaagctgttgtaattgtagtttagcccttaccctgagaaaaagctgctggggaagagagctataaaagaaaaagcccaaagtaaagttgctgcatgaacccgacttgttatccctgtcgctcatgtcaccgcgggccggagactgtggagaccagagacctggacagttattatcattgttatgactttcactgactttatttttcatctgaaatgcaactttaccattctgatgatgttttctttcctacataagtaaatgtaaaatcaaattatataatatatgttttattttgcagtaatttcatttttaatatcattcatatcagtatcaatgtttctccaatatagcagtattgttcatttctatcatttggttttaagttaccataactgactcatactttgaaggaatcttgagaaaactatattcgatttagataagtaattttacagaattaattacctaatgaaaactgaaatgtctaaggatgaatagtgttgtggctctcccttccaattccagtatgagaaaactgaggcagaagaattcatgtccattctaagctatatttcaagatccatgccatatattttacactatataaatgtctcaaaacaaaactaaacaaagcagatacatgaaaaagcaaaatgaaaattaaat

SEQ ID NO: 4981 - DNA, 1000 bp, mus musculus
tatcatatcaatcttttttactggtttcacttcctcaaacttcctgttcagtaactaaaaaaaatttgagtaaaccagtttatttaattttccttatatacttctttttttgtcaatcaaagcatcttgctatctcaattttcttattggtcgtacatttttccagtttaaaacctagagaagtcagcagcgaaggctattgctgtcagaatataattttttcatgaacatatacatttcttcactacatactctctatgtatttgcatcatgatgagttactacactttcctccttattaacattttggataggacagaagacaatttaaaagttttgatgagtaccttcatcagttttttattatcaaatagaaaaaacttctgagctagattcttagggaaagtccatgtctcctaaatctggagaagactaggggatttgagaagatcagatatagacagcatgttaaaaattacttttttaatggcagtttttattagatattttcttcatttacatttcaaatgctatccccaaagccccttataacctccccacaccctgctccccagcccacccacttccacagatatcagcaactcacctgttgctttttactatttaagatacatttaaggaaacctgaaactaaacttggtttgcatgagttctggtgtgagtttgtgtgaaaaacttaagtttttacataactttactagtgatgtctatgtaacctccctttaaaaagacaaaactaagccaatacaattgctattctaagaaagacttttgaagcagtattatttatcctaactttcgatgttacttgcagagtttgagcctctgaaaaaatagttgaaagtagaagtttgtcaccaaatgagacaggagggctatccaaatgtactaaatatgcctgtatgtgacattaagtgttgctatttgtcatccctacctgagtggtaaggacttcttaattagggcctaaaaagtaatg

SEQ ID NO: 4982 - DNA, 1200 bp, mus musculus
gaggtcatcatttaaaatcctactaatacacagggattcccaaggccatttgcaatcatctttaaaattgttggtttggttttaataatcttccttccttccttccttccttccttccttccttccttccttccttccttccttccttccttccttcctccctccctccctccctccctccctccctccctcccttccttccttccttccttcctttcttcctttctttcttttttaaagataatttctaactttacatttcagatgctatccccaaagtcccctataccatccctggcccttttccccaacccacccactcccacttcctggccctgtcattcccctgtactggggcatatgatcttcgcaacaccaagggcctctcttccccttgatggccaactaggccattctctgctacatatgcaactagagacacagttctggggggtactggttagttcatattgtcgatcctcctatggaatacagggcccttaatgatggagctagggaaagtacccaaggaactaaaggggtctgcaaccctataggaggaacaacaatatgaataatgtttcttataaatactttaatactaattaaagatgaaattttattttgtacctgcgggaagcgggtgtggccacatgggcctaaatggcgccctagcccattgccaggcccggtggaccccacatgtttactgccttgcccaagcatgcgcagtgaggctgcatgtgtgggctgcctgccaggctggactgttcctcatgatccagactggtgaccaacctgagctcttgcctggagcatgtgtgatttctgagtggatgaggtggggtggggtgaaatgaggtcagtcagcttgaatataggagggttgttgttgttgtccttgctgcaagaggagaaagggtaagaagctgttggggaagagagctgtaaaggaaaaagccacaagtaaagaagctgctgcatgaacccaccttggtgaccatgtcgttcttgtctctgtgggtcagagatggcggcatgtaccatgttttaatattatttgaaaatgaaattaatgaagtaaaacacaagctaatgtgacagctattttcatttacctcctttatttctgataaaaaggacaataataagcccatatgtaaaaatagacatatatcatgtatgaaaattcattggctt

SEQ ID NO: 4983 - DNA, 1400 bp, mus musculus
ctattactgttgtgtttacaaataaattgaaattttgcggtaagaaagccctatataaacagggttgtcagattttatattaagacactgtttgatagaattctgaatcttcagagagtgagtaccaagagatgaaaaattatcaacaaacaagtattctgagtgtcttcattgagaggtattcatattaaagcagtgaaaatatgttcacagagatagcgcttctatcaaattcacagaaaaaaaaatctaagaatatgggaagggatctgggagggaaagaggatggggaatggggaagaggggaacatgatctggtattgggtgaggaaaaaggatctttagagccagctgagagaatggaaaccggcaacctcaggagatagagggttgggggaccctccagaatgcaacagagacctgggaggtgagagactctcaggactcaaaagtagggacagtagtatgggacagggaacttgtagagctgatctccagcaggaagcatcaagtgagggagggggttgctataccacagtcaaaactgtcacccataattgttcctgtctgaaatacctgtagggatggaaataggaccctgaggaaaacaaggtccagcaaccggcacaaagagggatctaggtcaagaagaggtcccaaggcctgacactattactgaggttatggagagctcaaaaaaaggagctatcatgactgccctcctaaaaacccagcaggtagctgaatcagatgcagatatttgcacccaaccaatgaacagaagctgctgacccctgtggttgaattagggaaaagctggaagaagctgaggaagaggactgccctaaagggaggaccagcagtcttaatcaacctggaccccaagatctctcaaatactgaaccaccaaccaggaagcaaacacaagctgatatgaggcccccaacacatatacagcagagaactgccgtgtcttagttcagtcagagaagatgcacctaaccctcaaaagactggaagccccatggagttgaaaattctggttgtgtttgtggtgggtggtgggtggtggggacatcctcatggaaacagtggggtggggaggagttatgggatatggaacaatcaatcagagggtaggctagggtaggggactaaaatctggaatatatatatatatatatatatatatatatatatatatatatatatatatatgataaaacgaatatcttacagatcaactccctttcagaaagatttttaaaatattcaattaatttttacaaaacttacataaatgctgatgtaattgtattctatatgacgaatagatggagattttcaattaaaacaaaaaactacttccctttacatttttggcagtttgtgaaataagg

SEQ ID NO: 4984 - DNA, 1000 bp, mus musculus
cattttcaatgatatctcatttcccagtttcccttccagaaaccctgtatcccaaacccctccccctgcttctatgatggtgttcccccatccactcctgcctccctgccacggtattaccctagtcttgggtatcaagtattaacaggaccaagggcctcttctttcactgaagccctacaagccatcctctgttacatatgtggctggagccatgggttcctctatgtgtactatttggttggtggtttagtctctgggagcccgagttggggagggggtacgtttagttgatattgttgattttcttattgagattcaaacccctttagttccttcagtcctttctccaactcctccattggggaccccatgctcagtacaatgtttggctgtgagcatccacatctgtatttgtcaggttctggcagagtctcttgggtgacagctatatcaggcttctgtcaacaagcacttcatgacatccacaatagtgtctgggtttggtgtctatatatgggatggatccccaggtggagaagtctctgggtggcctttccttcagtctctgctacacattttgtcaatgtattttctcctgtattttgttctaagaaggactgaagcatccacactctggactttcttctacttgaacttcatgtggtctgtgaattgtatctttggtattctgagcttattcttttcaataaaattaagctttccaataaaatgaagaacaagctttgggatattcggagagtatggacaaataagcacctggagcaattcaataggtagagttttcccagctacacatgaccattttatgaaaagtcaaagaaagttttcttagcaaaaatctgtgaaaattttagcaaaattctgagttagtaaaataatgaaagtagccaaatgatgccccagtcttaacattatggaaattactagttcactcactaaatctatatctgtaaaagatctgaagaaactattaaat

SEQ ID NO: 4985 - DNA, 1000 bp, mus musculus
catcacaaaaggaaaccaggtcagaaactcacacagggaaggaacttaaaggcaagaactgattcagaggccatggagagatgctgcttactgctcagcttgttttcttatagaacccaggactaccaacccaggcatggcaccacccacaatggtctgggtcttcccacccttaatcactaaatgagaaaatgccttagccctggatctcatggggcatttcctcaacagaagctcctttctctgtgataactccagtttttgtcaagttggcacactaaatcagtcagtacaccttgtcaacttgacacacaaacacataactattaagcctcaacttttactttcttattcatccccaacatgtaaataactttaaaagttccagagtctttaaaaattcttacatattataatttcgatccctttaaaatacccaatctctttttaaaatcaaagtctttttacaattccaagtctcttaacagtgagttacactaaaatactttgttatttcaaaagggaaaaatatcagggcacagtcacaataaaaaacaaaaccaaactctgtttcaatgtctgggattcactcatgatcttctgggatcctccaaggacttggatcacttctccagctctgcactttgttgcacacagcttgtcttctaggctccagctccctgtactccactcctgctgttcttggtggtcatctcatagtactggcatctccaaaacactgttgtcttcttctgaaactggactacacttttacaaaaatcctctcacaggctcttttcatggtgctaatcctcaatttttttccatgaccccttcagtccttggtcttcagctgccactgtggctgtaccttcaccaattgcatctccttgcctctcatagtgccaagcatcagctgataccccttcgtgtttcaaaaccagttccacctaggagactcttatacattaccaagtctggctgtccacacagtgtacat

SEQ ID NO: 4986 - DNA, 1400 bp, mus musculus
gcatgaaacacagctgtcatcagaagagttaaatttgaaatgtaaaaaagagcaaggagatctaaaggtggagaaagcctaaggaaacataccacagatagcaaatgaaaaattttaatttaaagcatagcctttaaagtgtcaggctgggctaaggtcatattctaatacgaactgctccaaggatggctcagggcaaaggtaatcactggaatgtacaaagtcttcagcaatatttatctttactattcatttccttactacttaaacacatgaattcttagctctttatttccaaagagatgattttgtttagtggggtttgctcaatatatatttctctcgcaatgctggcactggctgtaaacccaatctattatttcatcaaaattgttagcatcagagcacagtactttttcaggaataatttttgacttaacattaaatacaaaacaaaatcaatagttcaggtggtatatacaggaacttgttggcaagcagattcaattctggaacccacatagtggaacaagagaactgctcccacatgggtatatctgttctttcaatagatgtgtactttaaagaatttacacttgaagaaaattgaatctggcaggtctcccaggagatctgttgtaactaggaacatgggtgagaccccctcctcaaataatcatccagctggaacccacacagagcacagtggatgcaggacctctcccctctgtgcgactccatctcccttcctgtctgcacctccaagcggggtgttgttgttggggcagatccatgtgcctactctttctccacttcccatagcctgtccttctcccagaagatctgccataatcagggacacaggaggccccctctaaccagagaacgcactgcctgtctcccaggaggcccactctaacccatgtcacagagctctatttggcttcaaggatgcaggctccagacagagacacccaggccagttaacactagagataaccagatggcaagaggcaagtgcaagaatataagcaacagaagttaatgaattttggcaccatcagagaacccagatctcccaacacagcaagccctggatatcctaacacacctgaaaaacatgatgctgacctaagatcctatctcatgaagataatagaggcttttaaggatgatatgaataaccattaaagaaatacaggaaaacacaatcaaatagctgaaggaattgaacaaagtagtccaagacctaaaaataaaagtagaaacaataaggaaatcacaaatggaggcaaccctggagatggaaaacctaggaaagaagtccggagccatagatgaaagcatcacaaacagaatacaagagatagaagagagaatcacaggcatagaagatacta

SEQ ID NO: 4987 - DNA, 1200 bp, mus musculus
gagtagatggttactctcagaaaagttcagtcatgataaatgtcaccttcttgacttaacaccttagtagaaaacttacagctgaaatgtgaggaaacatttaatgattcactcaaaggagaattaaaacatctctaaaggggctaccgaaatgctcagcatttaaaagcattcactgcctgcttttctagagtacctgcgtttgatttccagcaccacacagcagctcacaactatctgtaactccagatccaggggatccaaagccctctctgactttggcaggcggtgcatgtatatggtgtactgtcatatatacaggcaaaataacaacacacatacaatcaaaaaaagaatccttaaagttgtactgaaagcattggtaaatatgtgatgggtgattattgagttattactttttgtatcttgctttcatatagggcaaggtgcatttacacttgacttaccaattgatttgtgcatatctgtagttcttagcttagcagtcaatactcttaaaagcatagcagtggtgctttgatgtggatagttctgtttgtgtcatgtgatgcacacctgtgatgttttgctcaagcagactcatatgatgttttgctgaaacaaggggattcttgaagttgagagagaatataagtaggacccaacagacagtgactaggtgctggcatagctagtgttggtcttgcttctttgctaatcctcacttcattggaagaggcacagcagaaaacttctcaaggcattccagctgagcctgctcactcccattgactcctgacaattcagtggaggcctgaatttttctgctgggtcatgctgccactttgattatgcttggtgaaacttttgaactggattgttgatagcctgacaatgaagattctagttgctgcaaagaacaacttctaaacaggtctacatctttttgtcctatttaccatcttttctcccatatctttgtatagtggattagaaggggaattgaagtgtttgagaaatcttactaaagtaggttttgaaaaatctaagcttagaatgctttatattatttactttacagtggttctttagagtattattagtcttaaaatgcctttgaaataaagtttatacaataacctattttcctcattgttagttatttaagaacagaaagtgataaaaaatattttataactc

SEQ ID NO: 4988 - DNA, 1000 bp, mus musculus
ataaaatactgacactgtcactcgtcgtcccccccccccccccacgcacacaagcacacagagactctccttatccttctctccttctacttctgcgaggatagtaccacccctgagattccccccacactggtgcatcaaatttctgccaggataggagcatcttccctcactgaggccagacaaggcagacagataccaaaatcaggctacagttttagggggagccatcggtacagttgggggggcccacatggagagtgagctggacatctgctacatatgtgccaggggtcccttgttcaagcccatatgtgttctttcatgggtggcacaatctctgagaactcccataagttcaggttagttgactcagttggtcttcctgtggggttaccattcccttcagagccttcattccttccctgaactcttccacaagagtccctgacctctgtccgatgtttggctgtgggtatctgcaactatttcaatcagctgcttggtggaccctcttaaaggccagttatgctaggctcctgtctgcaagcaaaacagactatcattattaatgtcagggactggtgtttgcccatgggatgtgtctcaagttgtgccagttatttgttggccactccttcagcctctgctccatctttgtccctacatttcttttagaaagaacaaatttttggttgaaagttttgttggtgggttggtgtccttatcgttccatgggtgtgtctgggggtgggtgggtgtcctgcctggctataggaagtggcctcttcagtttccaaatccctatttttaggcatcttgactaagttgaccagcgttgactcctaaaatcttcacccatctcaagcttctgggacattctaaagatttccctccaccccactagcagctgcagatttccacttattctcttagttctctgggtcttcctcctgtctctccacatacatgatcctgccccctcgtcctactctcctct

SEQ ID NO: 4989 - DNA, 1200 bp, mus musculus
cataattatgtttgcatgatattacatttttgtcaatatccaccttagtgccaaggatcagccttggcttagagagtggttcaacaactacaagtgaaattattatttaaaacaaaatggcttaagtaaaggaatcttaaagagtatgttattagtcagaaaagacagtcttgaaaagctcacatctcacatgacttgactttctaaggaaggagtgcttgagagtggtgagacaaatgactcaaagtcaaatagtgggttataatctgatggcctatgttctgcttgagacagctttccagattgctctctctgtgctctgctctaagacagctttctcttgctattttaaaatctcttggacagctcatctcttgcagatcaaaagcccaatcttttatttacacatcaattcaatcatccaccccaggttcccttttgaatagcccatgaatcagcattccctagctccttgtttcttagacagaaaacacattgtttgtttaccattataaaagaattcataggtctgcctgcctttgttaagcacagacaatgagctagctgggtgggaccctgccctgaaattcctactacttccatgcttgggcctggacctaaacttgctctatctcaagctgaccttgaactcaggaatctgcctgcttttgtgagcacaaacagaaaaatttagctgggtgggatcttgcccttcaatcaccactccttaaatctatttatcttcttccttagtatctttctgtcaagctggctcacagttcatctgtttctgttcttttagatctgtaaagctccttatacaattcatattgcattcttatagtttgcatagttgagaaattaattttgaggtcatatttccagagttactttccatagccttaaaggctgttctgaaagtctcagcttttatgattttgtggagacatagacacacccttgccacctagagtcatgctacttctaattatcatggagtcattaaccttgggagggagaatatttcctgaatgagaaacaagaggttaaaaaaattattttcatacaaacatgtcttacattagccattgacacttgtggaggcccatgctccactggctctgttcagatacttcataaatggaaatcattaataataatggaactaccagaaaggaaattcttacaagttgcacactg

SEQ ID NO: 4990 - DNA, 1200 bp, mus musculus
cccggtgagaacaatcaaaatattgccttcccatgagaggcatacagttgtttctaaggtttggttaaagatcagtgtccctctcctcacagtattacactaaaatctatgtttttccaatgtatttttgctattttaaaaatgggatatagttcttgtagaatttaaactgaatttcagcagtttttgttgcttttgttctgacaccaagtaaccatacatttggttcttctaatgtctcctctgcacagttataaattcagctggcaataaaatgggtcagagtctccagtgacgatctaaggcaggaacagccaggagctcacagaccatagaagtagaagaccagcagagacaggtccttcctgcctccatctgtacccagagggtgagacagttctgcagccctctctgcactggtcttgccaggagagagatggtcttccaggagtgctgacacaggtttacagacctacaggaggaacaagcttcagccagaaactgcaagaacatctaacataagagattaccagatgccaaaaggcacatgcaagacttttaccaacagaaaccaagactatttggcatcatcagaatccagtactcccaccatagccagtcccaacacacgagagaagcaagatttcgatttaaaatcatatctcatgatgctgatagaggattttaagaaagacaaaaatatcccacttaaggaattacaggagaacactgctagacaggtagaaacccattaagaggacacacaaaaaaatctcttaaaaattacagaaaacacaggtaaacatttagaagcccttagagaaaaaaacaaacaaacaaaaatcccttaaataatttcaggaaaacataaacaaacaggtgaaggaattgaacaaaatcatccaggatctaaaaatggaagtagaaacaataaagagatcacaaagggagatgactctggagatagaaatactaggaagtaagttaggagccatagatgaaagcatcaccaacagaactcaagagatagaagagaaaatcttaggtgcagaagattccatagaaaacatggatacacaatcaaagaaagtgcagaatgcaaaaagatcctaatgtaaaacatccaggagttgtacagacactaagagaacacaaatgccagcccaggctactatacccagccaaactctcaattaccat

SEQ ID NO: 4991 - DNA, 1400 bp, mus musculus
tggtgatctcataggatgcacgggacaatttcaatattttttatctgttgaggcttgttttgtgaccaattatgtggtcaattttggtgagggtaccatgaggtgctgagaagaaggtatagccttttgttttcagataaaatgttctgtaaatatctgttagatccatttgtttcataacttctgttagtttaacttcatccctatttagtttctgtttccacagtttgtccattgatgaaagtggtgttttgaagtctcccactattattgtgtaaggtacaatgtgtgctttgagctttacgaaagtttctttagtgaatgtggctgcccttgtatttggagcatagatattcagaattgagagttcctcttggaagattttacctttgacgagtatgaagtgcccctccttttttttttttttttttttttatgactttgggttggaagttgattttactcgatattagagtggctactccatcttggttccgggaccctgccgagtgtattctacacaggccccagacatccatccactttccctgccagaggaaaggggtccgcccggcccgggagtgctttgcctgagcatcggcagcagacatcttggttccgggacactgctgagtgtattctgcacaggtgagactacggaatacagaagctaaaagcttctattacaggcaggagccacagagcttctaaggcagcccccttttcgggccccagacagctggtgactttcccggccagaggataggtgtcagcccgggccgggattgcttggcctgagctttgactgcagacatcttggttccggactcctccaagactattctgcacaggtgagagtgtagaatacagaagctaacagcttctgggacaggccaaagcaactcagctttgggacaggtcctgttttggtccttcgtcttcggccaggagggaggtcctaaggccagatatctgtgcacctttcctgtaagaggagagcttgcctgcagagagtgctctgaccactgaaactcagaggagagagctagtctcacaggtctgctgatagaggataacagaatcacctgaggaacaagctctaaccagagacaaatataacaactagctccaaagattaccagatgatgaaaggcaaacataagaatcctactaacagaaatcaagaccactcaccaccatcaaaacgcagcactaccaccccacctagtcctgggcaccccaacacaactgaaaagctagacctggatttaaaagcatatgtcctgatgatggtagaggacatcaagaaagacattaataactcacttaaagaaatacaggagaacactgctaaagagttacaagtccttaaagaaaaacaggaaaacacatccaaacag

SEQ ID NO: 4992 - DNA, 1000 bp, mus musculus
actaggaccctgaagccgacagtctggaggcccagcagcaagctggctttcgccagccacttttggcctttttctggactgagtagcttgcattttatcttgctggtacctttctcccttataacgaactgcttcctcctccaagtccgtttcttcagaggagctaagtccttcatctgattctgagctactaagagctagccgcttaaactctagtggcaggtataggctccttctcctagagacctccgctgattgatcttttttcttctctttttcttctccttccttccaaactctccccaggtattcatccctgacatgattttttcctcgagttcagacccgtggaaaggcctgtatacttatttggtgcaccatgtttcctctttgttcctgctctctctccccgctttacctctgatagactgtcttgaatttcatccagaattctctgctctgccttaaccacttgttgacatgtgaaaaggaacagaaaggcttctaacgctggagaaagttcaaggccagacatacctcgtaaagctgtaacatgtcccgcagtactggttccgccccgcaaacgagggatctcccttgcgccggtgtgatggtagttccccgggtctttggcgctacttattccgagcttttgtccccgccggcaagaacacactcgggacaaccggaatcttctgcagcaaaagctttattgcttacttctcaggaggaagaccccgaacccggaaaatggcactgcttatatagcctgcagcgtgacgtttcagcacctgatgtggcgtgacagcacctgattagttgctcgctcatgaccccattactacgccccgagatgggcaatgactgggcgtgaatttactcttgcacttgtgcataaggcttgtttactagttagacgcagtggaagccagggccatcttataatggcgattgctcacggcacagctctccacagttccctagccatggtttttctttt

SEQ ID NO: 4993 - DNA, 1000 bp, mus musculus
ctttggctggttttattccttgaaagcagttttcctgagcaggactccacagttctggcatcacaaagatcttggggtctctgaggcaatctcagtgttacagtttcttgttccagggtctaggatccacacatgatcttctgcgttcctccaaagagatcgggccacttctccagctctgccctctgtatcactctaagctctggttgactccactctacttctgctgctgttcgtcctgctcatcccatgggactggcatcttcaaaatgctgggttcttctgttgcaactaggcttcactgatagcctcatttatgctcccttcatggtgccaagcctctgcaggacaccttcatgccttcaaaaccagtaccacctgggtgattcttacatgtgaccaagttcagctgcaacacaaggtacaatgtggctatctctggaacacagcttctttgtcctctcagaaaacacttcctagaagatttcatctcagtgatgctggtctcttcttcatcacttctaatctcttagctacagctaacaagcatcaatttttccagtagccccttctatttttgcttctaaagccagagccacatggacaaagctgctgggttctgctgcttgctgggcctgggacatggccccttctattacattatcaccagttttctcttctccaactcctttactgcctcagcttggctgtcctgaactcagagatctggaggctctgtatccacaggcctagacctaagcttttcttcatctgcaacttgttctgtatcaggatggacttgaactcagatgcttgatgctcatctcctagggtttaaaggcatgtaccaccatgcctggacctatgctttccattttatatcttatattgaaaaccaagagtagcaatcacaatccattccttgtcaattttaaacatacttgtatctccttatgtcaatatgtaaacaataaccaggtttctttcctctgtgttcttt

SEQ ID NO: 4994 - DNA, 1600 bp, mus musculus
tttttcgttttttctgagatatggtttctctagccctagctgacttgtaagccagggtgaccttgaacgcagaaatctgcctgaggttaaaggtgtgttccacaattgccccagctctactctaattctctttttaaaaatgtgtgtgtgtatatatgtatatatgtatatatagaagtaatattaatccattaatatctgtttcctaaaattcatgtctctctctctctctctctctctctctctctctctctctctctctctttcttaaatttattcttttcatacatagtttcataatgtaagcagccctggccgtcttgaagacactttgtaggcctcaatcctgtaagagccttcctctgcttatcaaatgctgccatgaatgttgtacctcactatgactggctgagattctcaccttttcttccccccccctttctttttatgattctatctttggccacgcagtggtggtggtggtggcagagggaggtggatcactgtaactttgcagctagcttagtcttcagtctgatttactcgaaaggagttccaagaagactggttatatttttcatttattatgcattttaattaaaatttaattaaacccaaagaatttagactgaccaattcagagtctgccatttaaaagcataaggaaaaagtaggagaaaacgtgaggctgtctgtggatggtcgaggctgctttagggaacctcctcaccattctgcacttgcaaaccgggccactagaacctggtgaagggagaaaccaaagtgacctgaaacaataggtcacatgaaggccagccaccatcttgttgtgcaggtggtcagttagcagacaagatagctgacatgcacatgttgtctttcatcttggtgaggtcaatgtgcaaccgagtgacaggacaaggaagtagacatgcagacaacagacatgcaggtgcaccacctcccttctgtgtttgtataaaacacacacaaaaattttcattatttacagtaagccttaaaaagcactctgacagcctcgcatatatctacattctatgtgattagaatttcctttttttgttgttttttaatttattctcaagagctgcatggtggtttctcctaggttctgttgctctctcctggcatgcaggtatatacacagcagataaagcacaaacacacatttacattgaaaaataattgtaataagaatgaaagaaagaaagaaagaaagaaagaaagaaagaaagaaagaaagaaagaaagaaagaaagaaagaaagaaagaaaggaaggaaggaaggaaggaagaaacaaagatcctaactttggcccggctgtgtgggtggcagaaggaggcaggcaggtaggcagagaggacctctctgagtttgaggttaccaaagcctacaaaggaagttccaggcagggatgccagggctacaccgagagaaaccctatcttggggaaaaagaaaacaaaagcagaaaaagttctggcttttactttcagacatatgattcttctagtactattgactatctaattttgatcatgaaggcacattggattttatgacagtgtgtgtgtgtgtg

SEQ ID NO: 4995 - DNA, 1000 bp, mus musculus
aatctgaatcttacttttcacatttgttggggtatccaggacttgctgtggtgggagtactgggttcagatggtgccaaatagtcttgctttctgttgataagattctagcatttgccttttgccatctggtgatctctggtgttagatgttcttgttgtctctggctggagcttgttcctcctgtctgtctgtaagcctatgtcagcactccctggaggcaagcactcccctggcaagaccagtgcacagaaagctacagaacagccccacctcctgggtgcagatatagtccacaggaccctgtcccagctcctctgctgcttctagagcctatgacctcctgagcacacgcaccctagagaattggggtctcttcacctctgcaatcaagctctcccaataaacgtgtgcagaaggatcctgctgcagcgtcgttcttgctggcgagccagggcgcgagcaagagaacagattttgcacatggcctgacccctgtgagaacttttcttccccttccatggtctcacttcatattgggtggtgactatacctttttatttgcaaggggacaatagctgactcatggtcaaggtgccagagattcccaggtgaccaagggtggcttaagagtgtgagttatgatttttcattacagccgccttccttctctgccaaccaagggcctatatactcagtcttactctccagtccagtgagctctgggagttatattagctgttttcattgaaataccatctgggcttttgcagagaagggagaattccgggcaaacagagggctgaactttgcctccctaggtaccagggtcagatgccagacatggcctgctcatgaccgccatctttgctgaaaccatttctgtgtttataaattcattatatctgagaattttcatatagatgttttattttgtcttattttttttctccaccttgtcctctggccatggccttttaattttcttttgccttttaatt

SEQ ID NO: 4996 - DNA, 1200 bp, mus musculus
ttattcataaagctagttcataaaatcatagctaggctagatggcaatgtggaaatcacactttgtagataaacatggaaagcactggatttacataagaggtaagtaggttcttgacttaagatgctttaagattagagtcattaagactgagagcaggcagggtctgagcactcaccagtgtatacttgaagttcaggactcaacattgggggacaccttcccttaataagtacttccctttcttttccttctctactctgtgatttcattgttatcatgggtacattgtgccagatctaaagtacatggttgctgctctgggacagggctagcaggtgtggccttctacaagtgtcaatgactgctgtgggtgtaaggcttgtttgtgtaataatgtacaaattttatgttcctccttcaaggaatgtcctccctccctgcttacgttaatgactccatgacagcagaagtctgggaggtgaggtgtggctaatgtttcagcaaaatggtaaatgttaggacagccctctttaagctgaggctggcccttgacaagtcctgaacaaggacttgaataccatcttcagctaggagaggtgttctgagagaaggggtgtctgggagtggcaaaaacaaagggctcaaagtcaattggtgagtccaagctgacacccgtgttctggtcaagacagattcctagagtgctttctatctgttctgctttttcctgcctgagacagtctaggggaagtctagattgccagtcctgtagggtacggaatactgcctgtcaacatgcctactcactggatgtttgctctgtgcctcctcgtgtgaaaaaggaggaggtgtgttacctgcacagatcagatttgctcctttggtcatagatacagccctagatatcagagaatgccaatttcttgaaagaacagaattagtataaatgaagagaccagctggttctgaataaagcaaataaagtatagttcagaaaacagaaaataattttaaacatgttcttagtcagattgcacaggtctgccatcccagcagggctgaggcagaaggattgcaagtttgatgccatcttggggtacacagctagatcctacctcaaaacaaatgagcaagtaaactaaacaagcaaggtggtggagaatcccaaaatttccttttggaattttcagaaaaaaa

SEQ ID NO: 4997 - DNA, 1800 bp, mus musculus
acagagaagaagtacattcttttgttttaggatgaaatgttctatagatatctgttaaatccatttggtccataacttctgttagtttcaatgtgtctctgtttagtttgtgtttccatgatctgtccactgatgagagtggggtgttgaagtttaccagtaatattgtgtgaggtacactgtgtgctttgagctttagtaaagttacttttattgttgtgtccaactcgaccagcaaggaaaacgcaaccaccagttcttctgaatgcagtttacttaggcagcttctctcttcaactccccccgagcctcggggtacaagcattttttatgcactcaagccacaaccatgcctcaaccaatcaccacaggtcacatcacctcaccaggcaggcttgctcagccaatcagggattaagggcaagccattcaccaaatatgggcttgtttactgcctggcacagatttccacccgggctagccagggagtccggaatggcttcccacaattcccccttttatattcttttgaagaaagctccatgggtgaagatagaggtctgatacccagtgtgcagaaataggggccatgtacaggattgactcttaggctcacaggtttttacccagagcaaccctgacctgctcctgtgccgtttttcctgggggaaggacactaggacactcaaccctcatgcaatcagacatacctcccagagattgtcaaacagcttccagactaacctctgtgtagtgcttagccttacaaccctatggagtgatggcttcattgttcattcttcatggcagcaagccaaatctgaggtgactgccctgcttccactgcggcaaaagcttgtgccactgtggcggcagtgcgaacctgggcattccacaagcgacacatacaccatacacacaatatgcatgccaaaacaagggccacagtgagggcacctatcccagcccattctttcccagtgccaactcaggatccacatgggtagaattcacagtgacaatcgccgagtgtagctcattcatcttgccatcaaaatttctaatccaatttcttaacaggaatttcttaacaggaagcatcatgacgaagaggcatcggcttgggaaacactgacagtatcccccatctgggttccgcacccatcaggggcagacacatgctcatcaccagcaagatcagcttcttcattttgacaatgtcgcagtagccgctctggaacccacactgtgttgcgcgcactcaactggccaggaagaacgacgctgcaacaggatctttctgcacacgtttattcagtcctgtttcttcttgtttatatctcccttgtttatatctcccttgtttatatctcccctgtttatatctcccttgtttttatatctcccttgtttatatctcccccgaaccctgggcctctcactcttttatactctcagttcccatccacgcacagcaggccacgccacctcaccaggcaagcagcttcagctaatcagggcagcaggggcaaatttccatcaaattggattcacctgtatcctggtacacctgcgcagcactcaagatgtttgtgtcttatatgaggaagtcaggtgcaagtcatatgacttagctgcagtccctggcgcctttgggactgccgccacacctgctcctaacatctcccccttttttcttttctggcagagagaatgtctgtagatagccccccgcagccatgccccttacccgtccttgggtgacaaacagcattggtttgatccctgtcttaggttggt

SEQ ID NO: 4998 - DNA, 1000 bp, mus musculus
gctcacctctattttatcgaggtccttcccaaactcctggggtcccaagtttcactcaccgtgaacttaccctgccagcaaccactgactgctgaaagttctgaactcggtgggggagtcggttccccgtacgggccaccaattgtcgcgtccgctctcgaccagcaagaacgacacgaccaccagtccttctaacagcagtttattcagtcctcatctctctcttcatcagtaccgttccccagctgaagagttctgaatccacaccagatccttctcaacagtctgttttacgggaacactttattaaccactccttccccgtgatgcagttctgaatcctccctgtagcagggggtcttcgcttgtgcctgaagatgtttcttgtcccgggttttctcgtctcgggatttctcgtcccgggtcttctcgtcccgtcccgggtctcagcaccaactgttgcgcgcactcaactggccaggaagaacgacgctgcaacaggatctttctgcacacgtttattcagtcctgtttcttcttgtttatatctcccttgtttatatctcccctgtttatatctcccttgtttttatatctcccttgtttatatctcccccgaaccccgggcctctcactcttttatactctcagttcccatccacgcacagcaggccacaccacctcaccaggcaagcagcttcagctaatcagggcagcaggggcaaatttccatcaaattggattcacctgtatcctggtacacctgagcagcactcaagatgtttgtgtcttatatgaggaagtcaggtgcaagtcatatgacttagctgcagtccctggcgcctttgggactgccgccacacctgctcctaacaacactggctctgtgcgattctgtggaaacatgcaaacagaccctctcgcctaggccaacacgggatccgggccattccatgatcctgtaagcacatccttccatttagcataccccagtttactg

SEQ ID NO: 4999 - DNA, 1000 bp, mus musculus
cttagcccatatcttctccggtatgaatttcctttatcctttaattattccatggagctccaaaccagcagtgcctcttccaaaaatcctttgccgtttctcagtcccctgttggttcgccaaatgttgtgtctggccagtagatcacaacctgggttctagcctggaaaggcattttggaaacctggaagagaagaggggctgggctgctcaagataaggaaggaaccaagacaaagctctctgctcaaggttcaatttttactatttcggcactccattataaaggaagggaaaggggcccaattcccgccaaataatcttggagtccagtagcagggtgatcatgtggcagcgtcgagaacagcaaagcggcaggttccagcagtaggcgtggcagaaagattgagcgggcagctccacccctgagcaagcaggtttcaggctgggggaggggagactacaattcttaccattgtagcttgtatttatgagatgtatctacgttgtagttgtatctatatattcatcatgaatacatctacatattcagtacagccttccttgtctgttgtcttcagctctctgctgggatgatttggctcttctgtgactactgcttgggaggattctattctttcagaggctaccttctgagttagtgaagtctctcctcgggcatccttgctgcctccttatacagcacacagacctgccagcgctttactttctatccccgagactctctccacttaaaaactccctttagatgtcctgctatagttgactggaaaatgtcccacaggctcctagatttgggtgtggcccctacttggtgctactgacttgggggattgtagaatctctgggtcctagcgcctggctaggggatgatgtaactaccaggcttgggacttgagagctccaggccattcctctaccccagatcatctgtttctggtttattacaatgtaaggaaacacccgaccccctgcccccc

SEQ ID NO: 5000 - DNA, 1000 bp, mus musculus
tttttttttggctttttaaaaaaatgtattttatttttttcttactcactttacatcccactcactgcccccctcctggttaccccctcccacaatccttccctcattccttctccccttctcctctgagtgggttggcccccctgggtaaccctttatacacaccttggcacttcaagtctctgagaggctagacacttcctctcccattgagaccagacaaggcagcccaggaagaagaacatatcccacatacaggctacagcttttgggatagccctcggtccagttgttagggacccacatgaagaccaagctgcacatctgttacatatgtgcagggaggcctaggtccagcctgtgtatgctctttggttggtagttcagactctgagagtcccaagggtccagattagttgactctgttggccttcctgtggagtttctatctgttcggggtcacaatccttcctattgttcttccataagagtccctaagctccatccactgtttggctgtgggtatctgtatctgtctgagtcagctgctgggtagagcctctctatttgcaagcataacagagtatcattaatagtgagagggattggagcttgcccatgggatgggtctccatttgggccagttattggttggccatttcctcagtctgatccatctcccatccctgcatttcttgtagacgggataagttttgtgggtgggttggtgtctttatcactccactggggtttctgcttggctacaggaggtagcctcttcaggttccgtatccccagtgcagtgagtcacagctaaggtcacccccattgattcttgggcgcctcccttatcccaggtctctgtctcgtcctggagttgaccccccccccagctcctcacctccatcagttgcagatttctattcattttcaccccactctcaccaattggcaggacatccagataaaaactaagcagagaaataatgaaactgacaga

SEQ ID NO: 5001 - DNA, 1200 bp, mus musculus
tgaacagcctctagtgagcaggagccctaagcatgcctcagatgctgggacaatcctgaaagtgagaccaatactcttaggaaaaaaagtggaaaatcggtagtgctcaaacaagcaaacaaaaactaccaaaaactacgacattaacaagacagtttctcccagccccatcatcattactcccgttagttcttttgacattaacaaacatggttacagcaaataataagacgtatcttataaattaatgtcttaaattaatgtttccaaggaaagttcaaagttaaataggaacaaagtgtgttttcttttatgctaagctccaagcttcccttatcattaacaaattgcaataattttggaaataatcactgtaacaatccaaatcttcattaggttaagtgtaagtaacatctatcgagggccaggacatgcatggcctctgaaagacagaagaaccctggcaccaggtggacacatttcaagcctgaactctgcagttggaccccctagtactctgatgtgatagagatgtggaaaaaggtgggtggtgaaggtcaaggtgagagcaggaggccaagcagagggcagaggaagggaaccatatcttaagactaggaagggactgaaatggggcagtgggcccgttggtggaaggcaggaaatccctaggccaactcggggcagaaggaaagtgcttgaaggcaggaacccagggggtggaagagaagtggggaggagacagctgaaggactggagctgctgggaagagggtgagaggcaccacagtggagaccaagagggatgggagagagatgagactaggggggacccaaggacagaaaggcccgaagaaaatccagactgtgagcccgacctcagcgcacgccacggagactactcacctgcagtgtcgcctggcacccaggtgcccgcgtgcttcgttgctaggacaccagtaaacacccgcccgccgcgctggaagccccagcctgggaggaaacactgagtgactccagcctctagtcgctgctgctcagaacccagagccctgcatcttgaaaacaccaggattcttccagcagcctgcagagccctagggctcatgccagctcagtctaggtacttgggagcagctttggaaatggaagagagggcactcagaaaagagacattagaatatcctgtgatgtttcacgg

SEQ ID NO: 5002 - DNA, 1000 bp, mus musculus
caaaaaaataagctacagaatactcaggatacagtccacagaactcaaaaaggttaacaagccgaagggcccaagtgaggctgccttaatcccacttgggaagaagaaagcaatcacaagaggaagaaggaagggagggacctgggtgggaaaggggacaaagaagaggggaaaatgatcagatattgggtgggggaaaaagactgaagccttgagggccagcagaaagaatggaaacaggcaacctcaggaggtaggaggtggggggagcctccagagatctgggaggtgagagactctcaggactcaaagggaggaaccttagatgaaacgccctacagcggggagagggaacttgtagagtccacctccagcagacagacagggcatcaagtgagggatggggttgccatcccagagttaaaaactatgaaccagaattgttcttgtttgaaagaactgcagggacaaaactggaggaagagcctgaggaaaaggaggtccagcaccaagcccaaattgggatctagctcaaggggaggctcccaggtctgacactattactgaggctatgaagtgctcacaaaaaggggcctatcatgattgataaggggccctcagaaagacccaacaaacagctgaaagagtcagatgcagatatttacatgtaaccaatggacagaagctgctgaccagtctggttgaattaggaatggctgaaagctgaggaggctgaccctgcaggaggaccagcagtctcaattaacctggacccctgagatcgctcaggcactgggccaccaaccaggaagcatacacagctgatatgaggcccacaacacatatacagcagaggactattgggcctgggttcagtcagagaagatgcacttaaccctcaagagcctggaggccccagggtatggggaggtctggtggggtggggggtaggggaggtggggacatcctcatggagataggggtggtgggaggtatggga

SEQ ID NO: 5003 - DNA, 1200 bp, mus musculus
aaaagttaaaaacagcaacaaaaacatcgaagcaaacaaaagaattaccatagtcttggtgtctctttacaacaatagaactgctagggcagtatgcatatgagtatttatgtgcatgtacatgtatgtatgtatgtatgtgcatgtacatgtatgtatgtgcatgtacatgtatgaattactgaagctttatctatgctcatagtgaggacattcatgttattggttctgctttcaagttttcatgaccattgtttgtgtttgtattatgtatctgtttctctttgtgagtgtgtttatgtgtacatatgcatgtgtgtgtataatctactcaagcctcatacatgtttatcagtgagtatacatgcttccttgtgaggagcgggtgcggctgctgccccaagatggtgcccaggacggctgccaggtcttatgacctgcacctgacttcctcattatctcagacttagccacatcccagctgcctgcactgcgcagatgtcagctcgcctgaggtgttgtcacttgctgtgaacctatggctgtgtgactggggtgattgggaggagtcagtagggtatttaaggtgctccccggggttgttcaggggattcctgttcctgcattgcaatgctaagtgttactgaataaacctgcttgaagaaggacaacgtggtgttgcgtctttcctgctggtcggggtggatgcgacacttcctttccttgctttttgatcactatgccctgtgatggttccagctacccgaagtgtgatgtgggtcacacaggaatttgcagcttccttacatcaatgcctatgctatctaatctaactctcttagaagaaaacccctgagtgcacaagacatgaacagagtcagtgtcctttattataaagcactgtagattcctccatgtggtttactgtcaattccttctgcaattcagagcccagcctgtggaacacagtgtttagcatgttattttaagcagatcagtataggaaacatgctgaaaactcattctgaacactgcttttgtgaaagacactcaagcagcgggagagtgaaaacttgttggcttttagtgccttcaagggcctgcaccaaaccctgtgaacctggccaagtttccatctgaagaggcttctacctttaaccctaagtattgatatcttgggagatgacctaactattctgg

SEQ ID NO: 5004 - DNA, 1400 bp, mus musculus
actttggatccatagtgacagagataataagaaataaccaagaatctaatataaaacaacaggacatagtacatgatctaaaaaaaaaaaacctgaacgggttagaaacctgattttgacacaagaatcacaaccatacactggaaacaggagtagcaataaatggtgctggtatagcaagacatcactcgcagaggaatgaaatagatccgtatctttcaccctgcaggaaaccagttcaaaacagatgaaagacttggatttaaaacttgaaacaataaagttgctagaggaagagaatgggaaaacatttcacacaaaagcactgaaggaactctctgacaagaacttcaatggcagggtccatctggggacacagctagcagaggtgagctgtgatctgtctcctgacctccatcatctggcccacaactctctctgccttcccagggtggcctgtggtggtattccatgaacatcaaggttagatcccctccccaagaaagtctctgcctgctggatccacctgggacactgccagcagaggtgaacagcttgcctttccctaagatccattgttaggtccatggctctgtatgttgacatcagaaacatcctgccaatagcaaggacaaccagagagttaacagacagtataagaaaataatcaacaagagcctggaaaatatgtcatcaccagagccaagctctcttgcttttagcaaacccttaatatcttaatacagccagaggacaaaatgatgatcttttttgtttgttttatacgtcatttatattctttttttttttttttttggtatttatttcatttacatttccaatgctatcccaaaagtcccgcacacgctcccccacccactcccccacccacccactcccacttcttggccctggccttcccctgtactgagtcatataaagtttgcacgaccaatgggcctctctttccactgatggctgactaggccatcttctgattcatattcagctagagacacgagctccggggtgggggggggggagggggaggtactggttggttcatattgttgttccacctataggattgcagatccctttagctccttgggtactttctctagctcctccattgggggcactgtgatccatccaatagctgactgtgagcaaccacttctgtgtttgctaggccctggcatagtctcacaagagacagctatatctgggttctttcagcaaaatcttgctagtgtatgcaatggtgtcagcgtttggaggctgattatgggatggattcctgggtatggcagtctctctagatggtccatccttttgtctcagctccaaactttgtctctgtaactctttccatgtgtgttttgttcccaattctaaga

SEQ ID NO: 5005 - DNA, 1000 bp, mus musculus
tcctggtaaagttgacagcatttttaaaatgtagttcacctccttggccctgaagataggaagtcagtgctttttagtacatccggtagtcctgcccggacctgcaaagcccagcgtgctgccttttctggagacctaatttcattggagaagcctgtgcttgttcttagaaatctctgggtcactcctccacagggtccaagcttctgaagaggcttgacaatgtgtgtgctgtagagaacattgtcccatgtcactgctaccctaagctacacagtgtgcctacattttgtactggaaatagttgagaagtgttaatcactctcatacgagcaaagctcctagggagatattgtggtacatacctataatcttattagcatttggaaggtggtggcaagaggattagccatttaaaaccagttttagcaacatagcaagtttgaggctagcctggtctacatgaaaccctgtcttaagaacaaaaaaaaaaaaaaggaaaaaaaaggcaaagtcattttatgtatgttcactcctgtcctagacaaaggttgccttaaggaaagcagatggcccaggtgcatccacgaacatccttaatcccagcatctgggagacagaggcaggaggtcgatatgtgccccaggctgactagggctgcaggcaaggccctgtgtctcaaagaccaacaaaaggcagcagacctcagtgtctcctgcacttacctttctgtttaatgatggtaaaaggcccttgggtcaggatcaacattttgttgagccacttttgtatacatttattagagaagtggcctttggaaggaaacaggagctctacggctatttgtcattcacctccaacatgcagcagtcatcttggggaggtgttgcttagtccctggagcctcactacctgttggctgcagtgtcgagcttcctggtaccatggtgcagcagggtgccatggtgcttacactgttctgtgcagcctcacagcagcc

SEQ ID NO: 5006 - DNA, 1000 bp, mus musculus
ctaaagacgaccatgactccatggacagactgcatttctgagttggtttggacacaggacaggtctgagaaagtcatttgtcctatgctcagacacttgcttttgtttgtgttgaactgatgtgaagcaggtgatgagaccaagtgcctcagatcagggcttgagtgctctctggttcgaggaagcagatatcacctgacagccaagaggcagctgcagagttcagcctcaggtagaaacttgggtaggagccttgggtctaaggaacattgactaaggacatccctggaaagtgtagcatagatagctcttcctgctgttttcccaacaaggacaaaaggaaatatgtttatacatggtgtgaatgagtcaaggatggatgagatagagctccctgggaaatgcggatttcatgttatccatgagcacagagggtaggcagcttgtctaccagagaggaagaagggacctcagctcatttatcctgtttccaacagggaggtggtgaagaaggggcagaacaagccctggacgaaacctgctactgtaaaaggtaggcttctgctttcctgtggaaagaaattccacctggcttgccccttagcgatgaggttcatgatgagagccatgattctgaggacatgagatgcaggaaggaaaatagtatcaaggaatccccaggttttgtgatagaaggaatctatggttggctggggatgagtgctgcccatgggagtgttgttcaaggcagtggagtgttgctgtgctgtgtctgggggactccgaggtccacctgacagaaggtggaattctcccatctacatttcgctttcagatgactgatcctgtgctcctcacagtgtggtatggggaatgacaggggctgagggaggagcaaggaaagtgtaaatggagaaatgaggtccctcaattcccctcgctcactttcagtgttctgtgtccttggagaatggtgcttgagattacaatcatagcatgg

SEQ ID NO: 5007 - DNA, 1000 bp, mus musculus
gttagaaagttcaaggccagacgtaccttgtaaagctatacttacgggtaccttgttccccagctgaagagttctgaattcacgcagttgaatccttctcaacagtctgttttacgggaacatttcattaccaccgttccccagctgaggagttctgaatccaggctggatccttctcaacagtctgttttacgggaacctttatgaccgtgacccgcagttctggttccagaatgaaggatcttccttgcaccggtgatggttaactcccgtcccgagttttcttgtcccgggttttttcgtcccgggttctttcttcccgggtttcggcaccaactcttacacgcgttcgcgaccggccaggaaagacgcagcaaaccagaatcttctgcggcaaaactttattgcttacatcttcaggagcaagagtgcaaaaacaaaagcaaaagcgaaaccccgtccctattaaggagagttatccttcgcctaggacgtatcactccctgattggctgcagcccatggccgagttgtcgtcatggggaaggcagagcacatggggtgaagaactacccttggcacatgcgcagattatttgtttaccacttagaacacagctgtcagcgccatcttgtaacggcgaatgtgggcgcggcttcccacatttcctaattgctttactcggctgagtgcttgtcttgaagtgttctaatgtcactgggacatcaggggtgttctgtaccacttctcctccctccttctggttcagtgattgggactgtaacccagagtcgtacgtatgctagagccccagtccaccccgtcctcatctctgggccttcagctatgaaaactcacatctcagacctctcaaataccaactttaaagaattattttttctttgttaacttttctcatttcatttcagttgcttgataaaatatgatagcaaaatcaagggaggagtaaggagaaacagatgcacccatgctgcctgttt

SEQ ID NO: 5008 - DNA, 1400 bp, mus musculus
ctttttggtttttagagacagtttctctgcatagatagccctggctgtcctagaactcactctgtagaccaggctggccttgaactcagaaattcgactgcctctgtctctcaagtgcagggattaaagatagcgccaccacgcccagcctgtatttctttaaggaaggtactattccctccttaaagtcctatcatcatcatgagaagtgattttagatccgaatcttgcttttttggtgtgatggtgtatccaggacttgttatggtgggagaattgagctctgatgatgccaagtaaccttggtttctgttgcttatgttcttatgcttgcctcctgccatctgaatatctctagtgctacctgcccttgatatctgactagagcctattcttcctattattctgcttctgtcagaactcctcatagtctatctgtctttgggatcctgtgattctgtgatcctgtgatcctgagatcctgggtgtgtcagagttcctggaagtcaagctgcctctgggaccctgagatcctgggattctggcatcctaggatcctgtgaacctggctgtgttagagctcctgggatttgagcatcctcagagtgctgtggtattggcttcagagtttgagcccaaggtaaaccagcacagaccattaggaacctgagccactggtcagacagtggttcctgcatccctggatcctattggtcccaattattcccggtggtattagaacaaattttgtgtcctattcacccctgatcctacgatcctaggcgtgttagagcacctaggagtggagcttcctctgggtgctgtgggactggcagcagagtttacaccccaatgcagtcttttattatggcatgtttttctggtgtcttcatcaaaaatcaggtgtccagaagtttaaggatttatgtcacagttttcaatttgattctattgaatgatgtgtctgtttttatgttgaaaccatgaggcttttattactatatttctgtagtacagctcaaaatcagggttgtaagacctttagaagttctttcattggtcaggatgttttagctatcctggagtttgtttgttttcatttgttttgtttttgtttttctatatgaatttgagagttgtcctctcaaagaattatgttggaattttgatagggattgcattgtatctgtaggtaggatggccacttttacatgagcatgggagatctttccatcttctgatattttctttgatttctctcttcaaagatttaaagattttctcacaattaggagttgtgtccttgttggattaggtgtagtcttgttggacaaagtgtgtgactgggggttagttttggggtttcagatgctcaagtcaggcccactgcctctcttttc

SEQ ID NO: 5009 - DNA, 1200 bp, mus musculus
tttatatgagaaagagataaaaccatttctctctattaaccaggaaaccataaaggaaacacatctcttctgacagaaaaactattaaaagaaaaaaaaaagtcttgctttgtttatgaagacatgtaccagctaggtcctaagagccaaggggaaaaaaatcataaagagatttcccaaagaaatccctgagccaaaatcctttcttaggtaaaaataccatctcaggcacattcctcccctgttgtgcttgcatgagcagatttcttccttgttgaaatcaccttcagaaaatgaatgcagtctccatgaaaagaaaagcttcccatgggggcaagacaaaggaaacaaactaatcctcactttcaactacatttctttgttttagttaggatctagaatgttctggaacaggagtctttgagaaatttcagacctttgaaatataactacaccagttaatattaacaaaaagttttaaaattatgcttttgaatttttactgggaaagtttttatagttcaggagttttccttaaactgtcaagtaattattctttgtaaattccccaacctaactaacattcatgcaaaacatgttctttcctccttcaattcaaaggcatccctgatccagtataattggtcaagccacaagcccatgacaccgctcccacaacttgcacactttggtggtttgaatgaaaatgggttccatagactcatagagagtgacacaattaggaggtgtagacttattgaagaaaacgtgtcactggggctggacttggaggtttcagaaactcaagccaggcctataagctcctctcttttcctgctgcctgctgatctagatgcagaactctcagctacctctccagcatcatgcttctcaccatgataagaatggactaaacctctgaatcattagccagccccaattaaagagttgctatggtcatgatttttcttctcaacaatagaaaccctaacaaagacagatactaatcctaaactctttgtttttattatcttaggggagaatcctacatcctgatatgcaatgtggactcttattttcttttggagttttaagaagatgaaattgctagttataaacccatttagacctacaaaaacagaaattttaccttgctcaactcaagcatggttttgacttgtctcttctagacctgtctct

SEQ ID NO: 5010 - DNA, 1200 bp, mus musculus
actttacagatgagagaaccaaagctcaaaaaggcaaatgacttctgtgtgtattcatgactagtaaacagcgtgaccattaatcaaacctgtatcttctgacggaaaaatgtctgttctttccactatgcaacactgtcttgtcccaagatatgttaaaaaaaaaggttgtttgtttgtttgttttctctaatgtggtctgacaagtttcagagtagaaatagggcttacttagtagacccacttgtgctgactagtcacacattaccttgacacaggttagagtcatttgggaagcagaaactttagttgagaaagtagtaccctcatacaagcctgagggacattttcttgattaatgattgatgtgggaaagctcagactattatagatgatgctacacttatagataatggtcctggatagcaaacagaagcagactgagcaagtgatgaagagcaagccacgaagcagcacttacttacatggtctcacatccaatttcatgcttctggttcctgctttgagttcccttcattgtgttactgggctatgtaaactgaaagaaaccctttcctcctccccaagttgcttttcatcatgatgggttttttgtttggtttgttttggttttgcttttttgagacagggtttctttgtctgtagccttggctgtcctggaattagtaatgtagaccaggctggcttcaaactcacagagatccacctgcctctgcctcccaagttctgggatgtgccaccatgcctggccttgatcatggtgttttatcacagcaatagaaagcctaagtaagataccacttgtgtaaagttatgttgtttttatttagagatttttgttggttagcatttcaagttttgaagtggagacttgggttttactacatttgttatccaagtggctttgaaattgtgagatcaagcatttgtcctaccagttagctaggacaacaggcacaccaaatgactgcctcctgtaatttttttaaacttttggattcagagtagtactcatagtattacagaattcttaaatatgctgttgtatttaaataagcatctgcaaaaactcaagactatgaggatgtcatacaattttggtgtcttagtggttatgtcttagaggtgaaactatttttaacagtatacttagctaatggatatccaatagagttttgc

SEQ ID NO: 5011 - DNA, 1400 bp, mus musculus
tagatggtatctctccatgaaagaaaaccaacattaggagctcattttcagggagattagcctacatattttattgcatgtggcttcattaaatattacaaaaatttctgcaaaactcaataatgtagtgtctccaagtcatagtttgtataaattagagggaatgaaaaatacatgttgggaatacatcacaggctctagaaaacaaatataaaccacctctttcaacaaaggccactgcataaattaaacaaatccaaactatcttcaaagataaaccaatgaagatatttaaaaatgaaaatgactgctatacttggtcatactggaggctccacactgttgtttaccagatattataaggactttttatagagaatatacttaaagtaggtcacaattggaaacaattaagaaatcactctgcatgtgctatctccacacccacctccttccttcttctggctccattgtaaagctaccactccactccagtggcctccaacagacctacctaacaaggagcatccaagttaaatcccttcctattgctttgcctgtctctgggagcacacacagctgctctgagctagctgcatgctgttcctcaagctccattgtctggctaccactcctacagcctccaataggccccatacaagaaacatccaggcctgctacaccaataacatccagaccaaggctgcccacaggagtcctgcttcatggggaacacctgggtcagaactccttccggatacttgttacactggaaacatcaggggacaaccaaatggacaaaagctagaataagaacacagagaagacccagggcaacattggaccttcagaacaaaggtataccactacagcaagccctgtatatcctaatacaaatgaagcacaaaaaatgagcttaaatcctcccttataaagattataaatgcctttaaagaggaaataaattaatccctcaataaatacagaaaatacaattaaacaggttaaggaaatgaataaaactgttgaatacctgaaaatgaaaatagaagcaataaaaacaatctgaggttatcctggagatagaaaatataggaaagagaacagcaacatcataggcagccatcaccaacagaatacaagagatggaagagagaatcttaggtatggagaacatgatagaagaaaatgttttactttattttatttttttaaaatgttaaatcttagaaattcctgaaacttccaggaaatctaggatactatgaaatgacctaacataaaaataataggaacagaaagtgagaatccaagccccgaggaccaaaaaaaatattttcagcaaaatcatagaagaaaattcccccaacctaaagaaagagatacctataaacatacag

SEQ ID NO: 5012 - DNA, 1000 bp, mus musculus
tctttattagacttattctttttttaaaagatttatttatttattatacgtaagaacacactgtagctatcttcagacacttacaagagggtgtcagatcttgctatggatgtttgtgagccaccatgtggttgctgggatttgaactcaggatcttcagaagagcagacaatgctctaaccgtattagacttattcttaaataattaccattggaatgtgcaatttttaatttttattggatattttctttatttacacttcaaatgttttccccattccaggtctcgccttatggaatcccctatcccatccccctctccccctgcctctatgagggtgctcccccatccacccccacactcccatgttccagctcttgcattcccctacactgggccatagaacacccccagacccaaaagctgctcctcccactaatgtccatcaaggccatcctctgccacaaatgcagccagagccatgggtccctccatatactctttggttggtggtctagtccccggtagttctgggggtctggccggtagagattgttgctccaaccatggggttacaaaccctctcagctccttcagtctcttcttcaactcctccatcagggactgttctcagtccaatagttggctgagagcatcagcctttgcacttgtcaggctctgtcagaacctctcaagagatagccatatcaggctcctgtcagcaagtacttcctggcatccacaatagcatctgggtttgatgactgtatatgggatggattcccaggagggacagtctggatgggctttccttcagtctctgctccacactttgtctccatatttttattttcctgagtattctgttcctccatctaggaagcatccacactttctgtcttcttgaacttcatttggtctgtgaattgtatcttgggtattttgaacttttggggtaatgtccacttatcagtgagtacataccatgcgtattctttt

SEQ ID NO: 5013 - DNA, 1000 bp, mus musculus
atcattttcatagccacatttataatttagagatctatctcgatgagttcctggacagacatatatacctccagtgtgtaaggccagggcagtatgatgtatatcactgctgcaacctggatcaatctttttatcacctgtgttaactgctgttaattgaggcatataataatcaggggtgccccaggcggcatctgcacccaatgtgaggacacagatgtctacttctaactcggaccaatggggctcagcaccaatcttggagctggaattaactatgtctccagtctgattttgaataatccaagcatagttaaaaacctgataggtctgggcttgcctggctgtcactgtcatgaccagcatcatcaatattgtgagagatctatccatggcgatcctacaagagaaaacataaaacatctcaggcgccaccctgggtggtattaaatggcttaattagtctttcagggagccatctggctcccccttccttggaattatagatgcaggctgagccttttgcccagatgatgatggggtctggcccattccaaatccctgtaaggggatctttccacagtgcttgagcatactctagactggtcttaggatgccaaagtcggtcagctgctgagcgaccacttatgtctagagttaaaaagttaagcacaaaaagcacatgagacagtagctgttttgactttcctttgagggtgtagatagtctcttgggccccgagcttagtcagggtattctttaaagtctgatgggccctttcaacaattccctacccttgagggttatagggaattccagtaatgtgcttgatctgtaattgtgcacaaaactgtttaaacttaagactgttatatccaggaccgttgtctgttttgataattttgggctgtcccatgacagaaaaggcatacaatgaatgatttataacatctttggtagcttctccagtgtgggcggaagcacacaaaaacccactgaa

SEQ ID NO: 5014 - DNA, 1200 bp, mus musculus
gatttttgtgctgatgctctcttatggaatcttctgcatctgagattctctcttccatctcttgtattctgttgctgatgcttgcttctatggttccagatttctttcctaggttttctatctcctgcgttgcctcactttgcgttttctttattgtgtctacttccctttttagggatagtatgcttttgttcatttccatcacctgtttggatgtgttttcctgtttttctttaaggacttctacctgtttgtttgtgttttcctgtttttctttatggacttataactttattagcagtgttctcctgtatttctttaagtgagttattaaagtccttcttgatgttctctaccatcatcatgagatatgcttttaaatccaggtctagcttctcgggtgtgttggggtgcccaggactgggcgaagtgggagtgctgcgttctgatgatggtgagtggtcttggtttctgttagtaagattcttatgtttgcctttagccatctggtaatctctggggttagttgttatagttgtctctggttagagcttgttcctctcgtgattctgttagcctctatcagcagacttgggagactagctctctcctccgagtttcagtgctcagaacactctttgcaggcaagctctcctcttacagggaaggtgcacagatatctggcattcggacctgcctcctggcagaagatgaaggcccgaaacagggcctgtccctgaagctgttagcttctgtagtccacactctcacctgcgcagactagtctcagagggatccgagaaccaagatggtgcacccaggtgctctgacaaaccctcctggttggggaggccacctctcctctggcagggaaggtgccaggatctctggagcccgaaatgggatctgcctcagaagctatcctgtagggaccttgggggtgtctgctgaatccatgcccaggtgacccggtgctgatgccgacctgaaggaattttgaccctagccaggcgggcttttctgcttccctaatgctgtctcaggtccgggataattggattggaacagaagttatgttccactcaccagtggtcctaagattgtgtggagagtcctctaggatatcttgggagcgttcaccaactccgtgcccaaggtgacccagtgctggtgctaactggaagggattctgcacatttc

SEQ ID NO: 5015 - DNA, 1000 bp, mus musculus
tgaccaacagagttgcctgtcacccaggaagtaaatataccaagtgacaggcagtaagggtctcttggtgtccactcataccaagcctagtaaacgaggaatattacaatgatatacttgagggagcacgtcattagcaagaagcagtcctgtaatgaggtctattgggttatgccacaccacagctcagccatcgcagctgaccatgatggtggcccatctccagggaacacacttccccactgtggttttgctgaatggcatctgccaaggtccaaagtatggtgggccatgcttttaacgccaaaattcaagagacaggtatgcagatctctgagcttaaggtgagtttatagagcaagatctaggacagcaaaacctagacagtgaaggatgaaatagaacaagggagcaatgttccagccctagaaagctgcagaacttgacagctttgtacatatgactctggctttagagtcaagagtagaaggcattactgggagagttaatgctggttagccggagctaagattaagagaccagtatcattgaggtgaaatcttctggaaaatgtttttttgagaacacaaagcagctgtgttccagaggtagaatttctgctggcagccagacttgataatatatgtaagcatgcctcaggttatattggttttgaaggcatggagggatcatggacagcagttgaggctggatgctgtgagacagcaggaaaggtcattggtgaaggtcttgtccctgttacagatggtgaccccaggactgaaatggtcatgcaaagaaggttacatttgatatcatgaagacagcctatgagaggctattggtgaagcctccttgcagaagaatatcccgcaaattcgagatgccagtatcatgggataatcatcaataagagcagcaacaatggagtagagtcagtccaagcctagagtgctacagagggcagagctggagaagtgaccaaatccttttggagaag

SEQ ID NO: 5016 - DNA, 1400 bp, mus musculus
gctttggtttatttgtttgtttgtttgtttcatggtacatcttgttttctgtatctgtgatgattgaaagttcttcttagtagtctaggctggcatcttctgggtctggaagacatctctccagcccatcctctggtcctatgattgtttccaaaacttttgtgttaaaacctttttagatttagcaatttctcctatcatctcttccgtctcttgcattcggttggtgatgcttgaatctgtagttcctgttctttttccggtgttttctccaagcagtctccaggattgcttcattttgtgctttctttattgcttctatttctattttcaggttttgaacaattttcttcatttttttcacttctttgattatattttcctgtatttctttacccaatttattcatatcctctctaaaggcctttatcagcttcatactataagatttaaggtcatttactagtgtttcatgtgcagtaggatattcagggcttactgtagtaagatagctgagctttggtgttgccatactaccctggcttttgttgattgtgttcttaagctggcctttacctacctggttatccctggtgtggcagaccttgtagtccctgatgagagcaggtctctgggattaaggatagagttagatatcctgtgtggcaacaggacttcaatgatgcaggcagtgttggtagtcctgggtgggagtcccttttgggattttggcaaagctttcccctaatagcaacaggcttatggttgtctctggtggcagcttacctcaagggatgcaagcagaagtggtggtctccagtgtctgcagacctcccagattgtgtgtggatccaaagatggaatgaagaggggatgggcagaactcatgctactgagcctgcacagagaccttgcaggcaggtgaaggaattgtgggaatctcacttgtttgtccttggtggcagaagctctctagggatgcaagcagaggtgtagcctaggtttttgaaagcagataggacagggcagagctttctgctgctgggttttcccagaaggtccaccctgcaggaaataaggctaggagtttcacctggtgggtggcacaggtttccaggatttcaggaagagagatgtggagcagaagatgtgctgaagagtggatcactgagacctcatggctgctctgtaatttttttctagctacatgtttttctagaaaatatttggcacacattttatatttaattacactgtttgaactcaaaatttccagtttttctaatttttaacatttctcaaatatttacaccagttttgttcttaagtaattttccttactacttcaccctttcttctctatatatcataataagagctatgtgtttgaagtgtcacat

SEQ ID NO: 5017 - DNA, 1200 bp, mus musculus
tcatattttatttaatgtattttgataatatgtaattttaagcttacaaccaaactaattaacaatcatgcttgaacagtattaactaacagttaagtttctctatcagacaaattgtatccatctcgaacttacaaacactagatagcatttcatgactgtatttaatggttatgttaaacagaaaataatgattagaaaggtgttggaaccgggtttcacctgggaggcaagccagggctgaaaagagaggggaactaggcggttgagagaaaaatggagctaagtcaagattcctgatcaaagctcaaatgtttaatggcaaatgcacttacttataaagggggtgggggtggggaggcccattcccgccaattcttccttggagcctggaaccagctgcaggtgatgtgcaggatagggtgtagtctcctgaatagctcaggggcctcttagcaggtagcagtggctgaacaatagagtgatctagggaggaaggctccacccaaggtaatctccttagtggtagcaaagtcaaggtctggctcagcctgcttcaaggctggaggagtctacagaaaggaacatatgtttgagcacataatctgaatcatatgatagaaagggcttttgttcataccatgagagttaaaaccagtaaatagagcattacattgttcagcctctgacagagcagttatcctatttgtctgtgtgtccctggataactggcaacaaaccaccatactgaatttgggtttagaaataaatttagtaattgaaagtccatgcaaatgaataacccacctacagaaaggatcaaaagtatttctctcattcttcatacctctgaccagtaaatgtgacaaagtccttgctataaatatctttcatctgatcagtgaaatgaaaatataaaagaaaaaagtggctattaaattccatgatcattttcagttaatttaaatatatattggcatatagtattgatctgatttatagtttgtttcaactatttagaactggatagataaccccattaccagctgaaacctgatactgcatcttttctctaccactctactctgcacctaaaacaggcattgataatcaactttacttatctagctctttctctacaattttatcatcgtctacataccccagtttccagtttcagttattttggaagacatatac

SEQ ID NO: 5018 - DNA, 1200 bp, mus musculus
cacatatatatttaagataagtatttaaaatgaaaataattccttaatatttatatttattgatctatagggttgctttattatggtttataaatagccactttaaaatactaattttttgtgtacctataaggtataaaaatataaaactctttatcattcaagatagtttcaagtttccactcggaacctgcacctggagcagacctggggcattggttctgtacctactcctataccaaccagagggatccagactctcaggtgctctgaaatgcccagaatcacagattagtagaccacaacatcttccccaacactcagagtaactggcaccccaggatgcagggacacagaaacctccacccagccagtggcacaggttccttccagtctaaaacctgcactgggagcagacttaggattctggatctgcacccactcttacaatacccagagcgagcctgtctcccagttctctgaaatgtccaggatcccaggatctcaggatcagaaggtcacagaggaagcttgactctcaggagttcagaaataccaaggaacactggagctctgacacattcaaaatcacagctgaggccacatcttttccaacacccacaggaactagggaaacacaaactcccacccagccagaggcatgagttccttccagcttacacctgtacctggaacaaaccagggtctctggcttcccaccaacccctgcaacatgcagagaaagcttgattcccaggagttttgacacaacaggatctcaagagcttggtcacaccaggatttcaggataccagagggaggttggctcccaggaactctgacacacccagaatctcaggatcacagaatctgacatgcacaggatcacagacgcagctggactgtgagaagttctgacacaaccaggatcacaggagggacaggctccaatcagagacagtaagagcaagtagaactagagataaccaaatggtaaaaggcaatcacaggaacataagcaacagaaaccaaggctacttggtgtcattagaacccagatctcgggggttggcgagatggctcagtgggtaagagcaccgactgctcttctgaaggtccagagttcaaatcccagcaaccacatggtggctcacaaccatccataacaagatgatgccctcttctggagtgtctgaagat

SEQ ID NO: 5019 - DNA, 1000 bp, mus musculus
ttaatgtctccagtccattttgatttaagaggacaaagtcaagatactttcatttatctattaaaaacttgtctatctctctacttgtttatgtatgtatgtattcatgtatctatcatctatctgcttatttaatgtagtatattttatccccaatcacaatcccccccttatctcttcacagtccctttcttagaaatccctctgcccattgctgtctcccttcctcctcagagaagggaaacccctgtggttaccacccctacataggacaatctaggtacatcctctcccactgagttccaaccaggtagtccaagtgtgtatatgtgagagaaatccaatggcagggaacagagactgagacaacctatattccatttgttacgggaactacatgaacaccagttgcacattttctaaaaatgtgtaggggatctaggtctagtatctgcatgttctcaggttagtagactctgcacttttctcgtgttcttgactcttcagaatttcttatctctacaccccattcttctaaaagactccccaggatctacctgatgtttggctgtgggtctctgcatctaccaccatccactgctggatgaagcctctcaggagacagttatgctagattcctatctgcaagcacctaaaagtctcattaataatgtcagaggttggctctctcatgtgaaaggggcagtcattggttggttgcttccagagtctctgctccatctttaccctgcatatattgtaggcaagacaagttttaagttgaagtttttgtgcatggattaaagttcccctcctctcctgtatattcttcctggctaaaggaggtagccaattcattctctatatcaccctgtggtaaaattccaagctagagataccacctcctagtagtctctttcatcccaggcctgaagtaatatttatctatatagcttaggtgtgtttcttataaggatgccattttgcatccattatgtta

SEQ ID NO: 5020 - DNA, 1200 bp, mus musculus
gaatactttaattcttgtcaatttcaagctgaatgttgaaataagaagtgagtgtgtggcttatacaggtgtccaaacacctcagaaataggaataactttttaatctgccaaattgacctgtgcttgcattagtttgtgccagtataagggattaatttacattgagctgaattgttatttattgagttagaattcaaaaaaacaattatctgtgtgctgatagtttagataaaatcccaaaattcccctataccctcccccaaccctgttcccctacccacccactcctacttcttggtcctggtgctcccctgtactggggcatataaagtttgcaataccaagggtccgactagtgatggccgactaggccatctgctacatatgcagctagagacacaagctctgggggtactggttagttcatattgtggttccacctatagggttgcctaccccttcaactccttcggtattttctctagctcctccattgggagccctgtgttccatccaatagataactgtgagcatccacttctgtgtttgctaggccctggcatagtctcacaagagacagctatatcagggtcctttcagcaaaatcttgctggcatatgcaatggtgtctgcatttggtgtctgattatgggatggatctctgtgtgaggcaggctctagatggcccatcctttcgtctcagctccaaacttcgtctctgtaacaccttccattagtgtttttttcccaattgtaaggaggtgcaaagtgtccacactttgttcttttttcttcttgagtttcatgtgttttgcaaattgtaacttgggtattctaagtttctgggctaatattcacttatcagtgagtgcatatcatgtgagttcttttgtgactgggttatctcactaaggatgataccctccagatccatccatttgcctaggaatttcataaattaattgtttttaatagctgagtagtactccattgtgtaaatataccacattttctgtatccattcctttgttgaggggcatctgggttctttccagcttctggctattataaataaggctgcaatgaaaatagtggagcatgtcttattacaatttggaacagacctctctttctttttctcttcctctcagccctaaagctaaataatatctaattctttcctactaaaaaatgatgt

SEQ ID NO: 5021 - DNA, 1400 bp, mus musculus
atattagatattttcattctacatcaaaagtgttctattcctattgaaacacattaattcaattgtagaaaacaatcttttaatacttgtctaaccttatccctcagcttataagtatcaaattagaatgtctttggatcaaattgttttggattaaattagattgtgttagagtgtatgttttacaaaaagcagtgtttgactgactgacttgaatttttaggaaagatcaatcaatgacacttgaattgagattgggacagaatccacaaacacttctgaaaggagcataaacttctgccatgtggaaaatatactcatgtgaagcagtattctcagcattgatgattattaaacaaagctgtcaataaattttgaaagagttgagagagggctatgtcctgcactattaagtattcattcaagatttacttcttcatgtggtaggtgagttgcattgtgggtattccatgttctttgcctaatgtccacttatcaatgagtacataccatgtgtgtccttttgtgactgagttacctcactcaagaggaaggaagaccaaagagtgactgcttcagtcctacttagaagggggaacaatataatacagggacaaggaacaaaacagaggctgaaggaaaggccatacagagattgccttacctggagatccatcccacatgcagacaccaaacccagacactatcactgttgccaagacgttcttgcagacaggagcctgatacagctgtcccctgaaaggatctaccagattcttaccaatacagatatggatgcttgcaaataaccatcagactgagcccagggaagccaaaggaagagaggaagaactgaaggagataaaggggccttatctgacatcaatgagagggaaggccattggtcctgtgaaggcttgatgcctcagtgtagaggaatactagggcagtgagtcaggagtgggtggttgggttggggagcacccttatagaagcagggtaaggggtgtggggtagggggtttgcagaggggaaactgggaaggagataacatatataatataaacaaataaaatatccaattaaaagaagatttacttcttcatttctttgaattatctctctcattagtatgtagattcactttcaacactagtaaattgttaattaataaggctagtaaagaactgcttttaaaataaatttattatgtacaaattttgagttttgaaattattatatatacatatttaaatagagtataaaagtttctttggtgaaaagtgttcaatataggacattttctgaggacccatacaactaggtgtgatatttgtctaagttatctaataagtacttcctaactatgttgtttgattcattgctttctaattaaaact

SEQ ID NO: 5022 - DNA, 1000 bp, mus musculus
aagtcccctatattctccactggccctactctcctacctacccactcccacttcttggtcctggcattcccctttactggggcaaataaagtttgcaagatgaaagggcctctcttgccaatgatggccaactaggccaacttctgctgcatgagctctgggggtactggttagttcatattattgttccacctataggggttgcagaccccttcagttccttgggtactttctctagctcctccataggagtgcctgtgttccatgcaatagatgaatatgagcatccacttctgtatctgccaggtactggcatagcctcacaagagacagctctatcagggtcctttcagcaaaatcttgctggcatgtgcaatagtgtctgcatttggtggctgattatgggatggatccctggatggggaggtctctggatggtccatcctttcatctcagctccaaattttgtctctgtaactccttccatgggtattttgtcccccatcctaaggaggaatgaaatatctatgctttggtcttccttcttgattttcatgtgttttgcaaattgtatcttggatattctaaggttctgggctaatatccacttatcagtgagtgcatatcaagtgagttcttttgttattgggttacctcactcaggatgatatcctccagatgcatccatttgcctaagaatttcaggaattcattgtttttaattgctgagcagtactctgggtcttgatgttttaatcacttaatattttaaatgtcagtctactggagaaaaccagtggaaaaactttaaggcctaagcattaccacatccagttttttcgcttgttgttttttttttttttaatgtgcacttggggcgggggtaggggtgggggtgggcactcttactcaggtctttgtccttgcaagacagacagtttgttgactgagccatcccttcagctttcaggagaacttttgtcaatgatccaaggacttg

SEQ ID NO: 5023 - DNA, 1800 bp, mus musculus
tggaggtggctcagtgggaaagaacacttaataatctttcatttgacctggatttggctcctatcacccatatgatcctcacaactatccctaccttcatttctataggatttatgtcctcttctgcattctggtaggcataaataaaacatggtatgcatacatacatacatacatacatacatacatacaccaaagcactcatatataaactatacttaaaagataaatttagggaataatttaaacaaaacagaaatagtatatttctttgattaagaaagtaattaaaatgtaatcaaaaactaaaatttatcaaagcaaagttcactttatcatgaaattgaccacctcaagtgtagaaattcaaaagtcctatgaaagtataaatattaatcaaaagaagaaaaattgagaagtttatatttaattagcaaaggaaaccagcttttatagcattagatataccttaaaaacttttatccaaactaaattgacataacttgttgccctgtcaattaaggtcaaagactaccagagtgaaaaagcagaaaacttcattggtagggcttcctcttctttgaccttgactagggacttaaaaacaaagctacatgcagactgttaggtagccatagttaaattacaggttcaacttactttctctggataagaaccagttcagctagaacctgagattcctgaaatgtttcgccatactaatgaggcatttttgtatcctcagtcttcttccaataacagttgcctaacctggatgattatatcccatcccacaaattacatgagctctgaatcatctcaagtaaagttcattgtgcctccctcaagctggtcctgggagtcttctttactgtacagactcacaagacttccaggtgccatttctgccatctctgctctcttggcacttaggaacccatataggctgacacccataagggcaagcagagtcccagaactaaataattctcctgtttgaattgtattaaactctcttcctcacagttcattgtcttaacaaaaagtcttaagatttactttcaattttgttatttcaaaattatagtaattgtgcttaggcataacatcatgaaataaatggttgaattgaattgtgcataattttagaaaagtattatctctgatgaacacctaagtagattccatactgtgaacacagtgaaacaagatactatcttgacataatgaatctcttgaatttggatatattttcaaaatctgtattagtggttcatgtagtgatatagttttaaaagagtatgaatacatatgatgcaaaatcaatgtgaaattccacataaagataaaaaacacagttattgtgagcaaaaagaagtaagccagtggctgaaaaagctcaccataggatgacttaagcctctgttatctgatttcatctcaaagtaaaattgtaacactctcttatgaaattattgctgtgttaataccgaattgtagagtagaatcatgaaagtattttgggaagaatgtcttaagaacctgatgaaagatttattccttatttcaaacagcaattaaattggtttttgcaaaatactgatatttggcctattgcgtggcaaacattttaggcaaaattgatattcattatgcaaaagacaagttgctacaatttgtctctatgcatacttttgtatttcctgtaaatttatgcatgcattccataaataatgcatctactgtatgtataaacaactcatctataggagagaaacatatgtaattgtatcgcatgtt

SEQ ID NO: 5024 - DNA, 1200 bp, mus musculus
gatttacataaaatgccaataatttaaagacgcttagtaaatagaaatatttcaaatgtcaaataatagaattacatcaattattaggatattagtaggaccaccaaaggcagcctggtttctggttgagctaaggttgcaaaccctggtgacactgaagaatggcaatcattttgcctggtttccagacactaggctcctgacacgaggctgcagccctccaaagacttgtggccatcagtcgtttaagggcaatgccccaagctcctccacaggtagaagatgtgaccacagataaccttaagacagatctccattttaatgaggtacctaaagacctggaggcttatccaataaactcctctttccctacatgcctccctgcaaaatgtatataaccttatcctgcccctgagaagttggatacagacccattcactttcctccatgacaataaatgtgttaaaactatggacttcctcttttcattgggatccattctggggagcaatggaagaggtcttcgcctaagaacctgctgtctaatctctcagagaaggcctctcatcgctcccagccacagtctctaacaagccaattcaaggactctatcccatggaatccagccagaggaccccctttccccttcaccccggggctagatccagccttttgggtgaccccactctgttctcagctctcctgctgcatccagcggagtctgcgtgccctgtgagcctgagaaccagatgttccaggtctccttgaagacccggggacacccaagccagcttcggctggctgcagttaagtgcaaactcctgtgtttcacctccctgagctgcctagcccattggcagagcagacgcaggaaaccacaaaccctacattactacttctatatgtcattgagtacaaaggttaattaatcaaaataatttgaaaaaagtaaatgtgagttagtttgggaaagaaaaatataaaacaacatgcaaagcctgaggtacaaacagaatgtgtgtgtgtgtgtgtgtgtgtgtgtgtgtgtgtgtgtgtgtgtgtgatttcaaggagttttaaatatagaaacgagcttaatagttactttagactctacatacattgtcttagtttggattattattcttgtgatgaaatgccacgactaaaagcaagtaagttaaggaaatatttatttta

SEQ ID NO: 5025 - DNA, 1000 bp, mus musculus
caaacgcagacactattgcatatgccagcaagattttgttgaaaggaccttgatatagctgtctcctgtgaggctatgccagtgcctcacagtggatgcttacagtcatctatagaatggaacacagaacccccaatggaggagctagagaaagtaaccaaggagctgaaggggtctgcagccctataggtagaacataatatgaactaatcagtaaccccagagcttgtgtctctagctgcatttgtagcagaagatggcctagtcggccatcattgggaagagaggccccttggtcttgcaaactttatatgccccagtacaggggaatgccagggccaagaagtgggagtgagtgagtaggggagcaaggaggggagagtttataggggacttttaggataacatttgaaatgtaaatgaagaaaatatctaataaaaaaggaaaaaaagaagaaatgttttatggactattaattttcagattatatctattatgacatttttatttagtttggatttgtatatgtgtatagagacaatgaaggtcagaagttaacttaggaaaattggttcattccttttaccatttggggcccagggatcaaaccccagtctttaggctttggagcaagcaccactatctgctgagccaagaaacagcccatagaaagtcttcaataagttgtaaatagataacttacatacattgaggattttgtaagttattatctaatttaagaaataactttatattaaaatttagtttttaaaagatgtatttattcattttatgtatatgagcacactgtacctgtcttcagacatatcagaagagtgcacctgttcccattagagatggttgtgaaccaccatattgttgctgggcattgaactcagaaccccaggaagagctgccaatgttcttaaccactgaacaatctttctaggccatcaatgtcatttttaaatctcagaattttgagaataatctttcaag

SEQ ID NO: 5026 - DNA, 1400 bp, mus musculus
caggcattatatgaagtgctaaagagaggcttctctctctgtaagttcatttaatcaagatgacttcaaagcccctgctaatctaagtatttgagcagaatgatctcagcttaatcagttatcccatctgggttttggttcaggactttgaagtgagagattttatcttatgtctttatttcttatgacagtgatgattctttcagagttttctaataaaataagtataagtaaagtactatataaaacatacatatggttgtcttcctagtggaatcatttgatgagaataattgccatttttttctttttattctattcatatcaacgtcagatcactttcttattagagaaattgattcttagtcaaatttgaaatataatttcttatgacttattcattttacatggatgcaaatatatctattgcacaaaagttcataactcaaaatcatggatggtgatattttaaaatagtaaaacaagcaaacaaacaaacaaaacaaaacaaaacaaaaaacttcagtactatcagagaaacaaatagccaaaaagtttacttgaaataaatgtatttgcacttccaatctgccatccgtacccatgagctgaggttgatagacagcctgctctccacggtcccgataggagagcactgttctcccaggagtgcttttactcctgggcttgaaggtgagatagtaactttctctccaataactgtgtgaaatgtggcagtccaggtgtatagggggcacaagatcagtggaacagctgggacaggatctttccagttgccatctgcacccagaacttgtgctgttccatagccctctgtacacaagttctaccaggaaagagctcatcacccaggagtgctgacacagacttacagaccactggccagagacagcaagaacatctaataccagaaataacaagatggcgaaaggcaaatggaagaatcttaccaacaaaaaccaagactacttggcaccatcagaacccaattctcccatcacagcaagttctggattccccaacacaccagaaaagcatgatattgatttaaaatcatatcacatgatgctgatagaggattttaagaaggatataaatgactcccttaaataaatacaagagaaaacagataactggtagaagactttaagaggaaacacaaaaatcccttaaacaactacaggagaacacaggttaacatgtagaagcccttaaagaagaaacacaaaaacccttaaagaattacaggaaaacacaatgaaacaggtgaaggatttgaacaaaattgcatctgtgtctcctgatttcttgtcaaggttttctatcaccagagttgtctccctttgtaatttccttattgtttctactttcatttttag

SEQ ID NO: 5027 - DNA, 1200 bp, mus musculus
cctccatttgtgttttctttatcgtttctacttccacttttaggtcttggactgctttattcaattcctttacctgtttgactgtgttttcctgtatttctttaaaggattcatttgcttcctctttaagggcttctatctgttttcctgtgttttcctatatttctttcagtgagttatttatatcctttttaaaggactgtattaccttcatgagataagattttaggtcagcgtcctgattttcaggtctgttgatgtatgcaaggcttgctgtggtgggagaactggcttctgataatgcccatgtacattggattctagtccttatgttcttgcacttgcctcttgccatctggttattcctggtgtttgctggtctgggtgattctctctggagtctgcctcttttgtccctgggttgcttcaggtctctcagtaggcctgcatccctggctgtagtagagatcacctatagggccttccaactgggggctctgcagtggagcagagaagctgccgatatgttgctctggctgcagtagatctcctgtgaggccttgagactatttgatcttcagaggagcagtcaagctgctgtcctgtgtgaggatgctctctaggtgggcttacagactgtggtttctgtttccctgtgtgcagcagaatgcccgggaggctttcagtctgtcaggtcagttaccatgcatgccacagagctcccaggaggtcttcaaactgtggtgtctgttgccaagttgctgtgtatacagaggagttccaagtatgccttcaagctgtgatgtcttcaagctggtgatatgttgctcagttggactgtatgtagcagatctcctggtatgcctcaggctgtggtgtcagttgccaaactgctttgagtgcagtagatcttctaggatggctcaggatatggtgccttcagaggagcagattggctagcagtctgccccagcaaaaataacctggcagaaggggaatggtattgggggaggagggttggtgagtgatggatcctgagttcactgggacttcaggggttggggatgggggttcttatcaactgctctgagtgcagcagatcctctagaatggctctggatattgtgggccagtattacattttggctaactagacaaagtattatcagctgacctttaagctgattctaagtgaagtaa

SEQ ID NO: 5028 - DNA, 1200 bp, mus musculus
acatgtcagccagatccaaagtcactcacagttttgtctagaatttgaagatctcttttacaggtagctcatcacatgataaaataatgttggctggtagcaaaagtttcttaaaagcacccatgagactcattaaaacatggcagcctgctcaccatggaattatgaatgagtttcaagatagaattcacaatgtatgagaaatcatatagttacttccacagcaatgtagtcctcaaaccagcattcataagtgtagcctggcaattctggctcttcatctggaagacaggaatgtcagtgtatgtgtgcatacatgtgtacattattttcttaaggttctgaagctcaaacacaagtgatcaactactggactatatccttaccttttatgtatattttaaactctttaaattttctatttaactcaagagttgcagttcgcaaagaagattggttttttttttttttttttttttttttggaccgagtgactagtacactagtatagttgtagtgattagtataaattggtgtagcctcccataagcctgaagcaggctaaaggagaactttaccttgttgccactaaggagattatctagggtggagccttcctccctagatcactctactgttctgccactgccactgttcctcttcaagatactgctacctgctgagaagccccagagctattctggagactacatcctatcctgcatgtcatcacctgcagctggttccaggctccaaggatgaattggtgggaatgaacttcccccactcttttataaagcatgtccaccattaaaaatttgcaccttgagcagactagttgtcttggttccattatttctcaatctgcctaggctccctctttccttccagattcaaagatgccttccaggctcgaacccggacatgtgagccgctggcgggccccaacaattgggagctgaattatcttctgttatcattagtccccttaatggttatttgttgccaatctgtgtgataacaatgaaaaaaaaaagccttctacatagtaagtaaatcattttggagtgggcacagaccactagtatctacatatccaaataataagaacctcattgtatcaaatcagggaactataaaagagatcaccctgtttttctgtatcctacctacctgatgttttcaccaatataattttga

SEQ ID NO: 5029 - DNA, 1000 bp, mus musculus
atttagccccagggcacagcccacttagccccaaggcccagcgtatttagccccagggcacagcccacttagccccagggcacagcccatttagcctcagggcccagcccgtttagccccagggcacagcccatttagccccagggcccagcccatttagccacagggcccagcgtatttagccccagggcccagcccgtttagccccaggccacagcccgtttagccccagggcccagcccgtttagccccagggcccagccgtttagccccagggcctagcacatttagccccagggcccagcacatttagccccaggccacagcccatttagccccagggcccagcgtatttagccccagggcccagcccatttagccccagggcacagcccatttagccccagagcccagcgtatttagccccaggccccagcccacttagccccaggccccagcccacagagccccagggcccagcccatttagccccaggccacagcccgtttagccccagggcccagcccgtttagccccaggccacagcccatttagccacagggcccagcccatttaaccccaggccacagcccatttagccccagggcccagcccatttaaccccaggccacaggccatttagccccagggcccagcacatttagccccagggcccagcccatttaaccccaggccacagcccgtttagccccaggccccagcccacttagccccagggtacagcccatttagcccctgggcccatgccatttagccccagggcacagcccatttagccccagagcccagcgtatttagccccaggccccagcccacttagccccaggccccagcccatttagccccaggccccagcccatttagccccaggccccagcccatttagtcccaggccccagcccattgagccccagggcacagcccatttagccccagggcacagcccatttagccccagggcccagcccgtttagcccca

SEQ ID NO: 5030 - DNA, 1000 bp, mus musculus
attcttaaaaaattggggagtgatggccttttgagcactcctgctgactgttgtgtgtggaggaatgctttggtggatggcacatatgcgaaggcagcacagggctgataaacaaaccttagtggaggctatggcagccttggaagcagaaaccccccccccccaatgttgactcaacatgctggatcagtaatcaatgacaggtaagaccctcacgtgcgcataccaacctaagacaggatggcaaaagtgagttcgtcactcccatgacgggttaggatgtgacacagatgggagcaacctaagacagatgctgatcccagagctactaataaaacaaaaagggggaaaagcaggaagcaggtgcagccgcatgggccaagatgtttcctgccttgcctgagcatgcgcagtgaggctgcatgcatgggctgcctgccaggatagactatccctcatgatcctgacctgtcagcctattggtgaccgacctgagctcgtgcctggtgtgtgtgtgtgtgtgtgtgtgtgtgtgtgtgtgtgtgtgtgaattctgattggatgaggtggggtggagctagatgaggtcagttggcatgagtataggagtttttgttgtttagcccttgccctaagtagaagccagttgtagtaagagaagctgttgtaaggggagttgttgtaagaaaaggtgcaagaaggagaacaagtaaagaagctgttgtgtgaacccgacttggtgtccatgtcattcttgtctccgcgggtcggagactgcagagactgtggcaaccaacttctgtcttagttagggttttacagctgtgaacagacaccatgaccaagtaaagtctttaactgtgctaacttacaggttcagaagttcagtccatcatcaacaaggtgggagcatggcagcatctaggtgggcatgatgcaggcagagtggagagttctacatcttcatctgaaggctgctagtggaaggctggcttccagg

SEQ ID NO: 5031 - DNA, 1200 bp, mus musculus
ttcatccctcagttgacagaagctctgaggaaaattattagatatagatacctaagatatggcatgctcaaattagttgagaaggtgggtgctacttgactgtggcaagaacttcctagatatgatagttacaccttttgaggatttattttgtttgacttgttagactatctctaattttaacatgattacccgagaaatataatttatgttccatagcttatatatctgttatacatgcagagcaccttttaagctttttttattacactgtatgtatgtgcatgcatgggtgcacatgtgtgcctgagaatgcctgtacagaaaacacttgcaagtggtgatcgagaccacctctggggagttggttctctccttttaccctgtgttcctgtggtcaaatttgcgttgtcaggattggtggactgtgcttgtattgctaaggctcaccagccccagtttttggctttattggaaaggagagctgtagaacctgtaaggtcttcaaataatatcttgatttatatgtgcccttcccactctatgacgttgcttatgaatccctgtttataaattcacgttaatgttctaaattggagttaaagaaaacaatattgctagtggttttatttttttctttttctctttataagacagggtgtttcactagctcatgaagatgaggctggccttagatggacgatccttcagcctcagcatacaacattccattagtgacttttttttttttccgagacagggtttctctgtacagccctggctgtcctggaactcactctgtagaccaggctggccttgtactcagaaattcgcctgcctctggctcccaagtgctgggattaaaggcgtgtgccaccacacccggctagtgactttctatttgaaagagcatgcttcttactattcaatggaaaaactggtactggaagtcagaaattgattattggtctattcagtagaatatacatacacaaagttacccttttacttagctcttttgacttgaaactttgagtatttgtgttaaattaataacaataaaaaaatcacacttcctttagaaacctccatattttaaaaaaagattgggtagttcttttaactattctttttgattggtcttaaaaactacaactatccacacctttgtggaactgatataatttaaatcagttattt

SEQ ID NO: 5032 - DNA, 1000 bp, mus musculus
tgcgtccctcctcagcacccacaatctgtgtgaactgcattaaaaatctgttgtatgaaatgctggcatgccgaggtctgctggcgtttagtgcattctgcactcacggcaccattgtgtgctttagagtcagagatgagtggaatccagactggtgagcacctgaggaaggtggggcaggatgtgataagaaatctgtgttgtgactgtgcctaagcaattcacagagactggagacagtgattgtctatggaggttcagaggtcaaaaccagggcttgtgggtagaaagaattcagactgactccaacgatcctgactccacgtaagggaatccctatctctgtccagatcagaaagaggcctggcttttctctggttcatgtgggcctggcgtggtgagtggagacttgtgatatttgtctgggtctggagttggggggcagctgagtggctgaagtggggcctctagaggacctttccatggtggacaacaaaaatgatggttaggccaacatgaggaaagcctagccccaggtagatcagacctaacaaataacttaaaatgagctagttttctattatgtcgtttttctatctatttaatcttaagaaaattaaactgaacaagatgacttgcattgtaaaatatacgttccagggaattaagtaagccatggggattttagggtggtgggttttcgtgaagtctctcaggatgaaaagtggtgttagatcatagtaggtgcctcctcagagaggccaggctctgatgtggccataggggtgaagccttgaacatctgggagaggccccgaggatccagtgggttcccggctacccctggcttcaggttgcctgcatttaaatcataacccctttcattatgttgttccagcaaatgtgctttctgcagatcaaagcaggttccttgatgacacttgtcaaaactgtgggtgtggggtggcgtgggcgggaagcattcagcagctttgtagggc

SEQ ID NO: 5033 - DNA, 1000 bp, mus musculus
agtttctgcttggatatcataaagatctcacatacaaaggtctctgccgactgccctacctggggttccatcccataatcagccaccaaacacaagcactattgcatacaccagcaagattttgctgaaaggacccttatatagctgtctcttgtgaggctatgcaagtgcctggcaaacacagaagtggatgctccagtcagctattggatggaacacagggcccccaatggaggagctagagaaagtacacaaggagcttaaggggtctgcaaccctataggtggaacaacaatatgaactaaccagtacccccagagctcctgtctctagctgcatatatagcagaagatggcctagtctgccatcattgggaagagagaggccccttggtcttgcaaacattatatgccccagtacaggggaaacaccagggccaagaagtgggagtgggtgggtaggggagcaggggagggagggtataggggactttcgggatagcatttgaaatgtaaatgaagtaaatacctaataaaaaattgggggaaaaaaaaaaaggtctctgccacacctggcagtggtggcacatgcctttaatcccagtacttgggaggcagaggcaggtggatttctgagtgtgaggacagccagggctacacagagaaaccctgtcttgaagaacaaaaaaacaaaacaaaacaaacaaacaaaaaagcaaaacagaaaaccccacaaaggtctctgccatagcaccacactcctatcccttccttttcccaatactttgaccatatatacctcatgaagcaagaccatctcagcacttcctctctactctttcctacaaacctgttcaagaatgcttataattttttttgaaatttttaaacttattcatatacatttttaattaaatagaattccaacatgccttccctttgtgtttctttctccaggccctcttatgcccctcccccatcaaattatagtctctttttct

SEQ ID NO: 5034 - DNA, 1600 bp, mus musculus
atgccctccaggtccaactatttgcctaggaatttcataaattcattctttttaatagttgagttgtactccattgtataaatgtaccattttctagtttggtgaagaaatctttctctggcattccagccatctcattttcattattctccaatactaaggagctatgagcttgttgcaatctcacaagaactctcccacccccaaatacacacactgattgagtggctgcaaaggaaaatctatcttaaaagcctattccacggagaaataatttgaaacaacaacaacaaaaaataaaataaaataaatcctcaggtaaagcacaaaattctaagtaaaataaaaaaattgatactataatcatagtcaatatttcttactgatatatatatatatatatatatatatatatatatatgcctccttactcagtgtcttacagggaagaagtgggattctagtatgattcaaacaacctaatgatgttttgttttgaggctttgaggtaaagatttaagccctcttttatgctgcttaataatctcttgatctctgcctggctgttgaattcattctgatcctgggaaagactgttcaacacatatgtcatggcccagggtatgtgtgatatcttttcaagatattcccttcagatgctgtctagccttgggttcccatgttatgattctgcttatgtctgcacagcctggtcaccctgctgcatctccagccacagtttatctaccccccagatgcacgtcttagcccaggcagtatctctctgctagtcttactatgctagtacatggaggggagtacctccctggctactgctgtgatcctaggccagtgacagcaatgtgggactgttgctccaggctgctttcttactgtggcttaattctgtccttagtgtttccaactataacaatagagtttaatattgatattatcaattttttttaaagatagggtctcatgtaactcaggctggcttatatcctagtgtgtagctaaagatgatcttaaacttgctaatctctatctacctcccaaatgctgggattgcaggtaagactaccacagcagctcagtctatactctttttgtgctcattcattcattgtgtaagaggcagctttttgtttgccatcagacttagaagccctgtcatttgtccttactgtaatgagttggcctggtctacaatgttgaatagaaacacaaaaacatgcttcactaatttactctagcattaatgaaatttaatctaaaccttcataacttaagttatttgcaagtggtatgcctttgataaacaatatttatcaagttaaggacagctctcattaacccagttagccataagtgttttcccaaatgaataaactcatggattttctattgggacttggttagacttttttttttcattaaactatgaatatattaatactttcacatttaagatttgaagataatttttaaccttttacatattactggctaatgatataacattttaaaattcacatcaaattcgaagttttaaaaatttgtgttgttgatgctttatatccattctaataaagaagtt

SEQ ID NO: 5035 - DNA, 1000 bp, mus musculus
tataggtcctgaaattaaaccacactgcttgggattgaaccagggccatcataggccaacatagggtatcaattcagctctttcttgagacttttactcagtgtagtctgcctctccagtttcagtttgagcatcgcaggtggagaagcaaaggagtaactgaacaaagaataactgaacctagctcatgcagtgtcttgtgagtgcaaggtattctatggaaactgatttcctaaactgcctggcttgaatctagaccattctatctacaagcaatttacatgaccttaactctagtttcatctcctgtaagaacagagtggatgcttaactcttgaagaaatccttgctcccactatctttctgggatgtatcagtttaagagcccaacctctgccaaatgctcctttaatcatgttgcaacaagggagatatgggcaccattgccttagagaaggttcttgcatttaactacagctagatactttctcccctctttctttattccagaagctttttagctgaaaagacaggaagaaggacaaggaccacacgatcacataaacagaacactgcagaatgaatgtcagagctctctctgtctaacacagcagcaataaaccttcttccctccttgtcagttgccctgcctggggacttaggcttctccagcagtcctgaagcttggtctgtccattctggcttcattaagcatgttaagtgagatgttctgccatgttgcgagagtctgtcacattgatagtttacaacagcatcatctcttcctgttggcctggtgctcccttccacactttgatttattaccttgctcttctgttcccacacgaccctttcatcactgtcgcacatgggcctgttgatgagatatgcttggtggtggctggagggagaggagagatcagtgcaagccaagaaatgagggagttggcaactggctttttcgatttctaaagctggtctttgtttttacttggaagat

SEQ ID NO: 5036 - DNA, 1000 bp, mus musculus
agggctgagcttcgaaacaaccgacgagagtctgaggagccattttgagcaatggggaacactaacagactgtgtggtaatgagagatccaaacaccaagagatccaggggctttgggtttgtcacatatgccactatggaagaagtggatgctgccatgaatgcaagaccacacaaggtggatggaagagttgtggaacctaagagagctgtctcaagagaagattctcagcgaccaggtgcccacttaactgtgaaaaagatctttgttggtggtattaaagaagacactgaagaacatcacctacgagattattttgagcagtatgggaagattgaagtgatagaaattatgactgacagaggcagtgggaaaaagaggggctttgcttttgttacctttgatgaccatgactctgtggataagattgttattcagaaataccatactgtgaatggccacaactgtgaagtaagaaaggctctgtcgaagcaagagatggctagtgcttcatccagccagagaggtcgcagtggttctggaaactttggtggtggtcgtggaggcggttttggtggcaatgacaattttggtcgaggagggaacttcagtggtcgtggtggctttggtggcagccgtggtggtggtggatatggtggcagtggggatggctataatggatttggcaatgatggtggttatggaggaggcggccctggttactctggaggaagcagaggctatggaaggggtggacagggttatggaaaccagggcagtggctatggtgggagtggcagctatgacagctataacaacggaggaggcagagacggctttggcggtggaagcaattttggaggtggtggaagctacaatgattttggcaattacaacaatcagtcttccaattttgggccgatgaagggaggaatctttggaggcaggagctctggcccttatggtggtggaggccagtactttgctaaaccacggaac

SEQ ID NO: 5037 - DNA, 1200 bp, mus musculus
gtatttctttaagtgagttattaaagtccttcttgatgtcctctaccatcatcttgagatatgcttttaaatccgggtctaggtttttgggtgtgttggggttcgcaggtctgggtgaggtgggattgctacgttctgatgacagtgagtggtcttggtttctcttagtaagattcttatgtttgctttttgccatttgataatctccggagttagttgttatagttttctctggttagagcttgttcctctcatgattcttttagcctctgccagcagacctgggagactatatatctcccaagtttcagtggtctgagcactctctgcagcaggctctcctcttgaacggaatgtacacagatatctggtgtttggacctgcctcctggcagaagatgaaggcctgaaacagggcctgtcccagaagctgttagcttctgtagtccacactctcacctgagcagactagtctcaaagggatccgggatccaagatggcttccccaggtgttctggcaaagccctcctgggcagggaggacacctgtcctctggcaagaaaggtgcccagatgtctggagcctgaaacagggtctgcctcagaaactgtcctctaggcatcttgggggtgtcctctgactgctctcccaggtgaccaggtgctggtgcagacaggaagggacttgtgaccctagtcaggctgggtttacggtttccctaatgctgtctcaggtcttgtgcaattggaatggaacagaagttgttttccactcactggtggtcctaagatcaagttggagagtcctctagggaccttgggggagtctgcagactccgtgcccaaggtgacctggtgctggcactgaccggaagggacttgtgatcctggtaaggccgggttttctgcttctctaatgctggtcctacgagattggaatagaaaagaagatgtgttccactcactggtggtcctaagattgcgtggagagtcctctcgggaccttggggggtgtccgctgactccgtgcccaaggtgatccagtcctggcaccaccagtagtaaacattgtaaatgacatttatagcctatttagcattaaattatatatacgtataaaatacatatatgtgtatttttccttagtgattttttagtgtattagggattaataagaaggcatgactctcttgtcactgatt

SEQ ID NO: 5038 - DNA, 1200 bp, mus musculus
aatgttcttccttcatatagtctttaaagctttaggaatgctagtctgtccatgtcattgttgcaataccattcttcaccatatatttatggttatattaggcatatgtagccttaatttttgtatttaacattctggttcatgtatataatccatttttaaatttgttttatctgagtcaatgtcccaatttctaagagctgtgtttatactgtttgatatggctaatcttgattccaggactctcatgatattacagttacatttgctgctttatccactaatccatggatctcaatttcatctaactctaattttaactttggtctcttttcatttatagtattttgccaaaatacgtgggttttctctctctctctctttttttttttttgtattttaagattctcttgttatatccatagaaaattctcacccacatcttccttctgagggacccagagtactctccacactgcaggacatctggatcacctctggatcacgagtgagtggaactcaacatcaactccaaataatcatggagggtcttgtgccagcagaaacagggacagaggagccccacctaaccagaggctgggatcctttccagtcagggccaccctgccatcttccttctgagcccagaggaggccactaagggttcgagagtgctctccacacctcagaacttcgtgatcacctcgggatcacctgtgaatgaaacgcaacatcagctcaaaggaatctcggaggtggatcagagccgcagactgctggacatctgccctgcaagaggagagcttgcctgcagagggtgatctgatcactggaactcaggtgagacttggactcccaggagtgctgacagaggctaacagaatcacaggaggatcaagctcccacaagagatagcttgatcattaacaccagagatttccaaatggcaaaaggcaaacataagaaacttattaacagaaacaagaacactgggcatcatcagaacccagaacacttaccacaacgagtcctggataacccagcgtacccgaaaagcaagacacagatttaaaatcatatctcatgatggtggtagaagatttaaagaagggcattaataactcacttaaagaaacacaggagaacagtgctaaagaggtagaaggccttaaagaagaagcacaaaaatccctcaaggaa

SEQ ID NO: 5039 - DNA, 1200 bp, mus musculus
gcgccagtcccgagttttttctcgtcccggaattcggcaccaattgttattagacgcgttctcacgcccggccaggaagaacaccacagaccagaatcttctgcggcaaaactttattgcttacatcttcaggagcaagagtgtaagaagcaagagagagagaaaacgaaaccccgtccctattaaggagaattctccttcgcctaggacgtgtcactccctgattggctgcagcccatcggccgagttgacgtcacggggaaggcagagcacatggagtgaagaaccaccctcggcacatgcgcagattatttgtttaccacttagaacacagctgtcagcgccatcttgtaacggcgaatgtgggcgcggctcccaacagattatgctggggtgcttggctctaaatgaaagatctagttcaactcttacaatgtttgaagaacatcaccaaaagaaggagtggaaagaaagtaagagccagataatagggagatatatagcaaaagtgatgtcttctagcaagacatagccagtgcaccaatgaattctctacagctatggtacaagacccatacatgattagattcaacaatatgcagcagcattccatccatgggatggattcctcccctctctgagagaccattgactgctaactgttgtagccctgtgaagcatcattttcttcagtggtgactgttgctcctctaaataacctcctacccacactctggcaagaaattgttaattaaaggcagtgtattatttaaaaagtgaagacataaataaagcagaaaacttgttgggaaaagggatggggacagccagagatggggtggaagttgggaatcctgaattcctagtccttgaatggacttctttctaccataagatttaattccagaacccaaagcttgaggaagaaccgcaacactagatcatggtagctactgcaacttaaaagttttctgagttctttccatcttctggctattataaataaggctactatgaacatagtggagcatgtgtccttcttatcggatgcccctcaacagaggaatggatacaaaaaatgtggtacatttacacaatggagtactactcagctattaaaaagaatgaatttatgaaattcctaggcaaatggatggacctggagggcatcatcctgagtgaagtaacacaatcacaaaa

SEQ ID NO: 5040 - DNA, 1000 bp, mus musculus
ctcttttcataattcaactttcaatttgtattatagtcactattattttaagtatctttcaggttgtgttataattctgggttatttgaattctaacatactagcttgcaacatagactgagttccggactgatgtgtggatagacatgttagttgcctgctacgttcttgttcttagggtgcattgagctcaactaagtgaccagctccttttacaggagcttcacccgaagtgctatactcgagttgcttaatggtgctgaagttcctctcccaaaagatactgtctactaggacatttctcatattatttaggtatttccgattttatgtataataatgagaatcaagagcatgtgttccttacacagccccatactgctgttgtcacagtgaggaagcatcttcacaacattaatatcaattttaagtaaacatagaactttacttatcatacaaccaagctactgccatggcgttcagctgcagtgtcctttgttcttgataaatatcattgtgtctgttgctgagctctgccactaaaacccaaaatcctggaaagcagaaatgtgttttcagttatttttttttaaacctcatccatattgtttgggagaaagcccaaaaatttatggaatcttagacctgatagaagctcaaaggatgcagagaggtgagaggaggatgccaaagcaacaggaagccaggctcactggcaagcagtttggcatcatctcagcccaggaaacagcaggatccagtagggagtgatggtttgactcaggtggacttgggttttcatcccagcactgctgtgtaatcactctgtaaccttgggcaagtgttccaaacttctcaacctgaggctctgcacctgatacatgcagttaataaagataacccgactcacaagagtagtgtgcatagtaaatgccacaaaaaattaaataatcttttagtattctgaaagaattaggcactgtaaaaacagaatgtgaga

SEQ ID NO: 5041 - DNA, 1000 bp, mus musculus
ctttctatcataatcccagagaactctcagagtagaagagtgttgtagcccttaggcacactgaatcgagttcctacccacatccaggcctccttagggctctgactttccaacaagtgtttcatgatctttgcagtcattgttcaaccacacctagcaaaccccatgctagcagtgttcacatagagcatattttgaagacgtatgtgagtggcagggttagaaagctgtagaaatcaggcagtggtttgccatcgatccacatagtctgagcccctggaatgagcagaatgaattagtgcatctgtgaagtgatgacacattgaagactctgagaaaaggatggatagtactgtgccactggaaaagctaccaataccagcccaaagccatggtatggaacagccatgtgtggaagacagacaacagtcatgtgaggaagcaacatacccagtcacatgagctaggtaccctaaagactaagaggtctacccttcactagagtgtgcatgaaacactagatttgagagcctcctctggtctcagtttttctttgtgttgattattcggttctctttcctgtctctcccttttagagtggaaatattttctctgtacctagaacaccattgtatgactatacttattttattttgcaccagttcgttagtaggaagtttcccttgagatgagaattttcacttggaattttgaatgatacggcaacaggttttagggccattcaggttgtagctaaagcccagtttgcattgtgagaaagacataaaacacagtccacatatggttgactatttaccccaaagggttccatattgaagatttggttctgcgaggggtaacaaaaagtatggaaccttaaaaggtgagttctgttgggagttgcttgaatcatatgtggttgttgaccatggatggattagagtaatgttgtggagcccctgatttagttttcaaggggattcggtatgaaacccagaat

SEQ ID NO: 5042 - DNA, 1400 bp, mus musculus
aggaaatgatcaatctcagggctaaaatcagtcaaatagaaacaaaaagaactacacaaagaattaaccaaaccaggagctggttctttgagaaaaacaacaagatagataaacccttagccagactaaccagagggcacagagacagtatccaaattaataaaatcagaagtgaaaagggagacataacaatgaaatatgtcttaaaataattattccgttgttgaatattaacagttgaaaatattaaaattatgtcctcaaaataaataaataaataaacaaacaaacttcaggacaaaaaaaattaaattgtttatcctattacttgtttttctgtcactgatttctcttttataaggagagtatccatgggattactggctatttttacatttggagggtgtatagggttattttttcagttcctgagagagacatagaatcctgcaaggaggattctatgaagtgaggatcacaagcaggcctcagatttcatgtttgtttgtttaaacttaaaggccagggaagcaggctcctgaggtgagatgctgagtaaggctgggatacactgtgtgatcatctgatgctgtgacaagccagcacctgggacacacaggaaacgggagcctcttctgagatcagaaaacctctttcgaaagaatagatgggaacgggctggaactaaaatcaggccatcgagccgagacttttttttctctgtgttttaagacctgcccatccatgtacacattctggtatgggaaatctgggtcaccttcctggcctgaatagaaactaatccctttcatttcttctctacaaacaaccttgccttcggttccactcccttggaggctacccatgcagaaacatactgtcagaaacactctgttgaacgcatataaacacttgcctgaattccaaccatctgcctatagtgcctcttctgaagtgagcccattcatcttcccaggcaaacgacaaactgtacagaacgcttcttcaggcagaaatggtcacagctgcgtgctacattctttgaacagacaggcacaatagactacattcatggagatccctaccaccttaaaatgaatctcaaaacgtggatatttaacatgagacaggtatctcttcttcactgcttctacagaagaattttataaactaaaacaatacaggcctatattaaagctttcaatctatcacaacatacgtatgctgtgttggtacacttaccttgtttgtaaggtataaataactgtaatttacgaggctcaactgagtagcacatgtcagtgtgttggaaacaagaaagcataaatcaaattcaagaaacactatgatgtaaagttgtagccaaactctatgaaacttaaatcacatgtgctatttct

SEQ ID NO: 5043 - DNA, 1000 bp, mus musculus
gatgtcacctagtgcggtgaccccggagagagcacaaatcgcgtgccgaggaggctcctttcagggcagaggacgaaaggagggcagagggtgtggtagcgtgtgcaaggaccaaggcgggccttgcgcgcgcttccggagtccgccggcccacccgcccggccgggccccgcacccctcaccgctgctcggtcccggccgcgggccctcgccgccgccgggaaagggctcctccgcggaaccctcgagcgtcgggggcgcggacggcacgccgtaggaagggctcttttcgccccagtgcaggttgcggctgcccgggatgtccgggggcgtcgtcacccagtggcccagttccgtccctgaaccgaaggagcgcgcatggaaagggccgccgaaagccggatcatcccgaacgcctccccggtagcccaggccatcgaagccctcagggcgccgcggatgcatctcggacaggcggacgaggacgagagaggccggcccacggagcccaggcctccaccgcgtccccgccgcagccgctgcgcgtccggagactgacaaccggaagtcacggctagaacccggaagtcctaggagcacgtgactccgccctggcgcgtcttccctgagttggttgctagggagatgcggcttaggatggaaggggaaggatgcttgttgggcctggtcccaggagatgcaaggtgtgtcccctgctagcagggatgctctgagctgtgcagcagccacgagtgaccgcggactgttgcaacatgctgactcccctcacccaggtgctcacccttttcaagggaaccctgtgtgagggcaagagtagccttcagcctagctttgtctccggctgtgtggaccaccacagcagacattaacaatgttcaaatcaaaaacatcctcgtgtgtgaatacatactgccctcaaccacataggaatcaactgtttaacttttctaaggcaactgtatacagttttcttttttct

SEQ ID NO: 5044 - DNA, 1600 bp, mus musculus
tgtctttttgtgatttgtatcctctgataattcgttgtaatataagtctgaagctcaaccagaacattacattcagattcaacacctctcttgtgtgtgcctgattgtcacttcatccgactcttttgcccatctgcctaagaaatcccgttcctcgcagaccagggacccagagggtctgcggcattgtttggtttagctttggttttttttttcaagacagggtttctctgtgtacccctggctgtcttggagcttgctttatagaccaggctggcctcaaaatcagagatctgcctgcctctgcctcccaaatactgagattaaagtcacgtgccacactacctagcatgctggctagtttttatgtcaacttgacacaagctagagtcattggagaggaggaagcctcaattgagaaaatgtctccataagatccaactggagagcattttcttaatttgtgattgatggcacagcccattgtgggtggtaccacatgtggactggtggtcctgggttctataacaaagcaggctgagcaagcatggggagcaagccagtaagcagcacccctctatcaactcctgcctccatgttcctgccttgctgaagtccctgtccggacttcatctgatgatcaactgtgatgtgaaagcggagaccagtaataccctttcctccccaaatttctttggttatggtgtattgttacggcgatgccctaagatgcatgcccttccctgaccatgcccatttctatccataccagccttcacctggacccctcaagcagcactgcttctctcacgccagcaggggtcctaggtgatggtctcctctcacctgccaaggactgtcaccctgcttcgtcagcgttccgttgactatccttggatctggttccagttcatcttctaagtctgtgtctcgtttgaggatcttgcgtttcttctctatccacctccccagtttcccacatggaaaattcactaaaagtcaaagagaggtggtaaaggccctctatgcacgactcccacagcacccccgcctcctgtttgtaggctaggctgccatcctggacgcttcaagaagtgcagtgtgggactcaaaatcaaatagtgccacctactagcaagagttggccaagcgccgttactacctgagtgtctctaaagataaagatatcctggattcaccccagggctataggtgatcatcctcaagatatataaggaaaggctccttgtttggatgccaccaagctcctagggatactgttcaggaggatgtaactcagttggtagaatgcttgtgcagcacacataaggccctgggttagatcccagtattgcataaaccaggcatagtaacacatgtctgtaatcatagcactgggaaatagggcagaaggtcatcctaagctacatagtaagttttaggtcagcctgagcaaaatgagcttctatctcaaagtagggggacagattagagaggagcttcttcttcttcttcttcttcttcttcttcttcttcttcttcttcttcttcttcttcttcttcttcttcttcttcttttcttcttcttcttcttcttctt

SEQ ID NO: 5045 - DNA, 1600 bp, mus musculus; identical to SEQ ID NO: 5044

SEQ ID NO: 5046 - DNA, 3000 bp, mus musculus
accaccactccatgtgccttactgccccatccaggtggccataattaagcactaatgagcatactggatatcattttcctttcgtcatcagaagagcactagtcccaggtccccttggtgtctttccccttgcactgctgttgatagtgccaccgcaacagacaaggctttgggggcagggaggtatgtttaagctcaatgactagctaccaagtatttctagccaagaataaattcctcgaggcactaggctgggtgtggtagtacatgccattacttccagcactcagaaggcacaagtaggcaaatctctgcttgaggccagcctggtccatataataagttctaggccagttggagttacatagtcaaacagacagtgagatgctctctaaaaataataaaacaacaaatgaaataacacagagcttagattgttgtatagccaaaagttttcaaaatatgttgctgtttttacatgtatgtatgatacgtgtacagtatgcatatgcatgtgagggcttggggaaagggcacccatgtgtcatggaaagcatgcagaggtcaggaaacaactttgagtgtcggaccgcatcttccaccttgtctgaggatgttcatttgctcacagctgtatatgtcaggctagctgggtcacaaggctctggggctgtccttatctcccatcttgctattggctcttgaagatcacagacctgcacaatggcgtgtggcattacttgggtgctggggatattgatttctgccctcacactgtcttgggagctgctgtggtgttccactgagctatctcgcccagccccaaatattcaaatctgaagaaggtactttgtgcaatttttttgtttgtttgttttgttttgtttttgtttttttgatactgggtttctctgtgtagccctggctgtcctgaaactcactttgtagaccaggctggcctcgaactcagaaatccgcctgcctctgcctcccaagtgctgagattaaaggcgtgtgccaccatgctcggctgtgcaatttttagttggttggttaagtttacatattttcaaatgctgtaatttaaagaacattataattgcttctgtttttaaatggctgttataattacttgtacaaatgtatataatggaatcaaaacatcatgttattgggtaagataccatcattctgctttcagaaacaaatacttctctatctttcagaagtgagcattttcttcccttgtgaactattttttttatttttacccaagacctttatcttaatgttgtactattttgatcaaaaacactcttttaacaccctatttcactcacctgcaattaaaatgcacctaaactttcagttttatttcctttgaccagaaatatctaagtattaaaagtaatctttgcgaagagaataatttttagaagcagtacactacaaatgaaaacaggaacaccttccacttagtaagaacaaatgcaaaatcacaccccagtgcaaggattaatgagatggtaaactttactctttagttcacgtatctgccaatgaggaattatttattgctcgcataaaacagatcaacataaattctatttgttttgtatgtgtatataaacacacacacacacacacacacacattatactacagtaccaaaattcagttctttgaatttctgatgccatgtggcaaaattcatgtaataatctgtaatcaaaaatacttttgcttttctgtcacctgacaagttggtaatgatcttctgcatttttaaagtactgcactggaaattctgagtagcagagccttattctccagttattttgaataatttactttcccagtttctgggaagcacaccaagacacattcactctgacttctcaaatgattcttaattatgctgtaacacacacatttaggggcaccttttaaaaaaactatctctttagaaatggcaggaataaaaacccatgttttttttttttctaaaactgattaaacatttgataaaacaatggtttctgatgaaatacttccatcttaatttttgctttaagtgtatttttccacttttgagctgtagattttacttgattatggaaaatgtctttcaaaaatgctcatcaatgggggcaacattcactatcaagtggctaaggtgcaagttctgtcagagaaaagttggctttatttttctactcaaaaaactatttttattctacaaaacactgtaaaattgatcactaaaaatacaaatcagggtgatacagatagagctgttgcatatttaaatgtgttacagagcaagatgatcaacatgctctgacataaagcaaaattgtgcccggcaagtttatgccaacttgacacacagtagcctcattcaggaagaggaaacctcaactgggaaaatttcagcagcagattggcctgtaggcaagcctgtgggacattttcttgattgatgattgatgggagggaggagttcactgaaggaggtgccacccctgggctggctgagtaagccatggatagcagaccagtaagcagcatccgtccagacctctgaattggttcctccctccagcttctgctctcacttcctgacctgacttccctcaatgataagctgatcctagaaaatgttaagtgaaataaaccgtttacttcctgatttacatccgggcatggtgttttatcagagcaaaaccctaacaaagacaaacgtgttatgatttaaatatgcaatgtcctttaaaggcttgatttcaaaggccattaagcctgttggacatggggcctggctagcagagtttgtgccctgggtttacaggttagagctggaccctggctttttgctcccggccatgtgcacctgtcaccatgggctcccacatgccttcttcactatgatagactgcaacttctcaaaccatgagccagaatatgtcatccctcttctaagtctttgcttgtcaggct

SEQ ID NO: 5047 - DNA, 1000 bp, mus musculus
gttcaggcaggtgggtggcgaaagctcccgcctaatctcagccccactatcgagtataatgacggaaggcccacaaaacggcatgatattgcacgctcccattctgaaagtccttccagactaccaatcaaccgggcgggaacctggaagcgtgaacacagcaaacattcctcgtcccttcctcgagtgagtacttggagaagaactggaagctcatcttctattctttctgcttcatcagagtccagtgaaaaagcaaaaagtgaggatgaaaggcatgtgagctccatgccagcacccagacagatgaaggaaaaccaggtgcccaccaaaggaacatggaggaaaatcaaggaaagtgacatttctcccacaggcatggcttctcagagcgcttcctcaggtgctgccagtggtgctgaatccaagcctctgatctatcagatggcacctcctgtctctaaaacagaggatgtttgggtgagaattgaggactgccccattaacaaccctagatctggacggtcccccacaggcaacacccccccagtgattgacagtgtttcagagaagggaagttcaagcattaaagattcaaaagacacccatgggaaacagagtgtgggcagtggcagtcctgtgcaaaccgtgggtctggaaacccgcctcaactcctttgttcaggtagaggccccagaacagaaaggaactgaggcaaaaccaggacagagtaacccagtctctatagcagagactgctgagacgtgtatagcagagcgtacccctttcagttccagtagctccagcaagcacagctcacctagcgggactgttgctgccagagtgacaccttttaattacaaccctagccctaggaagagcagcgcagacagcacttcagcccggccgtctcagatccctacgccagtgagcaccaacacgaagaagagagattcgaagactgacagcacagaatccagtggagcccaaagtcctaaac

SEQ ID NO: 5048 - DNA, 1000 bp, mus musculus
acaagaagatagaaataatcccacgcatcctatcagatcaccacaaactaaggctggtcttcaacaacaataaaaacaacagaaagcccacatacacatggaagctgaacaacagtcttctcaatgataacgtggtcaaggaagaaataaataaagaaattaaagaccttatagaattgaatgaaaatgaatgcacaacatacctaaacttataggacacaatgaaagcagtgctaagatgcgggaagcaggtgcagccgcaggccccatgaaacccacttgtttactgccttgcccgagcatgcacagtgaggctgcatgcgtgggttgcctgtcagactgaacagttcctcatgatccagacctgttagcctatctgtgaacgacctaagttcgtgcctggagcgtgtgtgaattctgattggatgaggtgggctggagctagaaggaggagtcggcgcgagtagtgactccctagtgtttagcccttgctgcaagaaagatggagtagtaaaagctgctgatgtaagtggtagaagctagctgttgtaaaagaagccagtagtagtgaagagagttttttagcccttgccctaggtagaagccagaagtagaataagagtagttttttagcccttgccctaggtagaagccagaagtagtgaataagagtagttttagcccttgacgtgagtagtagtagagtagtgagtagtttagcccttgccctaagaagaagctgctggggaagagagctgtaaaagaaaaagcccgaagtaaagacgttgctgcgtgaacccgacttggtgtctgtgtcattcttgtctccaccggcccggagtggagacgacgacactaaatggaaaactcggtccttcgtgcctccaaaaagaaactggagagtgcatacactaccagcttaatagcacacctgagagctctagaacaaaaagaagcaaatacatccaagaggagtaaactgcaagaaataatcaaactc

SEQ ID NO: 5049 - DNA, 1400 bp, mus musculus
gagtggagaaccaccctcggcatatgcgcagtttatttgtttaccacttagaacacagctgtcagcgccatcttgtaacggcgaatgtgggcgcggctcccaacagtgtcctactcactggtggagcggagggtgggcgagcgcttgctgtcgagctatatgtctgtgcacgcggagagcggcaaggtgttcgcgctgcagcctctggaccatgaggagctggagctgctgcagttccaggtgagcgcgcgggatgctggtgtgcctgccctgggcagcaatgtgactctgcaggtgtttgtactcgatgagaatgataatgctccttccattcttttggctggtactgaaggcttgggaagtttgaccactgatctcatacacaggtctgtgagcgtgggtcaggtggtcgcaaaagtgcgggcggtggactcagattctggctacaatgcatggttgtcctatgaactgcaaccctcagtgggccctcgcagcccatttcgtgttgggctgtacacgggtgagatcagtacaacacgcgctcttgatgagtccgatccacccagacagcgcctgttggtattggtgaaagaccatggtgagccagctctgacttccacagccaccattctcctgtccctggttgagagtagccaggcaccaaaggcctcttctcaggcttctagtcgtgcttcagtctcagaggcgtcgctggtagatgtcaacgtgtacctgatcattgccatttgcgcggtgtccagcctgttggtgctcaccttactgctgtatacagcgctgcgctgctccgcgacgcccaccgatggagcctgtgctccggggaagcccatgctggtgtgctccagtgcagtggggagctggtcatactcacagcaaaggcggcaaagggtgtgctctggagaaggcccacccaagaccgacctcatggctttcagtcctagtcttccaccgcgtccagtatcagaggtcattggggaagggcaagattcaaatgtcgatcatggctttcaagtaagtccttttatatttagaaatatttaattcgaagaaattcgtatctcctttcatggtatttcatatttgcacatgctattgtcaaaattcaacattattttagttacaatttttacttggtttgttacttttgtgttgtcgtacatttatttatttatttatcatctgagattctacatactcaggttggcctgatactcttgaggtcaagggacatgtcacatactggctattcatatagcacaatctttgttgttccaagttatcaaaagcaatttcatattagcctttgtatgttgcttatagcctttgtatgatttcagtcttccagaacagaacttagatgacatccatgggaatgccttctt

SEQ ID NO: 5050 - DNA, 1400 bp, mus musculus; identical to SEQ ID NO: 5049

SEQ ID NO: 5051 - DNA, 1400 bp, mus musculus; identical to SEQ ID NO: 5049

SEQ ID NO: 5052 - DNA, 1400 bp, mus musculus; identical to SEQ ID NO: 5049

SEQ ID NO: 5053 - DNA, 1400 bp, mus musculus; identical to SEQ ID NO: 5049

SEQ ID NO: 5054 - DNA, 1400 bp, mus musculus; identical to SEQ ID NO: 5049

SEQ ID NO: 5055 - DNA, 1400 bp, mus musculus; identical to SEQ ID NO: 5049

SEQ ID NO: 5056 - DNA, 1400 bp, mus musculus; identical to SEQ ID NO: 5049

SEQ ID NO: 5057 - DNA, 1400 bp, mus musculus; identical to SEQ ID NO: 5049

SEQ ID NO: 5058 - DNA, 1200 bp, mus musculus
atacccacctatggttgctcactgcaccgtactcgtggaaatcttggatgaaaatgataacgcaccggagatagtccttacttctttgtctttgccggtgaaagaagatgctcctttgggctctgtaatcgccctgatcagcgtgtcagacaaagactctggtgtcaatggacaggtgacctgctccttgactaaccatgtccccttcaagttggtgtccaccttcaagaattactattccctcgtgctggacagcgccctggaccgagagaccacagctgactataaggtggtggtgacagcccgcgacgggggctcgccctctctgtgggccacggccagcgtgtccgtggaggtggctgacgtgaacgacaatgctcctgcattcgcacatcccgaatacacggtgttcgtgaaggagaacaacccgcctggagtgcacatcttcacagtattggcggtggatgctgacgcacaggagaacgcgctggtgtcctactcgctggtggagcggagggtgggcgagcgcttgctgtcgagctatgtgtctgtgcacgcggagagcggcaaggtgttcgcgctgcagcctctggaccatgaggagctggagctgctgcagttccaggtgagcgcgcgggatgctggtgtgcctgccctgggcagcaatgtgactctgcaggtgtttgtgcaggatgagaatgacaatccgcccacgctgctcggacatcagtcaggtggacctgctggcgaatttagccagcttgtttcgcggtcagtgggtgcgggacacgtggtgtcaaaggtgcgcgcggtggatgcggactccggttacaacgcgtggctgtcttatgagctccacccaactgtgggcgctcgcagccctttccgtgtcggtctctacacgggtgagatcagcatgacccgagccctggatgaatctgatttaccgcgccagcgcctattggtgttggtgaaggaccacggcgaacctatgttgatcgccactgccaccgttttggtgtccctggtggagaacggccaggtgccaaaagcttcttcccaggggttgcccaactcctcccgcagggaggcgtcgctgatggatgtcaatgtatacctgatcattgccatttgcgcagtgtccagcctgttggtgctcacgctgctgctatacacagccctgcgctgctcagctgtgcc

SEQ ID NO: 5059 - DNA, 1200 bp, mus musculus; identical to SEQ ID NO: 5058

SEQ ID NO: 5060 - DNA, 1200 bp, mus musculus; identical to SEQ ID NO: 5058

SEQ ID NO: 5061 - DNA, 1200 bp, mus musculus; identical to SEQ ID NO: 5058

SEQ ID NO: 5062 - DNA, 1200 bp, mus musculus; identical to SEQ ID NO: 5058

SEQ ID NO: 5063 - DNA, 1200 bp, mus musculus; identical to SEQ ID NO: 5058

SEQ ID NO: 5064 - DNA, 1200 bp, mus musculus; identical to SEQ ID NO: 5058

SEQ ID NO: 5065 - DNA, 1200 bp, mus musculus; identical to SEQ ID NO: 5058

SEQ ID NO: 5066 - DNA, 1200 bp, mus musculus; identical to SEQ ID NO: 5058

SEQ ID NO: 5067 - DNA, 1200 bp, mus musculus; identical to SEQ ID NO: 5058

SEQ ID NO: 5068 - DNA, 1800 bp, mus musculus
cagcaactttgcagacaaagatcattatccaaaaacgaaacgaaaaaaaaaaatccagacctcactaaagaagtatgcgatgtcatagcaagcactggagggcaatcctgaaagaagtttaaaaaggtttaagtaattacaacatattcatggactggaagatttaattctgcacagatggttgtatgttcaatgatcaacactcactacaaaattctagttaactttttacggaaattgccaggccaaccctaaaactcatatgaaaattaaaggagtcctgaaatacagaaacaaagttgaaagagtcataactcctgatttagagaacattctaacttaaggattagacatttgaatatgtgacttgttccacatgtatgtaatatattttatctagcatatactggtatttagtaaaactattaaaagacctttatatttttccagttatgcttaaggctcttgcatatataatactagagagtgggtaaggtgccatttaattccatgaatactagttcatctctctttgtatatttacattacaaaaatatctcaagtagcctcttttatttaatcacttatgatgtaattgacaataaaaagtctttcactgtagcaatcaatctaccttacccgactgagaaataattttaggtgatttatatttattgtctcagtttctattgtttctattgttgtgacaaaactacgatccaaaacaagttggatggggaaaagtttatttacctccacatcactgttcatcattaaaggaagtcaggacaggagctcaggcagggcaggaccctgtcagcaggagcggatgcagaggccatggaggggtgctgcttactgccctgctcccatggtttgccttgactgcttccttataaggcagaggacgatcatctcaggagtggcatcacccaaaacgggctccacccctatcaatcactaattaagaaaaggccagtttttgtctataaacagatcttacggaggcattttctcaattgaggcttccttctctttgaatgactatagtttgtatcaagctgacatacaaagcagctgacatgcatcatatcaactcccagaaatacatatttcctgataaatttagagaaacaatccagagcataatatgtcaggaaacctttcttgatgcttaattgtaatttggaacacttattggctctaatattattttaaaatacctacacatagatgttttatataccaagactgagaataattaactgtatgtgtcttacctacaaaccactgatttctaagttggtcactattccttctggctgatgattgcttctgatgacagataaagaatttttttttgtttttttgagacagggtttctctgtacagccctggctgtcctggaactcactttgtagaccaggttggcctcgatctccaaaatccgcctgcctctgcctcctgagtgctgggattaaaggtgtgcgccaccacgcccggcagaattttttaaaaatctaataatagttgaaaactggagtacagattacatgccacccctgatatgtatgtacacaaatacacaaaccaaggctgaaattttgatttactgacaactttgtacaaattatttgcctaattctacttgggcatataagagattgtgtgacttcaatgtaacttcaaactctacttttctgattcacatagcatgtgacatcgaggaaatcatttaagccaaatctcaatttctacatctataaaacatggacaatacaaagaagaatttcacagagt

SEQ ID NO: 5069 - DNA, 1800 bp, mus musculus; identical to SEQ ID NO: 5068

SEQ ID NO: 5070 - DNA, 1000 bp, mus musculus
atggtacaagataagatagttgaatcctcctctgaaggtgaaataaaatagatattaaagatggatggagggaagtaaaggggtgggagagaggaggatgaggatgagaaggagggggcatcagatgtaggaagagcaggggagacaacagaaatcagtattgggcaggggtgggcttctctaggtcatgccagagactgggatgaggaggaaggccccaaggtgttataagggtactataggtgctgagactcctaacagtgggggatatggattctgaaatggtcacttcctgtttccatccaggactcctagaggagggataaggacagcaatccacccacaaacgctttgacccaaaatatgtccagcctataagatgtgcaaggacaaagagcagtctgaaggaatggccaaccaatgactggccaaaattgagacccatcccatggccaagaaccaattcctgacactattaatgatactctgttatgcttacagataggagcctagcaaggctgtcctctgagaggctccatgcagcagccagtggaaacagatacagaaactgacagtcaaacactaggtggaggtaggggaatcttgtggaagagctggaaaaaaggattgaagaacctgaatagggaagagactccatacaaagacgagagagtcaactaacctggacccttatgggttcccagagactgaaacaccaaccaaagagtgacctgtggcccgtcccccagcacatgcgtagcagaagtgcagcttggtcttcatgcagatccccccaacaactgaagtgcagggccgttcctgaatctattgcctgcctatggatcccattcccctagatgggctgcctcatctagcctcaggagagaggatgtgcctaggcttgcagtgatttgatatgttggggggattgtgcagggtgactcctcctcagaggaaaagcagaggtgggaacaagaataggatctgtgtgaggggatac

SEQ ID NO: 5071 - DNA, 1000 bp, mus musculus
tagaaggaggaataaaatagtcataagagatagatggagtgagggggctgggtggggaggggatggggtcagaatcaggtatggggagggacaggagagatggccatcagaatgaatggaaatctgcaactggtaggggtgaggaggtagaacacacatccagaactagacagagacctggggtaaggaaggtacccaagaatcagtgagggtcaccttagctgtgactcacagcattggggataggaaacctcaagaggccaccctctgtagctagacaggaaccccagtggaatgatagagacaccaatccaatcacaaaacttttgacccaaaatgtatcctgtgtgcaagaaatgcaggcacaggggatggagcagagactgagggaatggctaaccaataattagcccaacttaaaacccatctcatgtgcaagcaacaatccctgacactattaatgatgctctgttatgcttgcagatagaagcacgttgtcctgagaggctccacccagcagctaatgcagaaagatgtagacagccacagccaaacactggatggagctcagggactcttatgaaagaataagagaaaggattgcaggccctgaagtcaataggaacttcacaggaagaccaacagagccaactaacctggacccttggggctcttagagactgaaccaccaaccaaaaaacatatatgagctggacctaggtcccctcacatatttagtagatgtgcagcttggtcttcatgtgggtcctaaactggaacaggagctatcccaaaagctgttgcccatatgtgggatttgttgtctggccccagtgggagagaatgtgcctagacttgaggtaccagggttgaggggatacctgggggagggtacacagaggagaggaggtgttgggtgaagggttgtgggaggtggtgaccaggagggagcagtgagcaagatgcaaagtgaataagtaaaaataataataaataataa

SEQ ID NO: 5072 - DNA, 1400 bp, mus musculus
ggtttggtcttctcaatgtgtcctggatttcctggatgtattgagttaggatctttttgcattttgtattttctttgattgttttgcagatgttctctacggaatcttctgcacctgagattctctcttccatctcttgtattctgttgccaattcttgcatctatgtttccagatttctttcctaggtttactatctccagtgttgcctcactttgcatgttctttattgtatctacttccctttttaggtcttggatgattttattcaattccatcacctgtttggtcttgttttcctgcaattctttaagggatttttgtgcttcttctttaaggtcttctacctgtttagcagtgttctcctgtatttctttaagtgagttattaaattccttcttgatgtcctctaccatcatcatgagatatgcttttaaatccaggtctagctttttgggtgtgttggggtgcccaggactgggtgggataggagtgctgcattctgatgatggtgagtggtcttggtttctgttagtaagattcttacatttgcctttcaccatctggtaatctctggagttagttgttatagttgtctctggttagagcctgttcctcaggtgattatattagcctctatcagcagaccttggagactagatctctcctgagtttcagtggtcagagtactctctgcaggcaagctctcctcttgcagggaagttgcccagatatctggcgttcgaacctgcctcctggcagaagttgtgttccactcaccagaggtcttaacatcccgtggagagtcctgtggagaccttgggggtgtccacagactctgtgcccaaggtgccctggtgctggttgctgaccggaagggtgacatttcaattcttaacatctatgcccaaacactcaagggcataaaattttataacagaatcactcaggactgaaagggaggtaccttagatgaaatgcccaacaaacagtggagagagggaattcatagagtacaacgtatctacaaggcgaagcaagaacttgaaaatcagcaaaaatgaaaaggggatataataatagatattgaagaaatccaaagaatcataatgtcatacctgtacattgccatatcagaaagtctaaaagaaatgtataatttccatcatgcatgttacttatcaaagtgaaatcaatatgaggtaatcaatttaaaagaactataatactcagtgaaagaagaacccctcccctccccaaataaaaaacctcaggcccagacagttttagtatagaattatatcagactttcaaagaagaagtggcatcaagatttctcaaatattacataaaacagaaacataaaggaccttatccagttcattatatgaggttactgtt

SEQ ID NO: 5073 - DNA, 1000 bp, mus musculus
ctacttggtagaacatcttgagcaggattaggaggcatggccttgttggaaatattttgttagatattccaagctaagtctttccttgactccttatagatagaatttgagctctgagctcctagtccagggactatttgcctgcctaacagcagccatgctcccttccccacccctaaggtggtcatggacacactctttgaaactatatgtaagcaaccaatgaaatatgtcgtttgtaacttaatttggtcatgggatctcctcagaacaatagaacaggaactgagagaaatgaaaagtttagacagcagtgcctttgaaggctgaccctgtttccttcagatgtattggttttaaaatgctaattcccaatttcattttctctaatttccaactctgaaagtttaggttaaataactataaagtgattatgaaagttcaccaaatacatatgtggcaaattaatttttaaacattaaatctcagagagatttccaagcagacatagacttaggaaaaataaagtttaattgagttaggatagaattttacttcaaccaaagaaaacatatattttaatcactaacaaaaattgtagaaccacaaagacccgtaaaaagacaaatggttctcttctacccacatgggaaaatagcacagatatatatatagcactgacctttcaactaaccctgcaaaatgaaattctcatctgcaagtctttatagaacacaaaggctagtttagctgtaattttcagcatctgttccagtatattgttttagttaacatcatgaccaaaaataactcatgatagaaagggcttctttggctcatacttccacatttgtagtccactgctgaagacagtcagggctagaactcaaatagagtgataacctcgagacaggagctgatgcagaggtcacagagggctgctccttactgacttgctcctcataggctgctcagacagctttcttatagaacccaggac

SEQ ID NO: 5074 - DNA, 1200 bp, mus musculus
gctattaaaaacaaggataccatgtaatttataggtaaatggatggaacaaaacaatatcctgagtgaggtaatccagatccaaaatgatatgcatggcatgtattcacctgtaagtggatattaattataaagtacaggattatcatgctacaatccacagacccaacagagctaagtgacaaggagggtccaagagaggatgcttgaatctcactccgaaggggatgtggatggagtgagggaactaataggaaaaaagatgggggtggagtgtgtgtatgtgggggtgtgggggatcatatgtaggaagaaccaggaagagatggccagaagagtgaacaaaacgtggtggatgagggctgcatctctaggatgtgcaagagatctggaatggggaggctccaggaagtttttgagggtggctctagctgaaactctttgcagtaggggatatggaacctgaagttactacctcctatagccaagcaggactaccaatggagtgataagaacactaaccacccagacaaacttcgaagcaaaatttgtcctgtctacaagaagttcagggacaaagagcagagactgagggaatggccaaccaatgactggtccaacttgagatccatcccattggaaagaaccaatctctgatactattagtaatactcggtatgtttgaagatgggagcataactgttctctgaaaggttccacccaccaactgattcaaacagacacagagacccacagccactagacagagttcaggaagaattgtggaagagtttggggaaagattgaggaagccagaggggatagggattctacaagaagaccaacaaaatcaactaaactgggccattgggagtttccagagactgaaccaccaaccacagagcatacaatggctgggactaagccccctgtagatatgtagcagatattcagctcagtctttatgcaggttcccccaagaaatggagcaggggcatattatggctctgttgcctggctgtggatcctattcctctaactaggctgtcttgtctagcctcagtgggagaggatgtacccagtcctgcagtggtttgaggtgccagagtgggatggtaccatgggacacctcccccttctcagagatgaaggggggataagaacaagggaccatataatggggggaatgggagaagaggaa

SEQ ID NO: 5075 - DNA, 1200 bp, mus musculus
atgcttaacaggtaatatataccttaagtaaattgtccatacacaatacagcaccatatataaagagtatacattctgaaaacatttaaaaatttaacattgagcccttccggtcggcgccagcaccgggtctccttgggcgcagagttggtggacactcccccccccccaggtccctagaggactctccacatgatcttaggaccacgggtgagtagaacacaacttctgttccattccaatcgcgtgggacctgagacagcattagggaagcactttgggcttggagtcggcagatacctcccctcctccccaaggtctctagaggactctccacgtgatcttaggaccatggtgagtggaactcaacttctgttccattccaatcgcatgggaccagcattagggaaacagaaaacctggcctgaccagggtcacaagtcccttctggtcggcaccagcaccgggtcaactgggcgaagagtcagaagacacccccaaggtccctagaggacagcttctgaggcagaccccatttcaggctccagatatccaggcaccttccctgccacaggacaggtgtcttccctgccacaggacaggtgtcctccctgcctgggagggctttgctggagcacctggggaatccatcttggatcccagatccctccaagactagtctgctcagatgagagtgtggattacagaagctaacagtttctgggacaggccctgtttcaggccttcatcttctgccaggagacacgtccgaacaccagatatctgtgcaccttccctgcaagaggagagcttgcctgaagagagtgctcagaccactgaaacttaggagagatctagtctcccaggtctgctgatagaggctaacagaatcactggaggaacaagctctaaccagagacaactataacaactaactccagagagtaccagatgtcaaaaggcaaacgtaagaatcttactaacagaaaccaagaccactcaccatcatcagaacgcagcactcccacctcacccagtcctgggcaccccaacacacctgaaaacttagacacggatttaaaggcatatctcatgatgatggtagaggacatcaaaaaggactttaataactcacttaaagaaatacatgagaacactgctaaagtgttacaagtccttaaagaaaaacaggaaaacaca

SEQ ID NO: 5076 - DNA, 1600 bp, mus musculus
ttgcttttggtcattctgtttatcacagcagtgtttgctatttatcacatgaagacagaaatagggccgatccagatggaggagaagatgggaaggaacttagaggattaggcggaggagaaaccataatcaggatatattgtgtgagaaaataatgtattttctttctttttttttttccttaccctcaagcctttgtttttttctttctcacttccacacaacagaaatggtgtggtacagaactgaggggaaaaaattggcagtctttgacttttttttttagtggggaaggaggacacaaaagacaacagagttggggcctaaaccctatgccttttgctgctagcattctctcatggagctacatccccagtgtctgctggatctttgatcaagtctcacctgtggcttggggtaacacagaaaaacaatttcactccagtccccaagaattaaatctttttggcatcggacaaccagtcgtattgcacagttcagcagttacagggaaaacaccacctattatacagacatgtggcaggggacaggccaaatcttgctcagggcttctggttaaaaccgcagcaagttttctgggagttggcaactgaaagtaacttctagaaatgaacaggcacccaggggactctggaaagcacttaaatttctggtcttcacaggaatctttatccgggggcctctttcttggccactgaaaagcgtctttttctggaccaaaggagagggatgtgttgatcactggtcaggctggagggtgtcaggagggtcaagagaacaccactagaggaagtcaagtcaatcgcagaccaatggttcaaaggtctagaaaggaaggttgcttgggctggatcctttcccctccttttctccgattaaatacgaaagccaacaaagacgaagatacgaagatacagttgttggctttcgtatttaatcggggggaaaaaaagatgaagatacgggaaaaggacgacaaagaaagtggcatctcgtgtatcgtcccagcggagccccttgttggcctggttctcctgctttttgcgaagggcttccctccgcagaagccattctctctctagctgctctccatagagcgcctagtagaaggcatcaaagtcgaacatggtgcgactgtcgctggaagaagcccgagagccacctggagcccgaggggtgtagggaggagggcgaggaggagtgggattggccatgggagtcttagagggcttgatgccaggttcacgcaggtcctggtcgctgagcaaacctcggtcatacttgcgcaggaggatgatgctgcccaagaccaggtaagcttcggatacacgcgtgaagcgctcggcggccttggcgctcccggggttgagatccggatggtagaggaagctctgccggaagtacgccgctttgatctgtgcctgcgtggccatggaggggacgcccagcagctcatagagggcagtgcaggagtaagtcctccctcgcgagcacaaacccgtggcggaactcggaggcaacccgcggacctgccaccatctccatagcggtgacagggtcatgtattttcaatagaaaa

SEQ ID NO: 5077 - DNA, 1000 bp, mus musculus
catgggggaaagcaaaaagacctggttgtgactggtaaggagagcttaagacaaggtagggaatgacttacacatgagcacaagagttgtggagacatagtaaacattgcaagaagttcagtatttgtgctgaggctgtggagaacatagaactggaaggttaaaatagtttggcttctccatcctgccaaacagaaagtagcctggcagggccagacccggagcaagcagctagggtagcatgtgctcccaggctctgggtgagttaatgtgtctgggatgaaatggaatggagctgaagagaaacgcaggtatgaagataaccaatcagaatgaagggactcagaacatgatgtgttaggcagagagagaggcatggttacggcgattaaggctcatctcccatctccccacttggtgaactaggaacgtggatggaggagcaactgtggtggagaaacggtgtatgcttttgagatggactgagattgaattggaaggcatgtttagaactcagggcttgaaacacttgtatcctccatgtcttccctccctctgagagcagccctggatgtcctctgtgctcctcagtgatcagtgagaacttgttctgatgattgatgccatgagggagtggaagccagaagacaggtactggagaagaagtgttcaggagagaaaggatatcgagagggaccgccagtgagaaagaacgtcagagccacctaaacaaagtcagaacacgcctttcacatctcactgctgaaccctgggagaactaacacctcacgagtaggattaagaacttgtccgggcagtggtggtacatgcctttaatcccagcacttgggaggcagaggcaggtggatttcccagttcgaggccagcctggtctacagagtgagttccaggacagccagggctatacagagaaaccctgtctcagaaaacaaaaacaaaaacaaaagaactgtaatattctagcatccttgaaacaggc

SEQ ID NO: 5078 - DNA, 1000 bp, mus musculus
tacagagaaaccctgccttgaaaaaccaaagagagagagagagagagagagagagagagagagagagagagagagagagagagagagagagagagagcaggctgaggcaagccagggcaggcaagccaataaagaacatcctttcatggcctctgtatcagctcctgcttcctcacctgtttgagttccagtcctgacttccttggtgataaacaacagtatggaaatgtaagctgaataaaccctttcctcccaacttgcttcttggtcatgatgtttgtgcaggaatagaaaccctgactaagacagcaagcaaacctgatgatccaagatgcatccccaaaactcacaatgagaggagagaggccacttctgatagttgtcaactgactccctcatgtgtgcgtgccttggtaccacacacacatacatacaccacatgcataatacataagataacatttataacattaaactgcatagacatttttccattctttctttttcacggggtctcttgtatcgcaggctggtcctgaacttgctttataaccaaggatgacgttgaaagtcttatccttcagcctccccttcccgagtgctgttacaggcatgcaacaccatgtccatgtgatattgggaactcggggctttgtacatcaagacaagcacactagcaactgagctaacctagctaaggatccaggaacttagaggttcctgttatttgctaataaacctcatgtgtgccctctgacttggaacactctgcatctgaagagaacaggagaagcgcgataggaggcaaaggaaatggttttccaagacagctctcgctaatggcagacaggatggaggtgtgaaagagtgtggatgtgggagcagtcgtgaagcctgtgtgcttcaaaggaaaggagagagcggcaatctgttcttgtgcttccacaagttaacctgttggggttaagttgagtgactttcatgacccacgatattaatt

SEQ ID NO: 5079 - DNA, 1000 bp, mus musculus
tcatgcttggcccctcatcatgtcacatctgtctgtccttgctgataccttctgagttcctagcttctcagttcactacttacatactatgccacttccatcatctctcttctggccttttgtcttagctattagcctttatttcccttgagttccgctatgactttgacattgtaacaatacaagtcctagctatcaactctctcacattattttgggtgcttaaaaaactagatttacttcccaagaaatctttattctgatttgcaatgatctccttaggtttgaaccacctgatccccttctctgtatctctttttcagacccagaatggcttgatccactagcctcacctctcactagacatagaatgccctgcctgttgtctttgccagcccataacagtgctccccaccgttcctcctttgtcctgtgctacctgtctctcccctttcagtcagacatgaccgttggtgctcttctcaagggtttctctcttgaggctttctctgactttccctgtcttcctggtgtttttgctttgggaactttattttcacatagtcattaccctttctgagaggttgtccccagtttcctgggtaccagctgagctctgcactgaggctcttagctataggcgactgcaaagtcctacactgccttctttgcccaccagctgctggcagagcagtaggctggggatgctaatgactgatacctgttggatggaatttatatggctgtgagaacacataataagcactcatagtctgttactcaacatttgccctgaggttttctacagcttctaatgtagatgcctgagtgaaccaaatggacatggaagcctggcggcattggttgagttccctgttagagctttgaggggacagtggccacccttctgcttggcttgctttcatgtgttgttgaagttagacattaagaaatagagcagacctggtaatagagaaaatccttgagcaggtcgtgtttt

SEQ ID NO: 5080 - DNA, 1200 bp, mus musculus
agagtcacatgctagtctaatgagtcatattggagagtcacatgctagtctaatgagtcatattggagagtcacatgctagtctaatgagtcatattggagagtcacatgctagtctaatgagtcagtctttatatgtgacttggtctttttcccttgcagctttaaaattttaaaaataattttctgagactttaatataatttcatcattttcccttttccttccccctctccacaccctgccatagactcttgctctctttcaagtttttggccgtttttaaaattaatttttacataatacacacacacacacacacattcctaaatacacaagtgcagcctgctcagtttgtataatattacttacatgcatttgttttcagggatggccctttggtattagacaaccagctggtgtgctcttggctgggaatactgttgccccagctctctgcagtcctcagttgcctgtagtcctttgtgtggagttaagacctcacagggtttcctcaccacatcaacctttgttattttgtttttcctgcttgcagctttgttttttaataatattttttattagatattttctttatatacatttcaaatgctatcctgaaagttccctataccctcccccaaccctgatcccctacccacccattcccacttcttggccctggtgttcccctgtactggggcatataaagtttgcaagacctaggggcctctcttcccaatgatggctgactaggccatcttttgatatatatgcagctagagacaagagctccgggaggtactggttagttcatattgttccacctataggttgcagatccccccagctccttgggtactttctctagctcctccattgggggccctgtgatctatccaatagctgactgtgagcatccacttctgtgtttgccaggtactggcatagcctcatacaagacagctataccagggtcccttcagcaaaatcttgctggcatatgcaatagtgactgggtttggtggctgattatgggatggatccccgggtggggtagtctctggatagtccatcctttcgtcttagctccaaactttgtctctgtaactccttttatgggtattttgttccctattctaaggaggaatgaagtatccacccgttggtcttccctcttcttgattgtcttgtgttttgt

SEQ ID NO: 5081 - DNA, 1000 bp, mus musculus
ttagattttgttagtaaacagctcattgttctgagagagctgtgccacccatctggccctacagttttaatagaaaataaagagtgtgagtggaatgatcaccgccatctagttaaaaaagtggcattggatcaatacatctttgaaagttgacagaggacaaggttggctgatgacggcactgatgtacagtcagaaacaccccagggttggaggcatcgccagtgcaatagcacagcatctggagaaccttgtgatcgcttagcccactgaagctcagttccccagctggaaatttggacagaatggccacctcacaggcttccctgaggactcagaatatagtacaaagcctcttgaagcctaggtccaatactgcgactccattgcccatcaaattgagttggctaaagcaacctccaaggttgtcttacactcacagttgtctggactgtcatttgatggcagctgctgtgatgatgagagctgatgtgaagtcacttaggagaagagagctgctttgcagttgggcgaccacagtgtatctgccatttatatgctgtagttagcattttaatagccctagcacaagtaccaaaatgaacaaattaaaagagaaaggataggttttttttctcatgatttcaaaagtttcagttcctagtcctcatctccatcagttctgagagcatagagaggcagaaaagatggcactgggagtatacaacagaagtttcccacgtcatggtgaccaggaagcagatgagaggaggggacctgcaaacccctcaaaagccatgcccctagtgacctgcttcctctcgacctggtaacgtaggtctcacctcctaaactttccaaccccctcccccgaatgctattagtgacagaggatgtgttcagcacatgagcgcgtgtgtgcatgcgtgtgtgcatgtgtgttgggtggggtgggcagatatctcatgtcatgccgtaacagctgcagatatttacatcg

SEQ ID NO: 5082 - DNA, 1200 bp, mus musculus
gttcaaacctggtcatcagaaaatggtagagagcgaattgggagattaaacttaggctgatggtgggacccatcgtctgtattgctgtgctcaggcatagcgtggcaaccatttgtatggatgtctcctgctcatggagattgcattcctgaaagggtttccatgttggatcagatgatcagactcccataggaacacttcacggaaagaaggacccacttgaaatttccgtggtgtcagtgtgtccagagacatgattttaagttatagacaaggatgatgggatggagcagctgaactcctcataaaatctaagtcaccgtaaagagttctagtgtgtggagcgatgctctcgagaccacgagagccagtctacctaatgaggtctgcgcatgaagtaatgagagtctgcacagtgtttggatgccaagtaatgggaatctgcacaaagtttattcagcagtttgggcagaggtatttgatttaaacgatgctcgaatgcatcctattctcactttctggatgtctgggtcaaatctaacccacctgagtctggaagaggtctaatttgagtgtgtgcactcaacatttcagacccaagcatggagcccccagtatttaactgtagaaataaaattgtcagttcaagtgtctctttcctattaaaatcattccgcatgcaatttaggtttctattcttgtactcgttggctttgtcctcgaggagcaggatggaggcacatcgtgcttttgttgcagagtgaagcagaggtagtgctgtcatctccctgaagggtgacagttcctggttcctccacacctgcagagccctagacaacacatcacattcacctagtgtgcctgggaaagcatagtgtttatagtgtttgttcttcttttttcttgctgagggcttttactccaagcttggtctcagatccaacacaggagtcccagccttgtctactaaggagagagcaagggagtggacctgaagctttgtcacgtttaatcgggtggcctttcctaggattgactgattgacttgcagccttcaataggttttccaagacatttaggaaatacagtgttttcttttctctgtcgctgacattagtggcactaaatatttaatcacggatgagggctgcagacgctgtcccagagtgataaataatgagcccctgtacatttgtgact

SEQ ID NO: 5083 - DNA, 1000 bp, mus musculus
aaacagctttactcacaaatgttaagtgtaatgggtccttggtctggtttgaggcctctggcttctgctacactaccaatcctggatcctcattggaactccttctacatattgggttgttgcttatgtcatggagatccttcagctctacatataccggaccagccctttcacatattccatcagtagttcacagatggcgtggatctgggtctggttggtagctcagtcagttagccaaccagtgcttctgtgaccacaccaccagggccagctctcctgctcttttgcccttgggtggactgtgccacacccacacaaccagggccagctatgttatccaggctagatatgagtccagatttgcttagtgtaggagctgtccaggggtcaggccagatcagcacagtgccctatgggtggcagtccagatcattgatgcccacatggtctttggtggtaacctgttcacagacatcaaaggcctccgcatggccctcagcagcagcctgagccaggacatcaccatgatctcaggtagttacacaaactactcagatcaaattttcttccaataacccccatctgccaacctccccaccctagtcctcagcaccctaccatcacattagtgcggctcctacccctatccccagacattaacatgtcagtggcagctcagaccagtgacattcagatgcccctctatggcaacacagaccaagtcaccatcacagatcctggttgcagtagtgcctcagacacagaaagggcccttattggtagcccagcctgggacatcaccatgaccctaggtgattacacaggctcattatatctgtctgttcatcacttccagttctatgtctcttcacattaaatacgtaaattcgctttctctctcatctcttcactatgtatttactccctctttctgatctctccatcacgtatttgttcagcatagtggcatcacccataggccccctaggtgggaacc

SEQ ID NO: 5084 - DNA, 1000 bp, mus musculus
acctggttccacatgtagtgaaggaagctgggtgtgtactgttcttgttctttgggtgtgagcatcatgctctattaccaagatatgctgcttgctcttccagtgtgcctgcatcatgtcctctgtcactgttggcatgaagaacagagagctcctctccaaggaagatgtctgacgtgtttacccactcagagacattctgtcctgcagtgctccttgagcagctgatgtgaacagattgactccctggggtttcctttcctatgtagctccaggctgctgtagtcaattgaagacactggcaagagaagaaagggcaagagaataaagggcaagagaagacactattgagacaatacccatacctacccaactcccttacagtgccagtatctctttggcaagaggctgtagccattataatcacagttccctaaactgtccctagttttcatcagtattccttatcttctttgctccttttagcttgtaattgattctgggtatctcaattttatttttgaagtttgatttttttatatgcctctaccactctatgttgtttcattaaaatctttctagtggacccatctgatttggattgtatattattagggctgattaatataaagaaaacatttgtgtactgagtagtagaactgcctctacctccttcatgaagacttttgtcaaatgtcctttctagttcagggaaaaatgaagtccagcttatttgaactgctcagccatcactgtgatctgacattgttttcctgcttagcagaccgtgtgcactactggagaccaatctgtagccttgatacgctgattcactatgcgctgcctgctctgccctggcagcagattgattgacttctgggcaaggaggctcctggctgagctctcgagttgcccactatacttgccaaggcttcaagtggctctaatgagttttcccatgcacaagctgtagcctaacatgcctgtttgcagtaagcaa

SEQ ID NO: 5085 - DNA, 1400 bp, mus musculus
tgagttgtcttaagagaaagaaaacaccttctctaatgagaggcagtaattctttttttaatttaatttaatatacatcctgctcactgccccctccagtcactcttcctacaatccttcctcaacctcccttccttctcctccaagtggcagggtcccctgagtaacacccactcttgtacttcaagtctctggaaggccaggtgctttctctccaactgaggccagacagggcagtccagctagaagaacatattccccttaggggattaggcagcagcttttggaatagcccctgttcaagttgttcaggacccacatgaagaccaagctgcacatctgctacatatgtgcaggaaggcctaggtccagaccatatatgttctttgattggtgtttaaaactctgagcatccaggttagttaactgtgttggtcttcctgtggagttcctatgaccttcaggctgcaatacttcctcctactcttccgtaaatgtccccaagctccatccactgtttggctgtgggtatctgcatgagtcagcttctgggtggagcctctcagaggacaacttgctgctatctgcaagcataacagagtatccttaatagagatagggattagtgcttgcccctgggatgggtctcaagttgggtctgttatcagttggccattctttcagtctctgcttcatcttccttacccgcatttcttttagacatgatacattttgggttgaaaattttgtgggtaggttggtgtctctatcgcttcactgggttgcatctacaggagatgacttcttcaggttccatatgcccagtgtagtgcgtcacgggtaaggtcatcccaattcattcttgagtgtctcccttaacccaggtctctgtctcatccttgagatgcctctctttactcactcttgtcagtttcaaatttccatccatttccatggccatctagctatctctcctgtatttccccatacatgatcctaaaaaccccccttcccttctccatctcccctctttcccatttccctccctccatctaaaatgtagtaattattattgccaatgataaatctagacaaatacaattataaaagttaacattaatcaaattccctaaatttctaggtaagaattgtgaagctaaaataatataaaaaaaaaaaacaaaatgtataaagtaagtgggaaatttgtttggaattgataggatcttacagccttgaagagttagaaagaaaattgaaatattatttactgttactatgcatacctactaatacagtagcagggaagaaaaatcatatacaatatgaagatgtaagctaactaaaaacataaaaatgaatgacaaagataaagccaaatacaaatgctatatatatat

SEQ ID NO: 5086 - DNA, 1000 bp, mus musculus
gagaagagaagagaagagaagagaagagaagagaagagaagagaaaagaaaagaaaagaaaagaaaagaaaagaaaagaaaagaaaagaaaaggtgtgtcatacctaggtttctattgccatgacaaaacaccatgaccaaaagcaacttggaaaggaaaagatttatttcagtttacagttagttccacatcacagcatgtcatccaggcaaatcggagcagaaatctagaagcaggacctgttgcagaagctatggaggattgctgcttactggcttgctcctcatggctttggtatggcacccaggatcaccaccccatatccacagtgacctgggacaccccacatcaatcatcagtccagatgattgataccacaggctttcccacagtcaaaactaatgggagttctttctcaattgagactccatatcccaaaatgattctagcttgagtcaagttgaaataaaactagtcagcacagaatgacttaaagatcctctttctctgtagtgacttaagaacaatgggaaattggaaggggaagtttcctctaggactagcatcttgtgattaatagacgtatcattatgattagcaagaaggataaagaatagtatcctcatgaggaattgtgatgaatctcaataataccaagaaggttgccataaaccgaatccagaatgctatggtttgatacctcggtgttgtggtctcatacagaacttgatccaggtgtctgtgctgctgacacacacagaggatttcactctgcggcagttgtgtgctttgacagagacacacaatggatccctgtgtgtacgttttgtttgcattgctcaatttctttctgcagcttaaaggagacaaatcaaactctgtcaggggaatgcgcttggccacagcatggtacgaattttagttagaccaacaatggtcatctgtcaagatcctcccactaagactttgactgtctaggtttaccaaaatgcaactgga

SEQ ID NO: 5087 - DNA, 1800 bp, mus musculus
tgagagaagagaacagattactacagtttgtccacagtgtgtgtgtgtgtgtgtgtgtgtgtgtgtgtgtgtgtgtgtgtgtgtgtgtgtgtgtgtgtgtgtatttaattaattacaggagtccatgctgtatcacattattttttccttctaaaataccttttgctgctttcgaactattctgaaatagaactggctttaatttggtttcattgttggcgcattgtttgttttggtttgagctaacttggctagtgtcggaactcattcattcattcttccctggtgggcaactagatgattgtaggacaactttatttattttcttgtggttgacaagatttgaatatatgtgtctcatctttaatcagccagcaggcaagcccagtgcattaaactggtctctccagagaagtagaagtgataggatgtaggaaacgtggtggaataggaaaggaagaagagaggaaaaatttgtttataagtaatttgcatgtgtgactctcttaattattattcttttgttgtgcagagacaccctgaccaaggcagcttatgaaagaaaagcattatattgggtgcttgcttaaagtttcaaaggagtgttagtccatgatcattatggcaggaagtatggtggcaggcagacatggtgctggagcaatagctgtaagcttatatccttacctataggcaggagcaaaaagagagagggagataatgtgctttatatgagcctttcaaacctcaaaggccaccacaattgcaaacctcctccaacaaggccatacttcctacttcttcttaaacagtccaccaagtgggacccagacatcccagtatattagtctgtctgagccattctcccttaaaccaacgcagttactgtgaagtctgagttgctcaaggatttgcacatggtaagctagtgaatagaagaactgacagtatagttttagtctaggttcaaagcttaggaagttagttttattttaaattattattattattaatttttcttctttacactccagattttattcccctcctgttcctattcccaccctccaactgttccacgtcccatacctcctcctcctgtccccctccacaaggatgtccccatcccaccacacccccaccagacctctaaactccccggggcctccagtctcttgagggctaggtacatcttttctgactgaatgcagacccggcagtcctctgctgtatatgtgttgggggcctgttatcagctggtgttttctgcctgattggtgatccagtgtcagagatcttgggtccaggttcattgagactgctggtcctcctacagggttgccttcctcctcagcttcttccagcttttccctaatttaaccctaggggtcagcagcttctgtccactagttgggcgcaaatatctgcatcagactcagctgcttgttgggtctttccaagggcagtcatgataggtccctttttgtgaatgctccatagtctcagtaatagagtcaggccttggggcctctccttgagctggatcccactttggacctgtcgctggaccttcttttcctcaggctcctctccatttccatccctgcagttttttcataccagaacaattatgggtcagagttttgattaaaagagctcatatatcagttacattctgtaggtagggaaggaaggatgatgaccaaaaaaaaaatgtatgtatgtatgtgtatatatgtatgtgtatatgtatgtgtgtgtgtgtgtgtgtatatatatatatatatatatatatatata

SEQ ID NO: 5088 - DNA, 1200 bp, mus musculus
aagtttaaaggaatgaaatttaaaagaaatgggagtggttagcctttctttagagacttgtttcctgaactatttaccattcacagtgagacagtaagtcagaaatgaaaaaacacatcatcatcactaacaggagtccatcaaatatgcaagccattctatccatcagcaaatattctgtcttcagaagatacacagatatgtccttcagttgagaaagccccaagatcacaaatcattatccaccttggaaacagaaaatatcaaatataaatttctaaattaattatatttgaaatacttaatatgtaatgcagaaaatgtgaggattaaaaaatagatcaaatataattcaggcaaattttcagtattgtgattagaatctgaaactctctcctacaggctcaggatttgactttttgctcctgaacttatcaaagtatttggaactcatttcataagtaggtcattgggagtgggctttcaaagctcttgacagctcttgattcctacttcagccactgcttcctggtatgtggtcactgaataaaccaccaccctcatgttcctgccaccatgcctcccctgtcataacagactctttttttaaattaggtattttcttcatttacatttccaatgctattccaaaagtcccccatgcccttccccccctccgactccccctacccacccactctcacttcttggccctggcatccccctgtacagaggcagataaagtttgcaagaccaatgggcctctctttccactgatggccgactaggccatcttctgattcatatgcagctagagacacgagctccagaggatactggttagttcgtattgttgttccacctatagggttgcaggtccctttagctccttgggtactttctttagctcctctattgggggccctgtgatccatccaatagctgactgtgagcatccacttctgtgtttgctatgcccaggcatagcctcacaagagacagctatatcagggtggtgagcccaggtacatatttgctttcttccagtgttttaattggatattttggttgcactgatgcagcagtaactaatcaattcagatgtcaattatcaaagttaataatatagattatatttggccttttgcctttaaatgtccaatttcttagtaaagtgggaatactgtgggatcaggtatt

SEQ ID NO: 5089 - DNA, 1000 bp, mus musculus
tttaatgatttttaaattacttcatgggtatgagtattttatgtgtatgtacatctgggcaccacatgcttgtctaataactatggaagccagaagagggtgttgtagccactgaaacttgaaggacaggtgattgtgagccatcaaacggaaatctggtcttttggaatagtagcaaatgctcctagcctctcaatcatttctcctgttcccctgattattttcctaagacttgtttttagacttgccatctatagaagtataaaccttcaaaggtttatatgtcacttggtagatctgtgagaacacagaggtctttactgtcacctgagactgtttttatcttgtttccagccagataatcaggtaataacatagctacacattgttaaatgatagtttgtaacggactaaataaggactaaataaggatctctagtgattaaatagctagctaatccttgaatccacatgccagtaacttccattgtatacacactagattctgtgaatctttgtaatagctgcaattctttttttattagatattttctttatttacatttcaaatgttcatctttcctggtttcccctctgaaaactccctactccttccccttcccctgctcactaatctacttactcccacttccctgtcctggcattccccgacattggggcaccaagccttctcaggatcaagtgcctttcctcccattgatgtccaacaaggccatcttctgctacatatgcagctggagccatgggtccctccatgtgtactctttggttggtgatttagttcctgaggtctctgggggtactggttagttcatattgttttccctcctatggggctgcaagctccttgagatccttcagtcctttctctagctcctccattggggaccttgtgcttagtccaatgattggctgagaacattcacctctatatttgtcaggcacaggcagagcctctaagggaacagatatatcaggc

SEQ ID NO: 5090 - DNA, 1000 bp, mus musculus
ttgttctgaagagataccacaaccaagtcaactcttttaaaggacaacatataattggggcttgcttacagttttagaggttcagtccatttttatcaaggcagaaagcatggcagcatccaggcagacatggtgctggagaaggagctgagagttcaagatcttgatccaactgcagccagaaaatgactgaaatcctcaggcagctaggaggaggatctcaaagcccacccacaaagtcacaacaaggccacacctcaagtagtgccactccctggttcaagcatattcaaaccagtacaaaaaccttctcctgagactagctaagcccttctctctgtgtcatacactatagacccccgaggctctggtgtgtttgagtagttggtagtaggggcttcattagacagccccttgacccctgatttttctggatgtgtgtctgtgagtctgtcctttttctcatttgcttgctgctttagtgaagtttccaggacagagctatgctggatgcagcttgttactttattttccagtgatggacggattatgtgctagctttttgttataatcattatatttcttactttaggtagtggcctagctttttccttctttttagttctcagattttcaccttttaagatctattttcttatgcattgtgtatttgtgatactttgttcttctatattaatttttagttgaaattacagtttattctcagttcctatcatgccgtttcaaatgcttctgtttctgatctgtgtgggtttattcatcactctgtcattttgtgagatatttttttgctttgaatagatgagagttgagttttcatctctagcatatccttctctactgggcttttactcccagatataattttatgtcctattattctttttattcataatgactttctatttgagttctctcttttggtgggaaattagtttcactgaacttttagaagaaagggggagttcagagataacat

SEQ ID NO: 5091 - DNA, 1800 bp, mus musculus
taaaaacatgctcacattaatgcctgtgcacacacataattgcttcatttgagattatactatctaggatgagaatatctttgatttttctgctgacattcaggatataaactcttgcaattaagaacttaacagttctttttatgatggggatggcagggaaatcaacacagcactgggctctgcttttatggaagttctaactaaaacgcactagaattttcaaagtgtgacacagttgttagagaatcatttgattatctcatttataaccacatgcttttaattcataactatccactctggagaaagatcatttgaatttaactattaagatttacttcaagcttaaattggttctaaagtcagaggaggaagatggaagagaaaaagagacagcaatttacatatttatattcattgaactgtttgatagcttcgatgatattgtgcattgtcctaagctcagtaaaaagaataaaaaataaaaattcttgacattcaatgatttctgtgtaatagcaatgtatggataggagagttgccaggtaagtttaataaaatggtatgaaatgcaaaatgtttttaataaaaacacagagaagttctcatacagactacatttgaccctaagggtcttctcagagaactgtgtgatttaatagatttgggacaaaataaaccaacaagcaagcaaacaaacaaacaaaatcaaacaaaacacagaaataaatctgagaacagttaggacaggattgctgcttaaagacaaagtcatgttaggaagaaatggagacagtgatggactatcctgttgtgtgagacgtattgtatttatcatcgagtagcagattcaccagcttcagagctcgggagaaagtaatccatgactaactgtgcacaggggccctgactcgctttgcatactcgtcccctgtgctactttgtctctagatgaggcttcctcttttcctttattgttcttaagcatttcccatttttacatttctcactcagccttggcaccgtaatacttcctactactcttgccctttaagcttccaaactaatgatattcgtaaggatccatctttggattaataaaactatatatactagcaactccctatatacatttaatttaaaagtggtattaaacatttagaaacttttagacactgtaaaaaggccaaccctacaaatacatcgttggtatagatggaagagaaacaaaaacaaacaaacaaacaaaaaaaaaaaaaaaacaggtgaaaccaacagaaagtactttaacaaaaattatagaagacaagttcccaaatgaaaagaaagaagtgcctatcaaggttacaactacaacatccagtgtatctgaccacaaggagtaaggcttgatgtcaacaacagacacaatgtcagaagctataactcatagaaagctaggaacacactgttgaaggaaaatctgatgaagggaaatatcaagaaaggaattgaatgaaagcaaaaatacaatttaccaaaatctctcaatgaagaccggatgtttacagcactgcacttacatgagcaagctgaagagatctcctgataataacttaaagttttgcccaaaagccttggaaaatcaagggaaaaacacagaaaacagaatatgggaagggaaaataaaagtcagacctacaattaatgaaagagaaaaacagaacaacaatacaaataattaatgaaacaaagagtagaacctttgtagggaatagcaataatgaggaaaatttagccaaattaaccaaaagaaag

SEQ ID NO: 5092 - DNA, 1000 bp, mus musculus
cacggaacatgtgaactttgcatcagaaacattttgtgccacccagttttgagactacctgatgatactttctagttccatccatttacctaaaaatttcatgaattcatcatttttaatagctgagtagtactccattgtgtaaatgtaccacattttctgtatccattcctctgttgaggaacatctgggttctttccagcttctggctattataaataagactgctatgaacatattagagcatgtgaccttattacatgttggagtatcttctgggtatatgctagaaaaatcatcctaagtgaggtaaaacaatcacaaaagaacacaaatgtgcactcatggataagtgaatgttatcccaggagctccaaatacccaagataaaactcacaggccacataaagctcaagaaggaggaagaccaaagtgtggatatttcagtccttcttagaaggggggacaaaatgccaatgggaggagatagagagacaaagtgtggagcagagactgaaggaacagccatccagagacagccccatctggggatacatcccatatacacttgccaaacccagacactaatgtggatgccaacaagtgcttgctgacaggagcctaatatagctgtctcctgagaggttctgccaatgcctgacaaatacagagatggatgctctcagccatttactaagcacaaggtccacaatggaggtgctagagaaagtacctgaggagctgaaggggtttgcagccccataggaggaacaacaatatgaaccaaccagtactcccagagcttccaggggctaaaccaccaacaaaagagtacacatggaggaacccatggctccagctgcatatgtagcagaggaaggccttgttggacatcaatgggaggagaggcccttgattctaggaaggcttgatgccccagtgtaggtgaatgccaggacagggacatgggagtagcagggggaaaaaggatgggataggg

SEQ ID NO: 5093 - DNA, 1200 bp, mus musculus
cattgttgaaaggatatactttttttaagtcgatgtccctcagtgtagccccaaccagccaaatactcactaattagaccagtgtaacactgaactcacagagatcctccagcctcccccttctgagtgctttaagtcatacaccactacttctgcctacacagagaatttttaaggcaaagagaattttctgtgggatactgtaatagtgatggacacatggtatcatgtttttgtccaaacacacagaatacacacatcttgagtgaatcttaatgtcatttatgaactctcagtagattgtgtgtcaatgtaggttgattgaatataaaaaaaatgtaaacaagtccactttgcattatctatatactcactggagcatagtcatatttttagtggcctgccccttacacagaacttgagtcctttccctctcacacctctgccagaggccttcagttatggacgttacaagtgagggacctgggaaggattgtgaatggagtacaggaagtgaaacttccagagaatgaatattaatgttaggtggaacgaagtaaacaaaagtaggtatgttcatgatggtatatctgcttgcttatatcataagaaaggcagacgttgagctggtagccaacatgagcttcacccataatgaccagcattcatggtgctgaatggtgttcttcacaccactggagaagaaaggcaatcatcaaactcaccaccttcaaaccctgggatcaacaactgtgacctgcctgtaaaacatactggtacaatggtgtcaggaatgtaatggaaaaaccaaccatttttatttgtttgtttgtttgattgattgattgattgattgattgattggattgactgatttttttaaagacatctgtataacattgctaaaatgttcaagatcttaagactacataggtaataggcatataggaaaacctattaatttcattaatttaaataaacatcgcaataaactgactcctaatgatgtaatactaaagccatagattagtttttcactgaatcttcatcagagaaacttcttgtagtaaactggaattaacagaaagacacaaatggacaatgtccagaaagtaaaagacgttgaagcatttagttctaattgagatgtgttcatcaaacccctcccctcaaggctcaaggatttataatgaaaatgta

SEQ ID NO: 5094 - DNA, 1000 bp, mus musculus
accagcactgggtcaccttgggcgcgaaattggtggacacccccaaagtcccctagagaactctccacgcgattttaagaccaccagtgagtggaaaacaacttcagttccaatccaatcgcacgggacctgagacagcattaggaaagcaggaaacccagaatggccagggtcacaagtcccttctggtgggcgccagcactgggtcacctaggcacggagtcagcagacacccccaaggtcccctagaggacagcttctaagacagaccccatttggggctccagacatccgcgcactttccctgccagaggagaggggtccaccctgcctaggagggctttgctgaagcacctgggggagccatcttggttcccgaatccctcagagactagtctgtgcagatgagagtgtggagtacagaagctaacagcttctgtgacaggccaaagcaacacagcttttgggacagatccttttttcggaccttcatcttctgccaggaggcaggtccaagcaccagataactgtgcaccttccctgtaagaggagagcttgccagcagagagtgctctgaccactgaaactcagaggagagagctagtctcctaggtatgctgagagaagctaacagaatctcgagaggaacagtctctaaccagagacaactataacaactaaatccagagattaccagatggcgaaaggcaaacataagaatcttactaacaaaaaccaagaccactcaccatcatcacaatgcagcactcccacctcgcccaggctaggcacccaaacacacccgaaagcctagacccagatttaaaagcatatctcaaaatgatgatagaggacatcaagaaggacattaataactcacttaaagaaatacagaagaacactgctaaagagttacaagtccttaaagaaaaacaggaaaacacatccaaactcgtgatgaaaatgaacaaaacaatactagacctaaaaagggaagtag

SEQ ID NO: 5095 - DNA, 1000 bp, mus musculus
cctggagttcctgcttctatctcctgagtcttaggataatagcctgcgccaccatggccagcactaagtgatttattaatctcttcaacgtgaagagaaaattatatttgagtgtctaagtaggtaagatgcttcaaaaactgctatttttgctctttaaagtcagaatagttcaaaaggaagggggaaaaaaaaagggaaggaataaaggtgggaaggccgtcggtggggtgtggcctcttttgaaggtaccctggcactttctttcaaacctgaatacaatcaggacaccatgcttgactctatgatactccttcttgttttgtttgtttgtttgtttggctggttgattttgtttatgagatagggtttctctgtgtagccctggctgtcctagaactcactctgcagaccagcctggcctcagcctcacagagatccacttgcctctgcctcccaagtctgggattaaaggcatacactgctggcattgccacagccacagccaccaccacaatcactaccagcaccacctggtgtatggttttaaaaatctgtattgagaacttacatccaagcaaaaccttccttctatatgaatggtgatgacagctttacccagagttgctaaaacgtggggacaccaaagtgtccctcaacaggtgactgagtgcataaaccaactctggcatagcccaccagggacatagcaagtttgaaaagacttgagggaaccttaaatcttatcacttaaatttgtatcttcagtgcacattcgagaaggctacagtgaaagggtctatggccaccagggtttgatgtaagatggcagtttactcttcattgtcagcttcacggactctagaatcaccatggaactacacctgtaagtatgcctatagggatatttctagaaagatgtgactagcatgatggaaaggcctatacgaagtgtcaggacaccacccatggctggggaattctgtgcagaggtccagag

SEQ ID NO: 5096 - DNA, 1600 bp, mus musculus
tatcatgtatgttttttaatttcctctgttacattagcagcgtgttttgttcttcccaaatggttctggggttgagttcaaaataggctgttcattaaaaacaagctgaaatgctctcatgtaagagctaaccagcagtcacaaaactcacaagacagaaacatgaaaaggcatggtatatccaggagagcatgagctagtgcaacagttgaaatgtcaggcaaagaatccagaagtctacttctgaagacagccagtgattcctagatggccacgtccacagtaagaaaattcattcagggtacagaaccacaactcagcaatgtagaagagaaagtgaaccccaaaggttatgtttatacactctgggatgtctaatgttctaaccagagatgtctccatagtgtattccaagttggagaagcaagccccgcattcagacctgtacagccagaccagtcttgtgtggtttgttttcttttcgagacatggtctctttatgtgcccctagcttcctggacctgctatattaactagtctgtccctccaacctacagagaatcagcctgccactgcccctgtgtgctgcaataaaaagcatgcaccaccacgcctgccagtttttacacctttaaaacctgcgcaaccttgaatatgctggaggctgcagatgtcaagcagtccagtggcacgtgagagttctcaatcctgtgacagtgaaccttgtggcagatacctggtttcagaggctggcttgtcagctgatgactggtttggactttatggaattcacaatgattcttaagtgataggtcaaactcttagtgattaaggtgggttactaactaccgtaccctgtgctgctcaggctgaggctgctgactctctctttatgactgcctgctataattatctctcacttaacgcttcgtggggttggttccaggctcttggacctgtgattgctcctcattatcaggctctcagggtaatttagtgttaaacactaggctccgtcttaagtagctaccttcacagcacttggaggcatggggagtggacctcttccacactgatgactggttccagcagaggagtcactatctaaccacaactatgaactatcttcagagtttctctaaactgtgtgctggttctttgggtaggattgctgatttcttttcatcaaggactccttgcttaactttagatggtgcttctgtgcgtgcagaagctgtgtcgtccttccctggactatgcaggagctttattaataataataatgattattattattttatttttcatttttaattacattcgtgtttttccactgtgtctctttggaatggaatctacactttgttttcttgactctccttcagggtgttatagagaagcagtttcagtctgtcattttaccctggaagcttaaagattactttgataaaggcttgattaaggggagaggagtacgagtcagagtctataaaaagtctgtgcctgaagctgggtgtgttagcttgtgcctgtaatcacaacacataggaggcaacgggaggattgcttccaacttcaaggctcttagtctgagttacga

SEQ ID NO: 5097 - DNA, 1000 bp, mus musculus
aattattgtatcctagcttcatggggacatcttctcatttgtccccgccaccccccacccccaatcccaaacccaaaatgaagaagataacattttgaatgtaatacttgacagcttctattatggtttctgtcaccttttcatatatttcctaactgtgcctactccagaaaagggcaaggaattaatcaggttgccaagagttgggttacccagcatgcagcaagcacttcagctacggtatttgctcagtttctgtagggagttgtgtgatagcagctttgaattgaatatgcctggccctcttccacctggactcagttcaaactcattgcctgctggtccctgcatccagagtgggaaatcagtcattatattaggaacgaatggcaaatgattctgatccacacttttcagctggtatgttttttaacctggagccataccaaattggaaaattctgcaattttgcaagctgggcattagaacagtatcgcagtctaaatacatttctggtttgaggaagttgacaagatgattttttttccttcgacttttctttgctactgtgccactgacagacatctccaagtcaaccgcatcatcacctcccttctgatgctttttctgtttcacagggtgtgggaagatgatgtcagttgagtttagctgtcaggatctatgtaaatattgacctgaattcattctatggacatatgtaaatggaaagactatattcagtaaagatgaaagaatatcccttggagatttttctttcttttaaggaatgcaatgaaaagtgtgcaacggcgaagcaactgctagcaggaaaatatgcctactagcctgactgtggaagaacactgccagtgaggacagtggcaggagatttgcagtgagttccaaatgagagcacactttctatgtgtgacaccgagtactagcatccagtacgagttgggcctggctttgctgatagaacaaagattttctacaactt

SEQ ID NO: 5098 - DNA, 1600 bp, mus musculus
tgagttccaggacagtcagtgttatgaagagagaccttatgtaataataataattttaataataatagttttaataataataattttaataaaaatatttacaactttggcccaaagaaccatgatattaactctctgtgatatagagagaaggtggtagttaattgtgtaccagacatgtaactgtgtcacctaaacttccacgctttcttcagaaaagcctcctgctgacttcatccccaatgtttccagagtttcacagaaaagggccacttatcaagacctgaggtttctgcctgtgacaggcagcaaagacagcactgttgacatgctgagttcaatgatgactttgttcactgtgattctgtagctggcagatccagcagtgtcgggccagcaacaattccatgtggtcccatccctcaacccagtgcctgcagataccccatacatgtggaacgctgagcctgatagtcaggatgctgttgctgccttccctcactccctcaccagctcccatcattccatgctctttttttttttttttttttcaaaattggcgccagaagcgagagcccctcggggctcgccccccccccccccgcctcattgggttagtgaaaaaatgatgagagtagtggtatttcaccggcggcccgcgaggccacgtaccccgaccccgacacgaggaccgggctgggcgccgggggggggggggctcccacttattctacacctctcatgtctcttcaccgtgccagactagagtcaagctcaacagggtcttcttttcccgctgattccgccaagcccgttcccttggcagtggtttcgctggatagtaggtagggacagtgggaatctcgttcatccattcatgcgcgtcactaattagatgacgaggcatttggctaccttaagacagtcatagttactcccaccgtttacccgcgcttcattgaatttcttcactttgacattcagagcactgggcagaaatcacatcgcgtcaacacccgccgcgggcctttgggatattccatgctcttatacttctgtcaatacactcatgggataattaacaaagggtgagtgtgtgtgtgtgtgtgtgtgtgtgtgtgtgtgtgtgtgtgtgtgtgtaagaggaatagtgcaacagcttctgcataaatgtcaggggctgcacagctgcaaaagcatctcctgcaggaggacctaattgaggactgcctgagagaccaaggacttctgacttagacaatgccggtcaatagggaacttctgttttgaagagatgctttcttgggaccaaagttgcgtgggcagaaggtactaaaagagctcgcagcagtgctcagatgagctttctggggcatttctcagcggctccgagagtctgtgtcgtggagtctgtgtcgttgacttcacgcgtgtcgtggagtctgtgtcgttgacttcacgccacctcacctccaacccccaagggcagttagggtcaggaggcaattagtccagggcacaggtagtgtgtgtgtgtgtgtgtgtgtgtgtgtgtgtgtgttcaccacctgagaaactagaggtcacgcagggaaaccac

SEQ ID NO: 5099 - DNA, 1000 bp, mus musculus
actttccaggagtcatttttttttttttaaagtaagaatgaagtaagcatttctctttcccagtaactatccgatgccagtagcttctcagtaaggggtgttgccatctgccccatccatcgaagggctttgactggctcgatcttacagagatcttacacgggtatccacagcacctggactcaacgattgggataggcatgtccagagggagcatttcgcagctttccccccacctactctctttcacacattccttctcactcttcttcaatgttccctgagccatagtagtggagggattaatatgatgtctcacttcgagctgagcatctgatctcctattctcagtgcttttgctagaatgcatctctcaccgaccactgcccacagcaaaaggaagcttctatgactaaggttgaaagcagccacatttgtcagtgctgtgagctgggtggagggtgaagtctaggtgccagtatattttttaaaatagggattataagcattatttgatttagtaaacaaattaatatttacatatataagacataaaacactttcaggaaagcattttcactttatacaaaatagcaatgacatgtaaaatctttctgggggagacatgcgaacagcaactgcagttgtatctgtcatttctgtctcagaagaatgaattttgtaagagtattaatttttctgaaactatttgctcaaataatgcaagtatgtatacgtcagctgatatgattcacagatgactaaggtgtgcccaaaagtcatgtcttttgagcattatcccaagggcagcagtttcaagaagttctgggacctttaacgagtgggggcctagtggaaggttacagagtggtccctccctcccaatgtttgcttttccattttctggctattatttctcatcctagccaaagccaatctctaaaaccataagctaactaaaccagtatgtatgtacatatgtacgtatgtatatgtgtat

SEQ ID NO: 5100 - DNA, 1000 bp, mus musculus
cccaaaacatcacgaccaagaattaagtttgagaggaaagggtttattcagcttacacttccacactgctttcatcaccaaagaaagtcaggattggaactctagcaggtaaggaagcaggagctgatgcagaggccatggaaggatgttgcttactggcttgcttccccggcttgctcagcttgctctctggtaactccagactaccagcccagggatggcaccacccacaatgtccccaaccctactcttgatcaccaattcagaaaatgccttacagctggatcccatggaggcatttcctcaagggaggctcctttctctgtgataactcaaacttgtgtcaaggtgacacacaaaaccagccagtacaaatgatttatctatgtagaactcattgaaaacatacagaatcaccacagcttttcatttctacttgatttccagaaaactattaaggagatagacttggaggactcacattttagaattaactgtactttctctttaagaacaataggtgcttgtgcattttcattgtaatcagaattataatacaaagttgacatgtctggtcacttaggagcaaagaaatatgaatgttcaagttccaaataacaaaaggaggaaaagaagacaaactatgccacagccactagggagatggctctttcagaacatttctacacaagcatgaggatttgagtcaggacttcacatttaaaaaccagatacattggcacaattattgctatcaatgctatggaagcagggatggaggatattggactttgctggccaaatagtagagatgaattggtgagaccaaggttcagcaaaagaccaggtcttagttaattttcctgttgttgtgataaattaaatccagggtttgctgggttttatagctcaagtgaggcaatcaaggcagcaggacatgaagcagcttgttatattgccatatcagtcaggaaggcatcaatggtgaagatatgtgctc

SEQ ID NO: 5101 - DNA, 1800 bp, mus musculus
acattcctgcacactacaaatgctcaccacacacacacacacacacacacacacacacacacacacacacacacacacttttccactgttgctctgagattacaattacatttctccccttcctattctcctccacactcctacatatacccctccctgctcaccttcaaattcattttccactcctttaacaattgttgttacaggcatatgtgtgtgtgtgtgtgtgtctgtgtgtgtaacacacacatatatattcccaagcacactctgttcctattgcacaatgcttcttatatgtatgctttcccaggctgaccgtttggcactgggcaaccagttggtgtactcttaccaggggaattccacctttcccacccccacctcttctccttgcctatttactgttctccgtgcaggattgaggcctcgtaggattttcctcatccagtgttgtatgctcattggtgctagccttggtcagcttacattaaggagctcaaaagtagaattgcaaaacttaaatcaagtacagcataccattgctgtgctttgtaaggccaactgtcataactgtaaagagacactgggtttagaaattattaaattacaaacagcccagacctaagtataagatcaagtaagcagtgatgtgttagtttccttctccgtcacagcaatagaacaccaacaaaaagcaactcgagtaagaaagggtttatttcattttactgctcttactttatggagagcagccaaggcaagaactccaggaatcaagagctgaatcggagatcatagacggacacaacttaccgacttgtcatccatggtgctcagtgtgctttcttctgtaagccgtgaccacctgttcaagggtgatgctgctcacaggaatggactgtctttatatcaatcgttaatcaagaaactgtttcataggggccctcaggccactttgatggaggcaattattgaactgggctaccgttgtctcccagatcaccctagtttctgtcaagttgaaaaaaaagaattcaaacaattgaacccataacaacatgactattaagttataaccttttctttcttgtttgtccccacaacttcatgtcaatatcacaatatgaaacatagcataactttaaaagtatcacttttttaaaaagatttatttatttattatgtatacagcattcggcctgcatgtgtgcctgcaggccagaggagggcactgtatctcattacagatggttatgagccaccatgtggttgctgagaattgaactcaggacctttggaagagcaggcagtgctcttaacctctgagccatgctcattggggagtatggtggcatggagacagtcctggtattggagaggtagctggacagatagctgggagttctacatctggatccacgggcagtggcaagagagagacactgggcctgacgagcatttagaacccccaaatctcacccccaatgacacacttaataaagactacacttactccaacaaggccacacctcctaattccattgtgtgtagtgtgattgtatggtgtgtacatgtatgaaaaatgcacttgattatgcttttagggtccacctgttttgtctctccaatgctggtattacaggcaagcagagccatgccaggcttcctgtgtgggtgctgggtattcatcctcaggtctccatgcattcagtgcatgtgctcttacctgctgagccatctcaccagcctccttgacatttcatgtgggtatagcagacttctttgtcatccttgtga

SEQ ID NO: 5102 - DNA, 1200 bp, mus musculus
tcagaatacccatgaaacaactcacagaccatgtgaagctcaagaaggatgaccaaaatgtggatgcttcagttctacttagaaggaggaagaaaataatcaagggatgtagagggagggagggaagagggagagggaatttgggggcaggatcagttgtggaaggagacagggaagaagtacagagggtcaggaaattgaaaggatgtgtgtagcagtggggggtggggaactagggctaaccacttaaaaagtcccaaatgccagggaagcaagaggttaccaggacccaacatgaatggcagtagccaaaatacacaacaaagaggaaataagacctgtagagaccatatccattggatggcacggccccccagttgagggatggggtcacccacccttctcaaaaagtttaacccagaatagttcctgtctaaaggaaatatagggacaaagagtgggatggagattgaaggaaaggccatccatagactgcccctcctagggatctatcctatctgcagataccaaacctaaacactatggctgaagccaagaagagcttgctgaaaggaacctggtatagctgtccccagagaggctctgccaaagcctaatacacatgtaatgttcaattgccatctgactgagcatgggatccccagtggaagacttagggaaagaactgaaggagctgaagaggattgcaactccataggaagaacaacaatcaaccaaacaccgcaccccccaccccacccccgcccccaccgtcagagctcccagggactaaaccaccaaccaaagagtacacatgcagggacccaggctccagctacttgtgtagcagaggattgctttggggaggcttttggtcctgtggaggctttatgtcccagtatatggggacgataggatggtgaggcaggtgggtgtgggagcaccctcatagaagcagggggtggagggatgggatgggggattgtggaggggaaaccaagaagagggacaacacttgaagtgtaaataaatattctttctatctatctatctatctatctatctatctatctatctatctatctatctatgaaaaggtatagaaccaagtactggatatgtcaccaggagagaataaggctctccagtttttaacatgtcttactaattctccatctaaaaagtagcgaatattcagaa

SEQ ID NO: 5103 - DNA, 1000 bp, mus musculus
tttacttacaggttatttcggcagttatgaagctctgaagaaatctctgtctgatataaggaaagactggcacgtctctcatctgcaggcacttgaacaacacaaaggaggattgaggcctctatccagagacctgcaagcagaaggtacacaaaactgtttggatattcaatattttgaacactcctgtagcctcccctagccttgggtaggctggttttgaacttgctgccactgagaatgagaccacctggggtggaaccttcagacttagatggctctatttttctgtcacctgctgcttctcttctccaagacactgctacctgctgagaggcccttgagatattctagagacagcatccagcagatccacctacaggctggcaacaggcatcaagaacggattggcaggggatgggcctccccctttataagcacagactcttagtaaacttgggggccttgaacagaaacatgtcttggcctccattatttctctcgtcgttctctcccatacagctccggcctcccactcaggaacccagttagtgtggccgcaggcggcttacacactccttgctgacctccaccattaatggcattaagagagtcctgaggatgcacaaaggtgactgtgtaatggcatatgtccccggtctagagcacctaccacttccttcactgtttgaagcagtacagtgggaatgaggcctttctgaagcagcaagctcagaagcagaccgagcactgtgggcaggacagggaactgaccttactgaatactgccaggtgctgtgacatttcagccagatctcagagtagcttattaaaattgctgagggtttgttgcagcctataatcatttctgtcatggtagaaaatggacatttccagaggctctcttatgggaaaactgcaagaagaaaagagagagaaagacagagggaaagagagagagagagagagagagagagagagagagagagagagaggaaga

SEQ ID NO: 5104 - DNA, 1200 bp, mus musculus
ttctcacatcccccgctgcatgcttctctacatgttacaccagcagcagtgtgttgaattcttctcatgactcaaacatctaacctccctggcctctactgatagattcagattctaaaggtttctagtattagactaggtccatccgggcaatttctcatttgaaaatcaaatgtgctatattctgtaaacactggagtaaccttcgtttccaaaggctggaaataatgaagtactctgaagtatggagatgctgcggactgatttttgtctattacaaacaccaaaatcaaagccttcttaggaaaataaaactggagacctaatgctttcaaaaaaaacataagcgttgggctggagcgatggctcaggtatgaagaagagctcctgcttgccgctctaacagaggagtcaagctcagtacccagcaccttcatgatggctcacaaccacaaccacccagagaatctgatgccactctttggcctgaacaggacttaagcacacaagtggtacaaacacatgtattcaggaaaccattggaacacataaaaataaattttaaaataaactactttagatgaatgaaaaaaattctttaagtcttagctcacaaaattcaacaatatccaaaaataatattacatgaaataagaaacttaaaaataaaaaacattttagaaataattagttgctaactatcttcttaattttttaattttacctgcatgggtattttgcccgcagcatgtatgtgtgtggtgcacatgaaggctagaagaaagcatcaaaagccctggaactggagttccaggaagctgtgagctgcctattgttgctgagaatcaaacccaagatgctctggaagagcagccagtgttctcaactgccgaggcatctctccaagtccataaaataaaaattttaagaggaattaaataacagtaaattcctgataatccttctgactataagtgatagagactagaaaattcaaagaaagggaatagaaaagttcttatcaggccaggcgttggtggtgcacacctttaatcccagcactcgggaggcagaggcaggtgggtttctgagttcaaggccagcctgatctacaaagtgagttccaggacagccagggctattcagagaaactctctctcgaaaaaccaaaaaaaaaaaaaaaaaagaaagagaaagaaa

SEQ ID NO: 5105 - DNA, 1000 bp, mus musculus
catgatggagagaagggaaataaggactatgtggtagatggaagagaaagcaaaactgagcaacttgggcactgtggagagatgaagaacaaatggatatgaagagcctataaaaccacctggagccatgctgccatgaaaggccattcatgtctgggtccatggtcctaccacagacagggtatgtgctgaagtctgtggcccaagtgaccaccaaaagccatgcagctgtcagttgtctaggatgccaccaagaccatgtagatgtctgtgggccatgccactgctggggaacacactgatctgagaggcctgtgctgcctcataaggtcatggtgaagtccttgcctgaactgtgctgggagccatgtctgggtctgtggtcctgctttagctgctgtctgggtcaatatccatggcctgagttactgccaaaagccatgcagatgtcagtggtatgggatgtcacctgagaccatatggatgtctgagggctttgctgccaacaagggacatactgatctgagtggcctgtgctgccacctgaggaggcaatggtgacatctgggcccatgctgctgcccaaggccatgtctgggtccacggtcctatttgcagccagggtctgtgttgatatctgaagcccatattactaccaaaggcaatgtggctgtccctggtctgggctgtttgggttgatgaccaagcaccatgctgagctgtccctgtccctcccctgaagcaggaaaactgtccctgctcctcatcagagcatcacaggagagctagctctggcgatatgaatacaggagagctgaccctaatggagtgagtgtgggagagctggccccacccctcactggctgcagcattcagaagagtggccctttacctcatctgagcagcacagtagagctggccctggtggaaggagtatgggtaaattgaaagcaagggtgtgagcacaggagatctggccccatgcctcgactagacaaag

SEQ ID NO: 5106 - DNA, 1600 bp, mus musculus
agagtaccaaaactcaacagcaatcatcatacacactttgataataactaaatattaacatctttgtttctctaatgaaaagacacagaatgcctgaatggagacaaaatccatgttatctgttgcctacaagaaatacatcttatctttaaagataggaacagttttagagtgaaacgattcacaaaagaattccaatcaaatagaaccagggagcaagcaggtattgctaccctaatatctaacaaagtaggtttaaaattaaaacatatcagaggagataaagcggtaaagaggacttaccttcaccttcatcaaggggaaatttaatctatatgacattactaccatgaacataaaaagtggaaacttctagtttctttggaaagttatgtcaaaagatcttttgctgggcacacaggtgaaaggatgtcttgctaaagcagacatgggaaagaatgttttcctgaagcagacacaggtgaaagaatgttttgatatagcaaatacatgaaagaacctattataaaggagtataaatatgaccccacagacagtgggaaaggagcactgagcattgatttggtttgttccacctcgctattcttcgctaacaacacatatgtattggttcaccttacatagcattgttgagctcaacttgtggtaacacagccattgagaaaaatttaccaagctcctgctgcagcttatcacttccctgatctcactgcaggctggtcggtgacccttgcagtttctgcaggattgaaatacagttgctggttcgtgcctggtgtctgcctgccaaaaggactggactgtagctgagggtttgtgtgactggtctgcagctgctgaatcctatttgttgtttgctacaggactgaactgctgagaaagaagattgagcttgcccccaaaaaactattgctaaacaggttcacttcccccatatcctaataacttttctcttctactacctctagtaggtgatgggctagaggagaagttgaactcttattaaaagtagattgcaaaaattgtatgcctacaaacacatatgaattaaactctgattaaaaactagtttcatagaagagaaaggaggacacggtacaggaggaagggatgtactataagaaatgaaggcatagatcaacctacttataacaagtgatttcaatagaccattctttccaatagcccagtcctctagggaaaaaataaacagaactattaaaattaaattacaccatccagaattgtcttaacagatatctgtagaatatgcctcccagaaatttatcgaaaatagatcacatcctaggacagaaaacaaatcttaaccaagtcagaattactgaaacaacttaatatatcctatatgaccataatgcaatttaacctaaaattaaccacaaacaaatctatagaaagcacacaaatttatggagaataaacacattactgaatgataactgattcaaaaaaatgaagaaaggagtcaaaattttcttggatctgggactaaatgaaaatggcaatacaacacaatcaaacctctgggacatgacaggagcagacctatggataggac

SEQ ID NO: 5107 - DNA, 1000 bp, mus musculus
tatttcaaccaatgggtacacatcatcacaatgtatccaatagccactagaaaagagaataaaattgtcattttgcattctgtttctggcctgctgtcaccataagttcttgtagaaatgatgtaatatgatgacgtggacagatacaggaggctgaaatgcctcaagggcgggattcccggctctggtttcctccactcagccccactgctctgaagtgctctcccaccttagctgatgtgggttaatgatgtaagcattttatggcttcatgctgctaaggtactggggaaacaactcgccttgtcttgagacgcccttcaaaggttcctgctgctctcccacacattaggaatctgattcccggagacagacaggaccataaggaacagcacatcttccatttacagcatcttctcctctagcagcgacttggcagcagcaccttccagacaggagattcctcaaagggctcaaagccaagtctgcatttctccctccagcatggatccactaagtcttcgtccctctcgccagcatggattctgcgtccctctctgcagcatgggtccactatgacattatactaagttatgtcagcacctcaccctgattttccatggactcttctgtaaaatgctaatggtaataccatgtactctcttatgttcctgatgaaaaagattcatgagttcaaagctttggaaatgctcatggttaccacagagccaacaaacaggatgtattacctaggcagagggcacaaagcttcagctccataggaccacaacatgcccaccctctgctgtggctgctgatggtgaatgccttatgtcccagagatcatgtaagcaatgacatgggcttctttacaaacatacatgtaagtgacacacatgaccccatggatctcaagcctcctcttcattctctgcttacactctcttctgcgtatctcacagtacacgtacatacatctcacactacatgtgcacttgta

SEQ ID NO: 5108 - DNA, 1200 bp, mus musculus
cggttgtacaaatctagaaatgtctccaggtgaggtgataaggcactgttttgtgccctatggccaacctaaagcaccctgggtttgcagggttctgttttggtggcagggatgtggcaagggggtccttgtttgtttttctggttttgttgttaccaaaaccccaggcagtacatgcattttgtctgtgagtcatgggaagtgaaaacacatcccttgagatcacaccacgggatatgatcatttcgtagcttggtaggtactttaggggaaaaaatattgattatgcgaaacttgaagtttaaaaaatatatatttatatccccctggcaatgggcaaagggacaccctgtgggtggtgttgctcttctatcagtcaggggcaaagcacatggcagtcctcagttcaccctagcttgatgcctggcttggtggccatagctgtactatacctagtacacaaaaaagtcaaatcaaatccaggcaacaccagaggaggaagacctgagacagagacctgcattccaccatgccacgtggtgctggcagggaaaggcacacagacctgccctctacctcatgatatggatggaccacagacacatggagcctacctactaccagaaaacacaatgagggaggaagaagaccaagacctgtggaccacagaccttccctccagtgcccagcacaggtaggctgtagacacctgctcagcaccatgtcccccaacacagacagagaatgtcatccaggacccaccagccttgtggacagcctacagtgggagccaccacaatgtgccagtatgaagtggtcgaaggggaaagaaagaaaactggagcagtttgggcattatggagactggagggcagagaggagtagcctgttgtgacaggctagcctcatcacctggaatgtagtgaggtcctagtctaagctgccacgcctgaatccacagctactcagtggcaggggttggtacctgatgagggcagccaccagggaccaaatggatgtccaggggctatacagaattggccccacccctcaccggttatgattctctggagagctgtccttacctcgcacctgtgacagcccttggcaaagctgaccctgagccttgcccagatagcagtgagctgaccccaaggatgagagtgtcggagagctgactccgccatccctcagtcatgt

SEQ ID NO: 5109 - DNA, 1000 bp, mus musculus
atcagagagtttgaggattttagagaagatggtactcaacagcttaatgaacgtaaaggggatagctgtaatgactgagctatgttaagaaaagaggagttcatggttgaaaaaaatgacaaagacagcacaggatagtcaaaggagaagagtgccaaggcagtagccttgatgtgatcttcaaggtcagagcagaaaatctcctcaaattaaagaaagacttacaggcaagtcaggattgactgacgccatgcatcagatggacatcacagatagtctacagaatattccgaccaaacctcaaaaggtatgatactctgttatgcttgcagacaggagcatgttgtcctctgagaggctgcatccatagctgactcagatacagacaccctcagccaagtagaggatggagcttgggaactcttatggaagaatagaaggaaggattgaaggccctgaaggggataggaactccataggaagaccaacagagtcaactaacctggacccttggggctctcagagtctgaaccaccaacacaaggacatacaggggttggacctaggcttctccattcctatgtagcagatgtgcaacttgaccttcgtacatgtcttgaacaaccggaatgggagctgtcctaaaagctgttgcctatatgtgggatatgttcttctagctgccttgtctggcctcagtgggagaggaagcgcctagccttgcagagccttgatggatgcgggttgggggttgggggttggggagctactcactcagaagagaaggggaggagggaggagggaaagattgtgggatggggtgaccgggggtgggggcagtgagcgggatgtaaagtaaacaagcacacaaaaattaagaaaagagagagtccatttctacccagtggccaatggaagcttctcaggaatgagctgcatgcatggacagaaaacagatcctaaccaagtcagaaagattgaaatagctctggtggcctat

SEQ ID NO: 5110 - DNA, 1000 bp, mus musculus
ggtagttcataacatttcaaagaacattctgaaagactactctgagacttattttagtctgaaacagcgacttgtgaaattagaaaataggatttgcaaaatcttataagaattaaaaaaaatatgaaaaatttctcataaatttaaatctttacttaaaaaaagaagctagttttataatcaaactagccattttcagttatttatttaaccatccccctggcccaccacacagaaattgtgaagcacactgtaaagttagggcgcatgacagaaagtactgacagcgatcttctgtgcatgttcagcagaggtcatgcgtaacaggctctacccattacacagaagctggttctgcccgccaaggctctcagggttccagagaaaggagcgctttaattctgtttctatacagtttttttctgttcccttataggaaaggcctgacctggtgagagctaccattcactgggcggccttctgggaggctgggaggctgcacactcacggtggttgtacttacatgcactgctttgaaataggtaggctattttattttaagctgaccacagcttagaagaaaacttttcaattttcctttctggcatgtttaaacaagcagacaaatgaatgtgattcacagagaccacacaaccacgtcaggtgtgaaagtgctttttttttttttttttacctgacaagtcaaaactgtgagacatgctaagtggccgcactgctgcaaaaaagaaaacaaacaataaagagaaagaaattcagctgttaggatccaaaggcagacagggctgtcgctggctctccttggggtctatatagaagctcctggatacaggtctgacatggaaaacaactacaagagtcttaatttcagctttaggacaacgacaggataacaataaaaagaaaaggtaacactttaaatacactgaaaatgaaaacaagatacagagagaagaacctactctccccacaagtgatggca

SEQ ID NO: 5111 - DNA, 1000 bp, mus musculus; identical to SEQ ID NO: 5110

SEQ ID NO: 5112 - DNA, 1400 bp, mus musculus
caaaatgccacatagcttatcaagcgagccttgtttccatagcttatcaaaacccggaacatgttcgaggttgctacgttttctactattaatggttctataaatattttattcacatctactgtctgtactctatattaccggggatctgtctatcttctgtggtgtacattgtatacatctcagggtctgtcttctaaaatgtatactctctatatccccagagtctgtcttctaaagtgtatactctatatccccagggtctgtcttctaaagtgtatactctctatatccccagggtctgtcttctaaagtgtatactctttatatccccagggtctgtcttctaaagtgtatactctctatatccccaggatctgtgttctgcagtgtcagtagttgtaggaagtgagaggcaaacattatctcttcaatatggccatggaaaactaatactgaaaggtccttcaagtagattttataaacagtgtgcccaaaggcattactttatcaagaaggtatccattggctttttgaatggctgttagaattctgacccataacaaatcatgaatggacccttaagcaggtgtctagctgctcacagccctatcttgctgctggtgaaccaaaggagagagcacaataaggttgaagcaaccttgactactccacagtcaagttgtgtgctttctcctattatacatcaatgcttcagagcaatcagcattatgatccccaattctggccttttgagaagtaagtctggaagaaagttgtcaagccacacccttaggggttgtgtgcccagtcagcagtggctctatgtgtcaccacagccatgatcattccatgtttcccaattattccctactatgctgagtattttatttgaaagaacaatgtttaaaagtatggatgacattctcatctaaggttgtatgtaaaaaccagtgagcattttaggagtctatacaacttttagctcccttcacatgccccacgttatcataatttctatgtgatccttataggttttattcattggaaagtttgttagaatgccttatattctgataaggtacaggctgtactgaagtcatgtcactttcgatacatttcaacctaaatgtatttactatatttgagtcaagtttctgtttattttgtcaatttaaaaaggcagggtgttggattgttaaaattggtttcctgaccttgatagtttgaagtttttccttactgttgtgaagccaaatggatccacattctgttgtttccacttaaaggcttttttcctcaatatggaagaaagatgtgtttgtctatttataaacaaattccatgagttttcttcatttcctattgcattgttgtgaaggtgtgtttagtgtaaaaaa

SEQ ID NO: 5113 - DNA, 1400 bp, mus musculus; identical to SEQ ID NO: 5112

SEQ ID NO: 5114 - DNA, 1000 bp, mus musculus
caatataagaaactacttagatagcccccttcccatgttcgtgtgtgctgtgtatgcatgtgcaagtatgtatacgtatctactgtgtatatttaagtgtgtttgcaggtaactgttctttttgtagaggccaagggaaggcctcgtggctcgtcatctgtcactgtctgccttgttctcattgactctagtgtcctatgtttttggctacaccggtgctgggatcccaaccccaaccccatgctctatccatcaggccatctctctggcccctcactcacccttccttacaaacggtgaggcaaacattgcatcattggctttataaacttcactgttttgaaaaagattattattagagggtaaaggcaatgtatgcagaaaatcaggaccaaataaattttaagaagagcctgaaacagcattccctatgatgaatcaattaagtttgctttcaggctattaattagatacacaaaacatttgatctcacttgacagttcacaacattctctaccatgttagtgtggcaatgccagatgtcattttgttcaccgtaattaataaggcacaaatttgtcattaaggaaaggcaactgttgcctctttgtcatgtctcaatttttaatccttcattctgtgcaaggcgtctgtttgtctaggctagcggcctataaattgaattgaatggtgcactggcttctatttctaaaggaagcaaagggtaacaaatagaggtcaaaaatcactctcagagcactacaaaactcccgaagcagagtcagccaagagcctttttactgtattggccatttgctttgcgactgtgtgcctgcttggaaagcctactggtatttatcagtctacctcttgttttagtagttggctgaggttggctctgaaacattcgctattcttgacagaatacatgactgcctggccagtgactgctctttcagcctacaggatacctgcaacaccgaccggctcctgacggatt

SEQ ID NO: 5115 - DNA, 1000 bp, mus musculus; identical to SEQ ID NO: 5114

SEQ ID NO: 5116 - DNA, 1000 bp, mus musculus
agagctgttcagtctgcagattaggaaaggaatggaaaccagaaacagcagggttcgtgctggaaaactggcatccttgagactcagtagggccttgactcgtttgctcatcctttaactggctgtctatgtaataggaacagtcctttccgcacgatggatgggaggtgctcccggggctcagtcctgacgttcccggctcacagggagatgcagctgatacccgcttgctagggagcgcagtatctctggggcttaagcgactggcttgcatttgctttgtagaaaagaaagacaatactcctctagaggcatgcagcggacaacttaaacttcctttcccttttagattttctctagattttccagaaaggatttcttcttgaatatctgctggaagttgcttaaagacttcttgatcaacaccctctggcagtgcctggaggggcaagtcacttgtgtctttttctttaggaaaacaggtggcatccaacggagactcccccgttcctgtgctttcgattcttctacttggtagacaatcccagtttgcttctttctccttgtgagagtcttccgtgtgggtgtccttcactttctacaacacaaggggaagagcagagctcaggagtctgcacgccttgcgcatcactgctgcagttctcctggagctagtgtctcacacacctgcaaacctgcccggcacctctgaccttgacagagagcaatccatcccgtgtctcacactactgtgtggcctatcatcatactcatgcagtccctactagctagcagactaggggacaagacacgcaggaggaaagatcccagccaccatgggctgcacatctaactcagtagataatgtgatctaatgctggtaaaaatagaagcacaaagcaggaagggatgatttcccaaaaactgcttgtctaaaaggtaacatttaacagtaacaaaagagcacaatgaaagtatatcatgagagaaccagacagct

SEQ ID NO: 5117 - DNA, 1000 bp, mus musculus; identical to SEQ ID NO: 5116

SEQ ID NO: 5118 - DNA, 1000 bp, mus musculus
tctgaaagagacagatgcagatatttgtacctaaccaatggacagaagctgctaacccctgtggttgaattagggggaagctggaagaagctgaggaggagggcgaccctgtcagaggaccagcagtcccaattaaccttgacacagagatctctcaaacactggaccaccaaccaggcagcataagcatacaccagctgatatgagaccccaaatacaaatacagcagaggactacccggtctggattcagtcagagaagatgcacctaacactcaagagatggaaggccccagacagtttagaggtctggtatggttggggtgcagggacagggacacccttgtggagacagggggtggggtggaggtatgggatgtggaacagttggagggtggaccgggaggggaataaaatctggagtattaaatagatagatagatagatagatagatagatagatagatagatagatagataaaagattgaaaaaatacaccatgaccaaaacaacttgtgcaggaatgggtttattttagattataattctcatggtacactccatcctgagtgtactcagaaggtagagggcataaagaataatcattactggtagtacttgtcagtttggtttcttgtaaatcctaggaccacttgcccagggatggcactgcctgcaatgagcatggatgcccccacatcaatcattaatcaataaaatgccctacagccataagccttatggactagactttatgtgtagccccccccaccccccccagcctgaagcaggctgatccagaccttgaccttgctgccactaaggagattacctagggtggagccttcctgcctagatgactccattattgttcagcctctgctgctgttccccttcaggatactgctacctgctgagagactcctgacaggagactacaccctatcctgcacattgtcacctgcagctggttccaggctccaagaatggattagcgggg

SEQ ID NO: 5119 - DNA, 1000 bp, mus musculus
aaataggcatgctcacttttcaatgtcatcaacactacaatgctcactatgcctgtgtcttagcatcaggacaacctgtactccagagctaggctgacacctgtcataaccaattagttaaatagaaaacatggtgtaaaacatgacttgtagattgggagcagttctcacccttacaaatgctccctggggaaatgaagctgtgctctttccctctgccatttctgaacggctgagcatcatttcttcccaagcaaggcaagcaatgagaacaaataaatgtaagacaagcacagtggagaaaaacaagatactatatccagctaaaagcagcatgcagttagaggaagaagaatcctaatgtatccacacaagaagaaggaagagggggaggggggaaaacaggggaggaggaggagaaggaggagggatcaaaacttattctcaatacagaaaaattataatccctgcacccatagatcatattgtacaaacaacatacagacatgctcatcctctgacacaaacaacaatagatggaaattttttgataagatctgacttatctaaaagctctattactaatagttttaatagtttctattcctttctcattagcttcaggctgagaagtgacatcatgattgaaaggacattttggtattcttttctgcctcaattctattatttagttctactaattgaaccaagccccaggaattaagagaacagcagaaatgttcgtcactttcattccaatagccaagttggaaagtataagggcgtgtcaggctaatagatagatcagcaagtcaatcacagaaatgaagccttagcaaataaatactgaataaaatgacatggaaattctagttttatgatacgcactttttttcaagaaatactgcctgttcacaggaaactttgaatatcttttgacacatccatgcataagtaaattcacaaagtcagtcattagaaggaaccagcactccatcaa

SEQ ID NO: 5120 - DNA, 1000 bp, mus musculus
ggaagttgtaaatattcctaaaaaggacaataggttaacagagaaactaggatttatatgattggtttaatttctaaactcttatgttaagtattcttcacatataattctgtgaataatatctttaaaaaaataaaagctccttaatcccactaccaacaaattcttccgttacttattccctcagacgtgcccagttattgttgccaaggaaacagccaggaagcaggcgtgaggcagactctttcatctggagaaagggtgatgggaatggatgagagttgagcaaggtcaggcgcttgctgctgaatacaaatctgtcatgcctaatagatgaactctttagcttctgggccgttcaggctactcccagcagccaaggagaaaataaaaaagacactcaagcatgaatgccaatcagcccatgtggccaacagtgatgtatttatgtgtgccacagcagctgtgctaggctttggaaggaatgaaaagataaattaaatatgtgtcaataattataggaggtcagaattcaagtccagaaggtatactcatgagatcagagggatgtcatttggttgatctagcccgttaacatcccatatgcttttctgaggtcagagttcaaaacctgtcgtagagtcaagtgtattgagctgagaaaaccctcaatcagccctctgttgtttgtttaccagggacaacaatcatataaagtacatggggaaatagtatacatctggtctcttttgattagtagatgtgtggttcatcactcgttcaaattaacatcaggggggacaagataccttccctctagtgatacctcatggcacatctatctcaattatgcctgcatagttcaaagttttgagccattctccagtatctccaatacttcttctaactattagagtgtaaaagaatgcaataccgttatgtgatggtatttagagctctacttatatacagttgatgacttcctcaaatatattttttt

SEQ ID NO: 5121 - DNA, 1000 bp, mus musculus
aaacttgagtcttaagaaagaaacagggctgaggaaacacagttacattagaagaaatcaactgaaaatacatacaccagcaatttcactgaaacattttttttgcctctttgttctcaaagataagatgatgcatggttgactctgtgtagataaacactggaaactgaaatagataagcaagttgtatttatatatttattcatacatgtgtgtgtgtatgtgtatgcatgtgtgtttgtgtgtgtgtgtgtgtgtgtgtgtgtgtgtgtgtgtgtgtgtttgtaacaataacaaagagaaagaggttttggactgagattggaagggcatgaaggttcaagggatggtaactgagaactgagcagaagaaagaaatataatcctagtttctctctgtctcctctctgtctgtctgtctgtctgtctgtctgtctgtctgtctctttctctctcaatgttctatgaaggaccctttcccggtttctcttcctcaatcaccctatcctattccccttcccctgcttctgtgaaggtgctccctacccactcacccactcctgcctctgcaccctagcattaccctacactggggcattgagcctccacaggaccaaggggctcttcacccactgatgccagataaggcaatcctttgctatatatgtagctggagccatgggtccctccatgtaaactctgtggttgatagtttagattctgggagctccgaggggttctagttggtcgatattgttgttcttcctgtgggttttcaaaccccttgagctccttccatccttcccatagttttatgaaaaaaatgtttcaaaccctttactatgaaagcaatgaaagaaacattttgttagagtggagacaactgtttacattcacctgcacctaaatttatgccaccaccaccttcagtaaatatatatggggtttaggaaaagagtttaggctttgatgtatcagtaatccttcagtgtccttggct

SEQ ID NO: 5122 - DNA, 1000 bp, mus musculus
ctaccataatctgcatgtggagattagagggcaacttcatggagttagttctctacataaattccatggatctacagattacattcaaattggcagaatgcatgacaaacaactttacctgcagaatcatctctctagcccagcttacatttggatgggtaaatagaagtaagaacagaatgacacttcctggacagtttcaggaaattgagatatcttttgaagggaaattggaataatccactgagaagcaaacactaaaatgtgtcttgtggtcaacaatagtcagaattccagaaggaaaaataattgattactgggcaccagactgcaacagatatatccataacacaaatcctgtacctaaggctcagaaccattccagaagacgggacaggaagagtataagaaccagaagaccaagaaagttgttatgagatttttgtttcctacaaatgacagtgacagttgataccacaactatttggctgcctaaaaatgaagaagtgcatagccaattgacattctagcatgggtaaatgttagggggtggtcctgaccatagacagaaagctacaaaatcaaggaaacctgagagctggagaaataacacctcccagaaatgagattctaattcattaactactactgagtggtcagccatgaaattacataatacaagtaacactaaatggaataaagagcttgcaattataatctagcagtgtgcgtgtgtgcataacactaataaccaaaagataatattttatcaaaaatataaagaaaaggcacagaaaggaagaaataatagcaataaagactatctttaacatttattgatgcttaaaattcttgaaattattccaataaagcttgtaggtagtacttctgaaaaactgcactaatccttcccaggaagtgacatgatctcaagagctggcccatccccataggttaagtagctacttctaatatcctcaacacagccagcaactggcag

SEQ ID NO: 5123 - DNA, 1000 bp, mus musculus
taaaatagcgcaaacataatagacatgcatatgtagttctacacaaccatactgcaaggccaaagaccctggggtgtggctctccgccatgcagtcattcaaggaaccatgttgatgaggggcagacctttagtccatggctgtctttccttccagtcagagaaaaaagaaaaccataaataagtgtatgtgggaagcttttaggagacaccatctatggtttgaatatccaataatgtcctcagaaaattaatgttcagatcctagccgttgttgtgatggtgtcagagagtggagacttgagaggtaagtgagcttggtcttctttcacgaaagaccccagagatccctggccctttgcttctgaagacacagcaatgagttgccatctacaaagtagggaatgtgctcttggatgctattgttttgagcatcctggcgctgagaactaaagagataaattttggttgaatttgtcctcagatttggattttttcccaaagacatgtttactttaacaacaacaaaatgcaatgttaagccaaaaggtatttcagtgggattctagctgtccatcactcggtgggcagcactcacagagagccaagagattttgcttagttctcctttgaattcccagtgctggcaatgtctgccaaggtacagggctaaccagcactgtctccccaggcatttgagcacacaaagaaagacaactgtgccagaacaaagccatgtgagtctatagtctgactccagaatgtgttcctgacatctgaaggtaattgcccacttcatactttctgcaactctgtctctagtttatggaatgatgaataagccagaataaagagccaactttacccttagaagaagtcttgaatactacagtcacgccactgagagctgcctgtgggattggactttgatatgtgccttgggtccagaatggtagatggtacccatccagctcagtagcaaaccctcactagatgcccag

SEQ ID NO: 5124 - DNA, 1600 bp, mus musculus
cacttcatactcatcaaaggaaaaatctatcaagatgaaatatcaattttgaacatctagaccccaaacacaagggtacccacatttgtaaaaacaaaacaaaacaaaaacaaaaaaatgtcaaagcttaaattaacccccacaaattaatagtgggagactttaacaccccactctcaccaatcagcaggtcatgcagataaaaatctaaacagagaaataataaaaataacatattatgaatcaaatggatctaacagacatctgtagaatatttcacccaaacccacacacaaaaaatatcttcttctcagcacctagtggattcttttcccaaactgaccatatagtccatcataaagcaagcagcaaaagataaaagaaaactgaaataatgccatgtatcttatcagaccaccatgtattaaagctagacttcaacaacaacagaaataccaaatatcctacacactcatgcaaattgaacaactctctactaaatggtctctgggtcagggaagaaataaagaaatgaaaaaatttcaggaattcaatgaaaattaaggcacaacataccaaatttatggaacacaatgaaagcagtgataagaggaaagttcatagcatcaagaacctccataaagaaattataaagttctcattgtaaccttccctcggcctaaagctggctgagccagaacttgactttggtgccactaagattatctagggtggagccttcctccctagatcactctattcttcagccactgtcactgttccttttcaagatattgctacctgctgagaggcccctattctggagactacaacctgcacattgtcacctgcagctggttctaggctccaaggatgaattggcgggaatgggcctccccctctttttataagtgcattcgccattaaacatttgagctttgatcagaatgttgtcttggctccatttctctcccgtttccctagtttccctttctttcagcacatctcataacagcaatttaaaagaacacttgaaatctctagaggaaaaagaaaagaagcaagcacaccaaagataaataggaggcaggaaataatcaaaatcagcactgaaatcaatcagttagaaaaaaagaagacaatacaaagaatcaatgaaaccaagagctggttctttgagaaaatcaacaagatagacaaacccttagccaaactatccaaaagacagagagacagtatccaaattaaaacaatcagaaatggaaaggaagacatagcaatagaccctgagaaaattcaaagaaccattagattatacttcaaaagtcctctacaaaattggaaaatcttaatgaaattgatgactttctagatagataccacttaccaaaattaaatcaaaatcaagcaagctatttaaacagctttataacccctcaagaaatagaagcagtcattaaaatctcccaaccaaaatttaaaagaaagaaagaagagaagagaagagaagagaagagaagagaagagaagagaagagaagagaagagaagagaagagaagagaagagaagaggaaggaagaagacaggcccagatggttt

SEQ ID NO: 5125 - DNA, 1000 bp, mus musculus
ggaactcaggctcagtgtatattacacaaccgccagcgagatgctcccaagtagtgagcaaggagtaaagagcaaggaggtgctgagcactgaccaccttagacagggtgaaaaccagaggggcgggtgcttatttctcaggtaaagtcagagctggaattccaccctgaagttagggactgagacccagagttgttgggaaaccaagaaggaagacagcatcagtgtgacttggggatcaggaaaagacacgtgggaggagccttacactgagcggacttgtcccaaaaagaatactttggtaggttctttggctgcttcagcaaagctgcacaagctattggcttaaaacatcagaagaatttatattgtcatggttatagaagctcaagttcaaaactgaggttccggaggcccatggtacttctgaagtctgtgaggaagactggccttttcccagctcccgggatttctggcaactcttgatgctgcttaggtggattctgcctcctatctcatccctgtcatcacgtgtccaccatcttcctctgtgtctctctgtatcttcatgtggcattctctcttcgaaggacaagagtcacatgggattaagagccaacagtactccagaatgaccaccttaatgtattgcacctgaaatagtcccatgataagtctcgtgtgtctgagaaaatagtggttaagacttcaacatatttgagtccatatcaaatggaagggacttttcctttcatgttacttcttttagtctggcttccctcccactatcaccccaggtagccagggtccagatctcaatgtcttcctccaggagcttctgaaaaccccactcacccagcctcaccacgcagcaccacgtaccacccagaacttctgcaagatgccagactctgccatgctctggtctaagctgtgtcccatccttccttgttatctgttccctccctaatcctcccaagacctagtatctgcggctctt

SEQ ID NO: 5126 - DNA, 1200 bp, mus musculus
caaagagactgtgtaagttagataactcttctctaaccaagaataacagacccagaattacccagaaatatgaacaaatcgggggatttgagtgttgctatatcagagatggcttggaaattctatcatatccgaaagacactgttctacaacagtctttcccaaaccctagctctaacaatccttctcttcctgcttctacactgtgtcttgagggatagggatatgatacagaagtcacaacagactgagcagcccacaggtgcttactctctgcactctgacaagctcagtatgagtctcagagttaactgccgtccactgcaaagagaagtttctcctatgagggttgagaattggaccaagtttaggtataaagataggtatttagaagacggttcatttagtaagatagtcgtcggttctcccctggggcttaactgtgggaaacacggtagccaatgtatgatctctcctcacccatgaattcttggctgaactgacagtatactggcatgaatttccttctttggaacaggcctgaaattcagcctttaaaagtggttggttacatccataacacccatgctgctattgcaccagtgaacatttcttgtcaaagctagctactatcgctgctcaaagtcacagctggataagactattgatttcttgtcttccccagaagcctacacagcactttgcgacattacaaaagctacctacagggttttaatgatttccacatgatgaagaatggaacctgagagacaattgctggtcaatccatagacaaagatctcatggtgaggggggaggacctctgtgagccaccctaaagaacaggaatcttgtcctcgtggcaattggcttccgtttaaagatggaggtaaggttagaaatgacaaaatcagaactggtttggaaaaaaaaataacccagaagcaattgtgaagggagaagggagtatccagaggacaaatgtaatatgagataaaatatggacatggaaaataaattgagagaaaggggtcatggtcaagagattaaaactgactccatgatatggagtctgcaggaggagacatcaaaccaggtgaacgaatggtgttggcattcacaagactgagaaccaaggccaatgtgagttcaggatataaagatgcctgacaacccaagttcagtccctggaacctgcat

SEQ ID NO: 5127 - DNA, 1200 bp, mus musculus
gtcacagagagattagaaaacagactcaagaagagacaggagcttatctgctggctccatcggttctcactggtgaaaggtacacccccactgccaagccttcccacctactgggaaaggcaaatgccctgtgaccggctgcttctgtaaatctgggaatgagccagattgccacaggtcctgttgagtcaggcctgggaactggtgctggatgggaggcaagcctgccactcaggatggaagacggacaggtgggctggtgcctgtggcaaagctgctcagggctctccatgagcaatcagcccagagtctgagatacagacgagaccaagagtctgaggggacaccatctactggggaaatgtaaaggggaacagaatacacggtggagacgttccaggagacagagcttatcgatgaacggaaaggggagaaagtatacccaagagacaaggcaggacagaaagtatctgtgagtgggtagaggggacagtacggaccagaacaagcagacagagcatgcccatcagagcatcccgggaacagagtggactcatgtaagggaagaggggtcagtgtgtacccaggacaggaacaaggtcccagcagagatgtggagagagctcatagaggagaggatacggagcacactagaagaggatgatgcacagcacaggaccatgcttgtgacccctcaggatattgaattccccgtttcctcgaaggagaaatgtcttacataataatcaacttcttcaaaacctagaactgtcagaatgtaacaggcatgcttgggctatttgttaatactccaccctcgtacagcagaatgactccgtgcagataacccctggggaaagcccttgccgattagcacagcccctcctggggcagaaaataagcagtgaccgatcgatggcttgtgtttgtcgtgtgtgccagtggagttggggtaaataaccactctactgcaaaccccgcctggtttctgtttgttatttttgttttgttttgttttgtttttaacctagaaaaacaggctctctagggctggagagatggctctgtcgttaagggcactgactactctttcagaggtcctgagttcaattcccagcaaccacatggtgactcacaaccatctgtaattgggtccgatgcctacttctggtatgtactcacatataaaataaatcttat

SEQ ID NO: 5128 - DNA, 1400 bp, mus musculus
tcagctagtgtatgcaatggtggggacaagtagttttaacagctaagaattcttaaagagccagttgactagcaatcggagcccctttaaagggccagacacctgagataattacactacagttgaacactagaatttacacttagtactcacgcaggaacgtcactgaattcatccatagttataaattgcatttccttgataatcctctgctctctggggggcttcttcggcagtccaggctcctcagctttgtctgactctttaggatccggctctggcttgtgaactctacagaggagagatgaacatgcagacaggcaagtgccagagggaagtagcagagtgaacatgttttttaaactggggggtgggggggggggatttgtaaatgtgtgacatatccttgtttaataattttatagccaacttttctttgtatccctaaccccttggttatgaagatctcagttgtaagaggaattttgaaaatcaagttagtaaatcttcagagtatggctgttttcatgtatatagccaaccatgtctgtcacccacagaacggacaccacacacctccccagtattcctgtttgcttctcagagtcaaacgtgtaaggctgggcttaactccagcgtctcttcttcatccccctagctcggagcctggaaacaccagtcatcttccctgtaccctagtgtcgtctgttagtcgctactattgtgtcactaagctatcgcagactcagcaagaaccaagggcggcccttgaactcactctatagcaaatggagtctagcaatgcactgtagtgagtgaagtccagggacaggctatagctctcaggctgtttaactgcccagacagaagagacattggctgccataatgcatgaactattccaagaaaaaaaataccagaccgggaaaataagagatccaacacagaaggaagcagagaaactccccagagaccagacccagagtgcaacaaacataacaggttattgtgggcggtcaataaaatctggactactctatcctagctgtgcggcagaattaaagcaggaatcacagttaaaacaaagtgatggttgccaggcgtggtggcgcatgcctttaatcccagcactcgggaggcagaggcaggcggatttctgagtttgaggccagcctggtctacaaagtgagttccaggacagtcagggctatagagagaaaccctgtctcgaaaaaccaaaccaaacaaacaaacaaacaaagtgatggcaccatactttctttggtgaacgcccacatgacctccatcattaaactggctgaatcttccctgaactttctcttcttgaccatgtactaaggacacgcctggtaacccccactgaatccacttcaagctat

SEQ ID NO: 5129 - DNA, 1000 bp, mus musculus
agagatggctctcatttgtggaatcaaggcccacagagcatggcaaaacagagggtagatttaggagggagaccccgacttgggagactggctgggaggatcttcgaagaagagaacctaaaggcagatccggaagagcaaagaaggctgtgaatgactttagataaaggcttggtggtagcgagacttggccctttctccattaccaccgggaatgttccaaggcccctctgaacctggaactcgagtgtactcaagtagaacaaggtagaaaagacaaacgacttatttagcgattcacataaggcttgtactgcctatttccatgcctgacttcacttgatacctggaacagaatggcctgcgaaactgaagcaatgggttacatttgtcagctataacacgtgcctcttaaaagcgcctccccaccccaagctgagtgctcgcttgctcgcttgcgccaccttgtggttttagagtataaaatgagaatgcaaactggattggaaattgcagacttccagggagctatcctggtggtacctcctcttttccacgcttattggtgttggaggcttattctaaagatattcctgaaacagtactaccgacaggccttttgaggctatgtctgagagagtagtgcagccagaccatgttacagaacatgagacattttagcttaaaagagtcttttagaccccaaggcaatagattttttggtgtttgtttgtttgttttgttttattttaggagaaatgccacaggaaagcctttggtttacagcagtggttctcaatcttcctaatgctgtgaccctttaatacagttcctcatgttagggtgaccccctggcacaagccctataggaaaggttacagcaagcaagtgacttttctggagatggctcaccattttgcatggttgtgatggatgggctctgagaagcatggaccccagagacattgttccaggattactccttgctgctgatatacca

SEQ ID NO: 5130 - DNA, 1000 bp, mus musculus
aggcttcaggctagttttccagtgaaaggttgctgctactgtctgcagtgatgcccctgtcctgtgtcattcctgcggctactagggtagactgttgtacagaagtgggcgaggaaggacgactccagaggatgtgtggtcctgatgtaacagcaggggagatagcatgaggaagtggctctgagcctgttctctaactgttcctctgcagcttgcagtgcagccccacaggcatccaagcctccctccagcagggaagtgctcctcctctgctgggagaaatggttgtctggctgggcattgcacatctactacagactgagatagccccgacgggcagggcacccagcacccagcagccagcgcactcggctgtagttgtggacagagctgtctcaaggcatctgtggcatgatgaaggcagctggtgccggtactggggtagtctttctaactgttagggcagcatccttttctcatggccgctccagcagcaggagaaggcccagtagctgtcagtggggtgccaggtttccctgtgcaaacagtgtccttgcttaagtgcaggagtgaacgtcagaaggatgtttctgtttgtgtttgattttcctctcaccccattccttctgtaacagcgtttaaacttaccagtgctgtgagaagaacatctaatctgtggctttagaagttgctcaatgtatccatgcacctgctgcgtttattaaaccagtttctccgcagttcacatccaaactaggcagactacagcttagctcccagcggatgaccctgtctgtatatcatgtctctgttctgtgtaggactgctcctacttgggcagtgtgtgcgcctgtagtctcagtacttgaggggttgaggcaggaggattactgtgaatttgagaacggcctgggatacagagtgagtttgcggttgacctaggttacataatgaaccctagtcttaaagaaagaaagcccaacaaaaatttttttgaatg

SEQ ID NO: 5131 - DNA, 1000 bp, mus musculus
ctctctacaagcttctgcaggcactgttgaggaccctgccaactccgtacgatgtagggctcagatataacttctcgggatttggaacctgtcagtgcaaacaccagaacatgcatctaacagtattttgggtcaccaagagtttcacactaaacagtgcttgtgtgattttcttttcaaactgatagactgtacattagtgatgttatctgtcccccaaaaggagataagaagcccattgacaagaagctgaggcaggaggattgagaatgggctcccccactccctctctgccagctaagcaatccaccagcgggccattcccatcaagctgaggaggggcatttcctgcgcggtgatttgtgtcggttaaaagcagaaacattgagcggtgacttgaggtttggttggtttggtttgcttgttttccgtcagctgggactcttacagaacaacaggtgggagggacagacagtcaaaccaaagatgaggaaatccacagactctccagaactttcttcctatgtcaaggagacgccaaagccaccctctccccactccaggttcctagtcaccaacagggtgcggaacggcttgagggagcacagcataccagagaggctaggacctgagttcaagttcttgctctcagagacagccagcagtcactcggtctctctggacttcagttttctacttactgtgtttgatccctttccactccacatataaacactgacaggactgatgttgaaccttggcgattccgcgtggctggcttcactgacccaccaggtatgaaaaggggttggtaaaattgtatgaaagagtgagggcaggcatacctgcaagctgccactgaatgaggtggttcacaagcagcacccagctcagaacgtgccgttggggaagatgtagcagccgagactggaataacctcctgtacacaacagaaagagtcccctcatcttccacctgcctaagatcttcacttgatctt

SEQ ID NO: 5132 - DNA, 1600 bp, mus musculus
tagagttgtgatgtgatgaagattccatggcagttgaggaggctgccttatggacaagcagactcaggctgtccctccccttagccagcttgccataaagagagcaaggaaccttccgctgtgtatgtattcctcaggcctctctgcccagagttaagaacttgttgggtttgtttttctaaaacaagcagagacctgacctccatctaatcaaacatctgaacatctctggaaggggtaaagagctttcctctgaatcctcaaaatacaccaggatgttcccgttccatagtcgctgcccgatatgtttattatgtgacagcatgttcttccccactgcctacgaatgctgctttcatccccaggccagactggcccctgccctgactgctcatgctgcccttggctctggttgctctacattctcttgtccctgagtgtcccacatattcggctaagcacccatctgcctctgcagctattattaggcaccactgcaacccaatcaagccaaaggatttggtttttattagcaagtgtcataaggctagcatttatatgtctgtttaggaaacatcctagcaagactgagataaatattaatgaagataatctcttttaaggaccagcactctggcccaagcttgcattcagatgtctttgggactctaggtaattctgaatcccgtccttggtcttgtcacctctgggtcacactcaacagcaccagagctccaaaacagcttccaacctgtcatgactagggtttgagaccagactaaccatccctccctcgtgggaatcacagaggcaacctgtgaaccaaactcagtgacttcccatacagggatttagaggtcctcagagcatgtatgggaaagttcactggctactccctgtcctgtggttccccaggactgtgcttagagacccatagggagataatacatcttatcagaccttcaaaactagtgagtgggagaggcgagagagacttttggaggtaggacccaaaggacatgctctttccactgtgtgtttcctgaggtggcccagggtgtaccacagaagacacggggcccggaagagtagcagagatgaaagagttcaatatggcacctgagcctggaggaagacgaggggccgcaggtgctgggcggtttctctccttcattgtttttcttacatggtcatcttcatgctgtgattattaacagagagccgcacatcaggattgatttgatgtcctctttggagcatatgttctactttttacaaaggttacaaagaaaagaatcattgagtcctattgtaattttgaacatcatgcgattattgagtcctaatgtattttaaatttgctctcaaattcatgcggctcttgtttgcatctatgcaaatgatatctgctaagaatctgaagatattcaggtaaaattccaaagttcctcaagtctagtgttaactgattgatacagacagccagtccgtggcagcaccaggcttggcacttgagcctgcgtcctgcccaccgcccatatgccccagcaggcttctgacctggccgagaaggtgggatggcgagacccatggcagcaag

SEQ ID NO: 5133 - DNA, 1000 bp, mus musculus
aagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaaggggcacttttggtatagcattggaaatgtaaatgagctaaatacctaataaaaaatggaaaaaaaaaaaaaaaagaaagttaaactaacatgacgcctcacaagagcctggacttgatgatctgtattatagaaacaacgtaggtctatttaaacaacaggtcagtgttgacgttggggctgattgtgtctgtcaatctccactgccctgcttccttcccataacaccatgagagctgtcgcactcatttaccctggcttgcccactcccagaatctaggttagactgttatctcgcattagccagtagaacgaagaagaggcggtgctgtgatagccctgggacggcgtgtgtgcctgggtgtgatgccgctaaagtcccagcattcaaaaattaaatgattttgcaaattggtttattttctgatggtgctagggaatgaacccagggcctgcacatgataggccaatactcgatctctgagctatgt

SEQ ID NO: 5134 - DNA, 1000 bp, mus musculus
tttggcaccacttcttgcacgtgccctggcttgccagcaagaacgatgctgcaacaggatccttccgcacacgtttattgggagagcttgattgcagaggcgaagtgaccccaagcccagaactggtgctgcttatataggcctaggagaggcgtgtctcacacccggattggttgtgcttgggttatgcttaccacctcatttgcatgcctacatctgattggttaacttctctctcatctgattggttaacttgtctctcatctgattggttaattttggttaattctcaaaacctcatcttggcaaaaaaaactttactgcctatgtatgtgtggtggccagcggtagccagcaccactctgcaacggcacatgtggcttcccacagaggggtcacagccaagaagcacatgggaagagaaagttccatggccaggagctagtgagatgatggggccatgaccaagaaaggggtggggtcacgaccaagaagaggatgatggtccatgaccaagaagaggatgggccatgaccaagaagcagatgaggtcatgaccaagaagaagatgtgtccatgatcaagaagggggtggggccatgaccaagaagaggactggccatgaccaagaagggactggactatgatgaagaagaggatggggccatggccaagacaagtatgggcatgaccaagaagcagatgagaccatggccaagaagcaaatgagatcatgaccaagaagaggatgggaccatgaccaagaagcaatgggtaagaggaaggcaagtttacttcagagaaatctcccagcagtacctgtttgcccctctcaaagttcctatctcttctaacagagtccacatattcagctcccaggcctctgacattcacccaatgctgccccctgcaccccgttgcctggatcacatgaactcccatcctcttgtggtttgcacagtggcgactcagtaaagaagtacttggtctgaagtcacat

SEQ ID NO: 5135 - DNA, 1000 bp, mus musculus
ctctgggtcctgtgagtacagaacaaggggtatacgtagtgaacaaagtggttttacatgttagaggttgagaggtcagtaatcagggtgcagagaagtagtggaaatgcctgtgccatttcctcttggaaatcaaggcattgacaatctcagaaacatgtgtggggctggggagatggtccagggggtgtagtgcttgctatgcaaacatggagatctgaattcagtccccagcccaggtgtaaaatgcgggtatgattgtacacacttgcaatctcagggctgggtggcagaaggcggcaggattcctggagctcacaggccagctcgtctatttgaaatgtgagatccaggttcaatgagagatgcaatcttgacgattaagggggaagtgaatgagagttacacatcaggtcagcctccagccttcactgcacatgcatagatgcacatagatgcacatgcccagttcccacaacacatgcaccttacatacacatatagtttaaaatatatgtgtaagacagccatggctgcccatatctgtgttccaagcatttgggaggctgagacaggagggttatcatgggatcaaagctgttctggactatatacctcccagatttctggaaaatttgttccttcagatttaggcttgttattatcactgctgtctgtaattcagtcctgagctagacaatcccatgtaattccctgaatctctcaaggaaaacaaaggtacaggctgttagaccctaaattcagatttagactgttagggcatgataacagctaaagagatagctcaacacttcaagggtcctgacattccgaggaccagttatcccagatcctcacaccaagcagtttcaaccaaatgacagtgcctccaactctaggggattccatgccctctctgcccaccacctatggcaccgtcacatatgtactcacacaggcatggacacacacatgtgcatcttttaaaaatacacattag

SEQ ID NO: 5136 - DNA, 1000 bp, mus musculus
aaacaccaagtgagggcagggcatgagagagagaggtgattgtgggtaaatggttgaagagttgttgaggtggtaaaagtaatacttaagaatatctgacaggttggcattgtgttttactgtatgaagcttatttttaaagctaaaaggtaagtgcagaaaaatcagtttcctcagcagacagggacacagtaaggcagtttctagtctgaggacatcaaatttaaaaaagaatttgtggaaagcttaaggccacatggagacactgcaggttatcgtccttctccaacctaacctccccctgctttttcacgtttcctaccaatctggacgggtctgaaaagagccctgtgctcacctgttgtaaaatgactccccttcccctgggaaggccacctgcttgtcatgttcacccagttaccagtgactcaccgtcttccaaatcacaccgccagctttcctgtttgtataacgattccatctcatttatgaacacttttgtgctcctaacaattctggaagatgctgtgaaggagccaggatcacctgagtgtgcctgctgcggagcacagtatccagggcagtcctcctgaaggggaagtgcgctcccatttcacctctgcctcttagaacccacaggctaagggacgtgttagagagactggggactggatcccatagaataaatactgcatggtgacagcagcaagcaggaggaaggtgagtacggtgacaatgatagtcacagcagtctggcagagactgtctatcagaccccgtctatcaggcacccccagagcagccatcttcccgggagacctaaaggaacaaccttgagctgtggggaggcaaaaaccttctttctggtggcctgactgcttatatgacccttgcacggaccttcagctgattccttgtccactttcacatcctatcttctaagaattttgattctgttcatcacagcgtggaaaatgacacaacagcatttcttcagaat

SEQ ID NO: 5137 - DNA, 1000 bp, mus musculus
attgggtattgggtgggggaaaaggactaacgtccttgagggccagcagaaagaatggaaacatgcaaccttagatggtatgaggttgaggggaccctccagaatgtatcagaaacatgggagatgagagactctcaggactcaaagagagagaccttagatgaaatgccctacattgggaagaggaaacttgtagattccacctccagcagaaagactggagggatcaagtgagggatgaagttgccatcccacagtcaaaactctgacccataattgttcctgtctgaaagtactccatgcatggaaatggaaaagagcctgaggaaaagaaggtccagcaacaggcccaaagtggaatccagctcaaggggaggccccaagacctgacactattacagtctatggagcgctcacaaaaagggacctatcatgactgccctccaaaagacctaacaagcagctgaaagagtcagatgcagatatttttacccaaataatgaacagaagcagctgacccctgtggttgaattaggggaaagctggaagaaactgaggaggagggtaaccctgtaggaggaccagcagtctcatttaacctggacccctgagatctctcagatactggaacaccaaccaggcagcatacaccagctgatatgagacttcgacacatatacagcagaggactgccaggtttgagttcagacagagaagatgcacctaactctcaagagactggaggccccagggagtttagaggtctggtgggatgggggatgtggacatcctcgtggagacaggtggctggggaggaggtatgggatgtggaacagctggagagtgaaccaggaggggaataaaatctggagtgtaatgtaaaaaaatcccaaatactgtaaaaaattatattttcacagaaagaactgaatttatactttgttacgttgggttgattttgtctttggtatcagtggagagcattatcccacatatttat

SEQ ID NO: 5138 - DNA, 1000 bp, mus musculus
aggggtccgccctgcccgggagcactttgcctgagcatctgcggcagacatcttggttccgggaacccgccggagtattctgcacaggtgagagtgtagaatacagaagctaacagcttctgggacaggccaaagcaactcagccacgggacaggtcctgttttgggccttcatctttggccaggagggaggtcctaacgccagatatctgtgcaccttccctgtaagaggagagcttgcctgcagagagtgctctaaccactgaaactcagaggagagatctagtctccgaggtctgctgatagaggctaacagaatcacctgagaaacaagctctaaccagagacaactaaatcaactaactccagagattatcagatggcgaaaggtaaacataagaatcttactaacagaaactaagaccactcaccagaacacagcactccgacctcgcccagtccagggcaccccaacacacccgaaaagctagacctggatctaaaagaatatctcatgatgatggtagaggacataaagaaggaccttaataactcactcaaagaaatacaggagaacactgctaaactggtagaagatcttaaagaggaagcacaaaaatcccttaaagaattacaggaaaacacgaccaaacaggtgatggaattgaataaaaccatccaagacctaaaaagggaagtagacacaataaagaaaaaccaaagtgaggcaacactggagatagaaaccctaggaaagaaatctggaaccatagatgccaggatcagcaagagaatacaagagatggaagagagaatctcaggtgcagaagattccatagagaacatcagcacaaaaatcaaagaaaatacaaaacgcaaaaagatcctaactcaaaacatccaggaaatccaggacacaatgagaagaccaaacctacggataatagaagtagatgagaatgaagattttcaactcaaaggaccggcaaatatcttcaaca

SEQ ID NO: 5139 - DNA, 1000 bp, mus musculus
ctctctttctctctctctctctctttctctctctctctctctcccctttcctctgtcctccctccccaaaataaactgttttttttgtatgagttacatttggttatgatataacaacaacaacaacaacaactaatgtaagactcatgtgtagattataaaaactaaaccagtttcaacttaaggtgagcatattaattatcattctacatatgtcaagtgttgtgatcataaaaagagaaagagctgtaaaaatatgttttgtgggatgtgaggaaaggggctgcctcagtgggcccatgccaaggcatcccttccccctgagggaccagacacacacaggtataatatagagtagagtttatttagggcatggggaggggaattaaaacagtagtagaggcagagagaaaggcagagagaagaagaaagtagagaagtagaggacggccatgaccatgtggagagaggggggaagagaatggggagagaggggaagcaagggtgcaagaggcaagagagaaaagctggagtaagggagagagcaggggccaagcagctcctttcatactgggcctagcttgcctgactgcctctaggtaaccgcaggaaggaggatacctggctgctgccaggcactgtgggggtagagtttagacagaatacctacatcaagaggtaagaaaagataagcatcttaatttgaaatggtcaccacagagaaagcacctagagtcagagtgatactagaaacgttacaggttttgtctgtgatccacaagaccatctcctcacagaccagcctgtttttgctgcaagggctaggtattttcagttatgatacaactataagacaattgcttttaattgtaagtttggaatttcctaccatgaagtaattgctttaaactccaatgtaaaatatgcagtaaaacgttaaattagttgggttgctatttcgctatctctggtaatatgttcccattgaaattcccataat

SEQ ID NO: 5140 - DNA, 1200 bp, mus musculus
ttaccacaacattcataacattgtgttataagtcttagataaagttttgcatgaatatattatatgaacatacataagtaaatatgtacacatgttcgttttcaaagtagggatatgagcaatggaatggttacttttaaggatggaaaatagagccatgtgaaaacagaatcttaattttgaagatttgttttgtgataatttaaggctgggaaaattttatgctcagcccattttgctttaaagttttgaatttgcattttgaaggtgatattaacacatggtgggttgtttctcctcttgtctgttgttttcactctctcctacctacagaaaagaggaaaaccagcctgctggatcagctgaccaacaccagtgggacggtcattggcgtgacttcctgcattgtgatcatccttattatcgtttctgtcattgtacagatcaaacagcctcgtaaaaaatacgtccaaaggaagtcagactttgaccagaccgttttccaggaggtgtttgagcctccccactatgagttatgtacgctcagaggaactggagcaacagccgactttgcagacgtggcggaagactttgaaaattaccataaactgaggagatcatcttccaaatgcatccatgaccatcactgtggatcccaactgtccagcgcgaaaggcagtcgcagtaacctcagcacaagggacgcttccattttggcagagatacccacacagccagtcaagcccctcatcccacccgtgaacagaaggaacatcctggtcatgaaacacaactactcacaagatgccgccgatgcctgtgacatcgacgagattgaggaggtgcccaccacaagccacaggctatccagacacgaaaaatctgtccagcggtcagtatccatagatatttaaatgatggcaactgtaactgaaaacggaaatgctgctatggcattgagttctagtctgtcttcatgctcacttgccctgtgaatgatagtgtgctagtcagctttttatatcctacacatgagcatgaaatatacacgtgtgcaatgacacatgtacacacagaccaaagatttttacttctgtatatgtgaaaactatttctacacaaacagggcatctcatttatgataaagatttaggcaaccaatctgacttcacagtcatagttgttgctcttatcaatatt

SEQ ID NO: 5141 - DNA, 1600 bp, mus musculus
ttctataattttgttgaagatatttactggccctttaagttgggaatctttgctctcttctatatatattacccttagtttggtcttttctttgtgtcctggatttcctggatgttttgggttaggggctttttgctttttgcattttctttgattgttctgtttatgttttctatgatatcttctgcacctgaaattttcgcttctacctcttgtatttgtttgtgatgcttgtatctatggctcctgatctctttcctaggttttctatcttcagggttattagctcaaaagctcagaatacccaagacccaattcacagaccacatgaagctcaagaagaaggaagaccaaagtgtgggttctttgttccttcttggaacggggaacaaaatactcaatgggaagaaatacaaagtgtggaccagagactgaaggaaaggccattcagagacggccctacctgggcatccatctcatagatacagtcaccaaacccagacattattgggaatgccaaaagtgcatcctacaaaaccctgatatagctgtctactgaaaggctctgccagagcctgacaaattcagaggtagatgctcacagcctgacattggactgagcacacagtccctgtgatggtttgtgtattcttagaccagggagtggcaccatttggaggtgtggccttgttggaattgatgtgacctggttggaataggtatgtcactgtgggtgtgggcataagaccctcaccctagttgactggaagtcagtcttccactagcagcctttggatgaagacgtagaactctcagctcctcctgcaccatgcctttctggatgctgccatgctccaaccttgatggtaatggattgaacctctgaacctgtaagccagccccaattaattgttggtttttataagacttgccttagtcatggtgtctgttcatagcagtaaaaccctaattaatatggtcctcaatggaggagttagagaaaggactgaaggagatgaaggaagggctttgcaaccccataggaagaacaacactatcaaacaaccagaatctccagagctcctagggactaaaccacccaccaagtagtatgcctggaaggacccatggtcccagctgtatatgtatcagagaatggccttgttggacatcagtgggaggagaggcccttgttcctgttaagactcgatgccccagtgtaggagaattcaagggcagtgatgaatgtgtggttggatgggtaggggagcacagtcatagaagcagaaagggggaatgtgataggaatttccaggggagaaatcaggaaaggagataacatttgaaatgtaaatatagaaaatatctaataaaaactatcaaaaataataaataaataaaatggtactcttcatatatgcagagaagcatgtgacaaatttcaatattctttcatgataaaattactaaggaaataggaatcaaaggaaaatactttagataataaaagttatgcatgccaaaactatagccaacattatattgagttgtagaagatgaaagctattccctctaacatttttaatgtcacagtggtacc

SEQ ID NO: 5142 - DNA, 1000 bp, mus musculus
tgtaattttcattaatggtcaaaaaaaatcatagctaaacataaaggacaattagcttacagctaaggactttccattagattaaaaacaagtctaatttttatcatgatttggaagaatgtacagtagatagagaggtctgctctgtaatcagcttaactaacatctctaaagtcaaagtgtaagatgacacaataagttcaaaggagctctgggggtactggttagttcatattgatgttcctcctatggggcttcaaaccccttcaactctttgggtactttctctagctccttcattaggaacctgtgctccgtctaatggatgattgtgaacatccacttctgtatttgccaggcactggcagagcctctcaggagactgctataacaggctcctgtcagcaagctcttgttggcatctgccatgaaggttctatgccccttcagtataggggaatgtcaggactaggaatgggagtgggtgggttggggagcaaggggaggtgggaggggataggggattttcagaagggaaactaggaaagagaataacatttgaaatgtaaataaagaaatttctaataaaaattttagaaaaagatgacacaattaaaagttatatgaggtgtacataaagcataaactagaaatgtgtcactgtgactattaatgctagggacatgacaagttacttgtgatgcaattactcagctgtacttggaacaggatagagttcatgaggagccatagagagattgtaatgcaactttgtcattctcggataagtttatccctttcatgtagaaagtgtgcacaccttgcacacagactgaagaacaacagtaaagcaatagaatagagtacagcatagaggtggccagctcactatttgggattcaggagaactaaccacagaccagatatccagattacatcctgatgtgcaagtacagcatcccaattcagtaggtgctcacaatatatttagagcttatag

SEQ ID NO: 5143 - DNA, 1000 bp, mus musculus
acacttggcagccaccctcttcaccttcggagctacctcaccagccctgtttctcctttaaaactccacctaggtatctactgtctacctttacctcatctctttctctgatccaagcctctcacttgtctctgataagatctcttttataattgagtttttctttttttacttagaaacattactttaacacttcatatattttatctttctactaatattttagttgctttatatgataatatttaagatatccatacacatatacagtgtacatatattacaaatatatagtgactaaatcagtgtagttcttgtgtatttttccattaatttattcattttacatccgaaatctgctcccttcttctcccagtcctccttccctcaattcctctacctattcctctggcccctcctcctttgacaagggagagaaaccctcaggtaccattctacactgacacacaaagaggatgcaggatgaggagcatcctctcccactgaggccagacagaacatcccagttagggaaacaggatccacaggcaggcaacaaattcaggggcagctcttgctgcagttgttgaggatctccaagaagaccaagctgcatatgtgcagaaggcctacgtctatcccatgcccactctttggttggtggttcattctctggaagccctcaagggtccaggggagttgactctgttggtcttcttgtggagtctctgtcctctgttctcttagtccttccccaagctctttcacaagactccttgagctccatctaatgtttggttttgggtctctgcatctgttcccactatctggtgggtgggacccatcagaggacatttagtttaggatcatgtctacaagcataacagaatattattaatagtgttagggttggttttggcatgagatttgtctcaatttgggccacttctccttaaaggatatttgatctcattcttcacttgctccttcaaacatcaca

SEQ ID NO: 5144 - DNA, 3200 bp, mus musculus
atttaaatcttattctgttatgacctagtgttccctatgaataccaatcaatatatgacagaatctctctagccctgagctagtaaacatatccaatgttgacttaccctaggtctgcctatgtcttaagcctttcctggtattacattactgcatatatcatttcctatatagaccatggaaagtaatttcttggtattcttcctacatttgcttttaactttaacaaagatgtataaaaatgtgcgtgtttcacagtatgtgccatgccagacttctatagtgatttttctttattttttcaaaaatatttccatggtctgttcctgatgatagcatctgaatgtttgtgtcttcccaaaattcttgtaataaagcttgactattaagatggttggatcagaaaggtctttggaaggtaaactataagagtagaccctctttgaccagagacttggcccatgagccaccatgctggatcacccaagttgatgcccgaatacctacaactgtgtaagaaaggaacaaatccctgcacttccttttgagctctccctgtatagcatagtaaatgcccttttcccacagaaaataaaattgaaaatttaaacataagataaaaaggaatgcagtctaatataaataatacagattattttttatttctatctcttttttgaaaatattttagctattttctttatttacattttaaatgttatcctctttcctaccttcccttcagaaagccccctgtcacatcctcctccccctgcttctatgagggtgttcccctacccatctacccactcccacctctccatcctggcattctcctacactggggcattgagtcttcacaggatcaagggcctcttctcccattgatgtccaacaaggtcatcctctgctacatatgtggctagagccatgagtcactctttgctttcagaacctttatgaaaaagtgactaggagctgccttgagccctctactgtgagggggcacaaagtggagaaactatctatgaatcagaaaaagaattctgactaaaatatgcatctttcagtgtttcaatttttacattctgggaataaaaactgtgaaagttagatttttgttttctgtaagcagatcagactatgttattttgtatagcagcataaatgaccaaaatactaggcaaccattacaaccagcttttataggaaatgggatcaacaagaacaatcttagtgcatttgtatttgatggaaatggaataaggtagtttttattgttgttgttgttttttttttaacagtataaatcagatattaccatggtcttgttcagactctaaaaattatccacagccaattactctactgtttatcttacttgtttcaaatcagttcttactgagtgaaaagaatgataatcattgctatagaaatatgaagccaagaatagattatcttgcattaaacagaaaacatttgagattattaatataatgaaatattatatcctatgctatgatgataataataacagttatagagttttagactttaaaggatttagaaaaggtataatataattacttcacattagggatctaatgttaattttaggaagatagaacttagtttttagattactgttatgtatatagacaactaagaagatgagccaaatattttccatgtatcccattgattgataagctctatgcacactataataaaatacttgaagcagactataggaaaagttatataactgcttactacagatgttcaaaatctgaatcctgatgggctctgtgaatttgtcctctgtttatagtaaaatgatcaatgtattgtagcatgttggaaagggtgatagagaagaaggcagaaagcatagaaacatattgtgttttgtcatgattatggatctctgagcttgcgtgcaaagggtattcctgaagacttctaagatgcctattatacaagactggggaggttagagaagcatggcaacaaacatgcatagacaaagccttcttaatagttactcaacatgactgagttgtatcagttaatgagcattttcaaactacatagatacgctttcactcaatgcctggagatgtttcaatagatacttactcactattttcccttatcactagttttctagcatttggaccaagctaaccagctagccaaaccatttttcttgatcataaatgaagataatctattttctgtttctctctgtttttttttttttttttttttccagaagaaaattgacagcctaggttctggccattgggagcaattttttttccactgcctgtcagagccctgtgagttgaacttcagaatcaaaaatgttcactgtcagatattcccatgttctacaatgatatttcagattgagttttatatctttcttgtttaataagctgctgttgggaactctttttgaagaaatttcattatatgtgataaatttcattatatatatgataaaagaagattccagaatattagtttcaatttttaactaattttatgctaaaatttctggatattcaggatctccattagccaaatgtggtatatgctattttttaaataaaataataatacatattatatatttttatgtattacatatatcattagatataatttaatatatattatatgattcatataatgctccttgacactacatcacagtatgccctattttattttgaataccaaatttcaggtagaatactacacactatcatttggcttccattcatcagagttcatataggttgtaataatttcattactcgaaaagataaggtagaatttggtataaggacatgcttgaacacaggaatttgaatgaaaaaagaagatttgcataagagagatcaaacagggcacattctgtaatagcagagaggtaagatgaagggagctcaaagcagctgctcgcactgcagttgtatttgaaagttgctcatcacactttcacctcagttcaagactcagcccaagaagtgatgtaacccacatttgggcgactctaccaaccataactgatctaaccagggaaattcttcatagacatgcctagagtcttgttttcatgttaattctatttttttcaagtaatattcaagattagctttcaaaactctcaaatgatgtatgtaaatcat

SEQ ID NO: 5145 - DNA, 1200 bp, mus musculus
atcatttgatgaaggtaaagcaccaaaaatttgatgacctgggaaaattagtaggtaatgaatagagactattagcattaaaaattgaaaataagatgaaagaggagaccccgagtagtctgctatgctggaggagatagcagactactcctgctgcatttacttcacctccatcagactcatgagccatgcagacaagaacttcttgtcttctgagaggttccaaccagcaacttactcagacaggtacagacacccacagctaagcagtgaatggagcctgaagactcttatggaagaatagaaagaaggattgcaggcccaaaaggggtaagaaatccacagaaagaccagcagtcaactaacctggacccttaagtctctcagagtctaaactaccagccaaagagagtacacaggctggatgaggcctccccactcatgtgtagcagatgggtaatgtgaccttcctgttgagtcctgaacaactggagcaggggtaatcccaaaagcagttgcctggatatggcatatgtactactagctgagctgctttgtttggcctcactgggagagtaagcccctagcctagcaaagacttgaagtgcaggggaggagaagaaggagatactcaagggaggggggcagctgctcagagaagaggagtggaaaaggggaaatgtgagcaggtgtggatagtgagtgcgatgtaaagtaaatgagtaaaagaataaaattaaattaaaaaaatagatgggtgacactactaaaagcagttgaaatcaaaatactatgaacactaacatgaacgtgtgaaatggtataaaatacagaagtaaaggagaaacaatacaatggaaatctcactaggaaagttaggaactggaaacaaatgcatgagcagaaagacattcatcacagcgccaagaacacaccaagaaacttaaattctgagtctatctatttggaatgttggtctaagttcagttatgcgtcaaaacgttgcctcagcttgtgtgtgatgatactcctcttttttttttttaaacctaaatctaactttttttttccattttttattaggtttttagctcatttacatttccaatgctataccaaaagtcccccatatccacccacccccactcccttgcccacccacttcccctttttggccctggtgttcccctgtactggggc

SEQ ID NO: 5146 - DNA, 1200 bp, mus musculus
tctacatatctttatttttaatttcatttaatcttttttatactccagatattatcctccttccagtctaccctctgactgttccccatctcatacctccttcccacacctctgtctccatgaggatgttcccaccccacaccccacctgacatctaaactccctagggcctccagtctctctctctctttttattgtttgtttgtttgcttgtttgtttgttttttgagacagggtttctctgtgtagttctggctgtcctggaactcaccctgtggatgaggctagccttgaacttagaaatcagcctgcctctgcctcctgagtgctgggattaaagatgtttgctaccactgcccagcagcctccagtctcttgagggttagatgcctcttctctgactgaactcagacccagaagtcctatgctgtatatatgtgttgggggtgggggggctcatatctgctgatgtatgcagcctggttggtggtccagagtttgagggatcttgtgggtaagggtaattgagactgctggtcctcctacctcagctactttcagcttttccctaattcaaccacagcgatcagcagcttctgttcattggttgggtacgaacatctgcatttgactcgttcagctgcttgttgggtctttctgagggcagtcatgataggtcccttcttttgagcacttcatggcctctgtaatagtgtcaggccttggggcctccccttgagctgaatcccagttttggcttgtcactggacctccttttccttaggttcttctccattttttctccctgcagttctttccgacaggaaaaattctgggtcagagttttgactgtgggatagcaaccccaaccctcacttgatgtcatatctttctgctggaggtgggttctaaaaattccctctctccactgtagggcatttcatctacatatctttaacagaagtgaaacaccattaaaatttcctaactcaaattatatctttgatttagtatttttccaaggtctgcaccatctgcatccttcaattgggagttgtttagtaccatagatactaacagttaaaattagtattgtctttccaagctcaatacaatcatgaaccatattctacatccctgttttagtttcttttccatttactgcaatgaaatatcctggcaaaattaatttaatggaga

SEQ ID NO: 5147 - DNA, 1200 bp, mus musculus
aataaaacctgctcaatctattcaatgttacttagttttttattattttatttatttacatttcaacccctgccctcccccgtacaagccccctatcacatctcccttctgtttgccctaagaaggtgctcccacacccacccacctaacccctctagcatcccccttccctggggcatcaagcttccacagcaggctaagggtagtcctttgctacatatgcatcaggagggccaaaggatcagcccatgtataatccctgggggctctgagggctttggttagttaatactgttgttcttcctatggggttgcaatgcccttcagctccttcagttcttcccctagctcttctataagagtccctgagctcagtccaatagttggttgtaagtatctgcatctgcctcagtcaggtgttggtaaagcctctcagagaacagccattccaggctcctatctacaagcatatcttggcaccagcagtagtgtcagagttttgtgtctgctcatggggttgatcccaaggtgggacagtatctgaatggccttttcttcaatctctgttccattttttgaccttgaatttcctttagacaggaacaattctgagtcaaaatttttgagattggtgagtggccccatctctcaattgggatcaagtctatgtctggaggtcatcccttcaggttccatctccccactgttggagctttcagctaatatcatccccattgcgtcctgggagcctctcacatccctggtgtctgagattttctagtggttccccactccccaacacacacacacacacacacacacacaccactacactgctccatatttctattcattctcctggtcctctgggcttctctcctctctcccccatacctgttcctgaccctctttccccgctctgcttctctccaaacctacttaattataaggtaacctctaacagaaaaaaataaagctctatttcctcttaaccttgaatttcttataagatcctgaactatggcacatgttgcatgccctgtcctataaccgtgctgcagcaggtgatgctgtctcctgtcataaacgtttatatcaggagtggactcagaactcggaactagctaagaatacagaggctacagtcataactttgattagctaaggttgaatataaagtcacaaggactttgggccatt

SEQ ID NO: 5148 - DNA, 1200 bp, mus musculus
tgctcacatctatgattccagatttctttcctagggtttctatctccagtgttgcttcactttctgttttctttattgtgtctacttccctctttagatctagtatggttttgttcattttcatcacctagttggatgtgttttcttctcttcctttaaggacttgcaactctttagcagtgttctcctgtatttctttaagtgagttattaaagtccttcttgatttattctaccataatcatgagatatgcctttaaatccgggtctagtttttcaggtgtgttgaagtgcccaggactggctgaggttggagtgctgttttctgatgatggtgagtggtcttgttttcttttagcaataatctcaagtctgccttttgccatgtggtaatctctggagtcagttgttatagttgtctctggttagagcttgtttctttcatgattctgttattctctatcagcagagttgggagactagctctcccctgagattcagtggtcagagcactctctgcaggcaggttctcctcttccagggaaggtgcacagatacctggtgttcggacttgcctcctggcagaagatgaaggccccaaacaggacctgtcccagaagctgttagcttctgtaatccacactctcacctatgcagacttgtctcagtgggatccagggaccaaggtggctccctcaggtactcaggcaaagcccacccaggtagggttgacacctctcctctggcagggaaggtgcctgaatgtcaggagctcgaaacagggtctgcctcagaagctctgtggctcctgcctgtcctcgaagctgttagcttttgtagtccacactctcacctgtgcagactagtcttggtgtaatccaggaaccaagatttctcccccagatgctctggcaactcccattactatggcattgctggatgatttctctcctgctgctcttaaacctgatctctctgcttctgtgtcatggcgattctcgagaaagtgctttttttgttacattggtcagagactctgaatttccaatacattttacattacttaacttccctggatttatacatctgatataaactgataatacaatttcaattctattgttctgttttcatgtagtaattcttgcttcctgtaattgatataaacatttgtactaatatatccaaattaaaagcacat

SEQ ID NO: 5149 - DNA, 1200 bp, mus musculus
acattaattatgttgagaatgtcaaaaaatattgcttgttgcctagaagtatttccttttacataatcaataaaatttaaaagaaattaatatgatgaggcaatcccataaaattgaaatatgacacagtagttgagggcatgttatcaatttcaacactacatcattaaagctcttcttgtaaaaaaaaaaaaaaagttcaaggggcacaagtcccctctggtccggccagcaccaaggttgctagggctcagagtcggctgacactctggtgagtggaacacagctgctgctccaatccaattgcacaggacctgagactgcattaattatagaagcagaaaacccggcctgataaggggcacaagtcccttccagtccagccagcaccgggttagctagggcacagagtcggctgacacccgccagctacccacaagacctgccacgggatcttaagacctctggtgagtggaacacagctgctgctccaatccaattgcacaggacctgagactgcattaattagggaagcagaaaacccggcctgatcagtggcacaattcccttccggtccacaccagtacaggggtaccttgggcgtggagtctgtggacacccataaggtatacacaggaccctcgatgggatcttaagacctctgtgagtggatcacaaattctgccaggaggcaggttcaaataccagatatctgggcaccttccctgaaagaggagagcctacctgcagagagtactctgaacactgaaactcaggagagagctagtctcccaggtctgctgatagaggctaacataaacacctgaggaacaagatctaaccagagacaactacaacaactaactccagagattaccagatggcgaaaggcaaacataagaatcttactaacagaaaccaagaccactcaccatcatcagaacacagcactcccaccccaccaggtcctgggcaccccaacacacccgaaaaactagacctggatttaaaagcatatctcatgatgatggtagaggacatcaagaaggactataataactcacttaaagaaatacaggagaacactgctaaacaggtagaagaccttaaagaggaagcacaaaaatcccttaaagtattgcaagaaaacacgaccaaacaggtgatggaattgaataaaaccatccaagacataaaaag

SEQ ID NO: 5150 - DNA, 1000 bp, mus musculus
ttacattacttttttattaaatattttctttatttacatttcaaatgctatcccttttcctagtttcccctatgaaaatcccctgtcccctaaccctgccccctgctcaccaacccacccactcctgcttcttggcattcccctaaactagggcatagaaccttcacaggaccaagggcctctcctcccattgatgactgactgttgtctccctttccagtctccctccacaatcccccaagctattgccctctcatttgcttctatgaggatgctcctccacctatctattcattcctgcatcactgcccaagcatcaccctttgctggggcattgagtatccacaggaccaaggtaccaaggtccatccctcttattgatgccagataaggccatccactgctacaattatagttgaagccatgattcccttcatgtgcactctttggtggtttagtctctgggagctctggggtccagttaattgatattattgtttttcctatggggttacttcaagttttaattgaattggctcattttcttcatggtttctcccctctctttctttgagtcttttgtgtttcctgggcaccaatgctctgtcagatgtataactggtgaagatgtttccatcttgtaagctgcacagaagccttctagtttcccaaactctcttatgtcaattattggtctttactcctggtctcactttcagaaatttcttcctatgcctgtcattgaagtatttcccatactttctctttagacatcttcaaagttttagaactttgttgaagtgcttgatccatttgtatttgacttttgaggagcgtagggaaaggatctagtttcatctttctacatgaagctatctagtttgagcaacaatccatgttgaagatcatatcttttctccaatgcttgtgattgacttttagtaaaaacaaaacaaaacaacccacaaaaaaacaaatccaaaatgaaaaaaaactacca

SEQ ID NO: 5151 - DNA, 1000 bp, mus musculus
tgtactcctttataagtagatattagccaaaataatgtacagaatacccaggataaaatccacagaacccaagaaggtaaataatcagaaggacccaagtgaggatgtttcaatcccatttgagagggagaagaaagcaattgcagggagcagcgggagtgagggacttggatgggagaggggaggggggaatgggaacacaatcaagtactggggtgtgggaacagtagggaagccctgagggtcagcagaaagaatggaaacaggcaaccttgggaggtgggaggtcaagggactggcaagaatgtaccagagatctgggaggtgagaaactttcagtaccgaaagggagacaccttagatgaaatgcccaacaatgggaagagggaactggaagagtccacatcctatagaaagacaaggcatcaagtagaggggtagggttgccatctcacagtcaaaaatactgatccagaattgttcttgtctaaaagaactgcagggacaaaaacagaggagatgctgaggggaaagaagagtagtgactggcccattttgggatccacctcaaggggaggctccaatgcctattaatgatgctatggtgtgcttacaaagaggggcctagcatggctcttctctgagaggcccaacaagcagctgactgagacatatgcagatatttacacccaaccaatggactgaccctggggagctctgtggttgaattggggaaagactggaaaaaggcaatgaggaaggtgacccaagaagaagaccagcagtcttaactaacctagaagcctgatatgtctcagacactgagacaccaaccaggcagcatacatcagctggtctgaagccccatacacatataaagcagaggattgtctggtctggcctcagtgagagaatatgcatctaacccagagagccttgtgaccccagggagtagggaagcctggcagagtggggtgggaggacattctcttggagatgg

SEQ ID NO: 5152 - DNA, 1000 bp, mus musculus
gtaggaggtgtgtgtgtgtgtgtgtgtgtgtgtgtgtgtgtgtgtgtgtttgtgtgtcagttttacaattttattcggacgtatttacagaaatgggttacagggaaaacaagctagacacagatggagacagaatgagtcagaaatgagaagaagtcagaagattacaacatattgccaaagttagtatgaggccaggtagagcaattcagtcagaagctaagagaaactggattgaatcagtcagcctggaagattagattgtatagaggctagaggcttccaggtttccaggctggttttgtgtgtcaacttgaaacaagctggaattatcagaggaaggggcttcccttgaggaaatgcctccatgagatccagctgtaaggcattttctcaattagtgatcaagggtgggagagcccattgtgggtggtcccatccccaggcttgtagcctataagaaagcaagctgatcaagccaggagaagcaatacagtaatcagcactcctccatggtctctgcaacagctcctgcctccaagtccttcccctgtctgaattcctgttctgacttcctttggtgatgaatagcaatgtggtagtgtaagctgaataaaccctttcttccccaacttgcttcttggtcatggtgttttgtgcagaaaccctgactaagacacaggcctagggcaagggacagttagaacacataaggaaatgttcttggctcagcccaagccagatattcacatagcttgggcacagctcttatctcatcacttcatctgaggaaataaaagtgacatttacagagaagtggcagcagtagattatcttctaggttacatggcctaaccaaccatgtgtagtgggccatgttaccagtgtcacacaagaattccctcattctgagcaggccatatgtccaatttgattatatttcaatagaatttgaaatatttattggaagtgggggattggtttttgtcaaagaaaggac

SEQ ID NO: 5153 - DNA, 1200 bp, mus musculus
aactagaagagcccttccctggcaggttggagagatagtgggttttaggagttaaaggtgaagcaaagagaaacaacctggtctgtgagcttggccctcatgatgaagatgctcatgggatcagatggaacgagggagctgggtgcagaggtggggtgttcaggatcagagcattgctggtatgccccaggggcagagtaacggcaggagacttaagccacctcctcttcagcctcctattcgaactggacctctgcagcgttggtactcagacaccaagtttatattgctctctgcttccataaactccatctggtccataccttcgcccgtgtaccagtgcaggaaggccttgcacctgaacatggtggtgaactgctccaagatgtgattgaactgctcctggatggctttgctgtggctgatgaaagtggctgccattttcagattccggggtagaatgtcacacagggctgtattgacattgttggggatccactcaaccaagtagctgctgttcttgctctgcacacttagcatctgctcgtccacctcctgcatggacatccatccctagaagacagtagccttggtcaggtagcaaccatgtcaggtcaccatgttctagccatcatgttcttagcatcaaacatctgttgggttagctcaggaatggtgagggcctggtactgctggatgcccctgctggtcaagagtgggaatcctagcatgaagaagtggagacagggagactggggggaggtgggggaatggcaccatgttcacagccagtttgcatagatctacattgagcttgcctggtcacctcactcatggtggctggtggctgaggtccccgtagatgggtgtggtcattgccaaacagtaggtctcatcagtattctctaccagctgatgcacagacagagtggcattgtagggcaccaccaccatgtcagataccttggctggtggcaccacgctgaacatattcatgaccttgtctgagaactccaggatcttgctgatgagcaaggttcccatgcctgtgccggtaccacctctgagcgagtgggtgagctggtagacctggagacagtcatagctttctgcctctttgtgcaccacatccagggctacatccactaactctgcaccctcggtgttagtaacccttggctcagttgttgcctgctccgg

SEQ ID NO: 5154 - DNA, 1200 bp, mus musculus
tcaatgatccttgtagtctcaaaatatttaatcaaactaatgatatgttatatacaatacacagaccatatgatgctcaagaagaaggaagaccaaagtatgaatgcttcagtctttcttagaagggggaacaaaatactcacaggaggtagatgatgggagggacttaggaggaagagagaagggggataagaaaagggggacaggatcaggtatgggaagaacctgagatgataaacagaggttcagaaaattgaacagaggtgtgtaacaatgggggatggagaacaggaggtagccaccagaaagtcccagatgccagaaaatcaagaggttcccaggacccaacagggatgagattagctgaaatgctcaacaaaggggagggagaacctatagagaccatatccagaggttaggaaagactcccagttgggggatggggccaaccactcatctccaaatttttaacccagaattgtttctgtctaaaggaaatactgggacaaagtgtcgaacagagactgaaggaaaggccatccagagactgccccacctgggaatccatcccatatacagcctccaaacccagacactattgctgatgcaaagaaatgcttgctgacaggagcctgatatggatgtctcctgagagactctgccagagcctcgcaaatacagatgcagatgcttgcagccaagcattggactgagcacagggacccaaatggaagggttaggagaaggactgaagaagctgaaggggtttgcaacctcttagaaagaacaacaatatcaaccaaccagacccccagagctcccaggaactaaccaccaaccaaagagtacatgtggagggactcatggctccagatgcatatgtagcagaagatggcctcatctggcaccgatgggaggaggtaccattggtcctgtgaaggttcaatgcccaagtgtaggggaatgtcaggatggtgaggtgggagtgtctcatggaagcagaggaaggggtataggatagggggtttgtggaaggaaaaggggataacatttgaaatgtaaataaagaaaatatccaattaataaaaaaagaaaaagaaacagcacgatccaataaaatttcttgaagaagaaaaaggagagatggttcagcagttaagagcactaactgctcttccagaggacctaggttcgattccc

SEQ ID NO: 5155 - DNA, 1200 bp, mus musculus
aagcccacttattaatttggaagaggagatttcgacacagcctaatgttaagtattatgcacatctacaatgaaaaggagcaagcaggacaaagagaaatacaaaatgtacagtttgaagagaaaaagaatgccaaaaaatgtaattttggaaccaagtcctgtgtttaggagataaaaacttaaaagaaaatactgactcaaaaaacagaattaaagaagaggcaacctcaggacaagacctactcagctcatcttgaaacctgtgaaaggaaaaacctttgggagtttcttagccagaaataccattaacaagtcaaagcttgagcaggggcacaagtcccttccggcccactccagcaccggggtgccttgcccgtggagtctccggacacccgcaaggaaccacacaggattccccacgggatcctaagacctctggcgagtggaacaccacaagtcccttctggttcactccagcagcggagttccttgcgcacggagtttctggacacccccaaggtcctcacaggaacctccatgtgatcttaagacctctggtgagtggaacacaacttctgccaggaggcaggttcaaaaactagatatctggacaccttccctgcaagaggagagcttacctgcagagagtactctgaccactgaaactaaggatagagctagtctcccaggtctgctgatagaggctaaaataatcacctgaggaacaagctctagccactataacaactagctccagagaataccagatggcaaaagggaaatgtaagaatcctactaacagaaatcaagaccactcaccatcttcagaacgcagcactcccaccccacctagtactgggcaccccaacacaaaagctagacctggatttaaaagcatatctcatgatgatggtagaggacatcaagaaggactttaataactcacttaaagaaatacaggagaacactgctaaagagttacaagtccttaaagaaaaacaggaaaacacaaccaaacaggtagaagtccttaaagaaaaacaagaaaacacatccaaacaagagatggaaatgaacaaaaccatactagacctaaaaagggaagtagacacaataaagaaaacccaaagtgaggcaacgctggagatagaaaccctaggaaagaaatctgcaaccatggatgcgagaatcagcaaca

SEQ ID NO: 5156 - DNA, 1000 bp, mus musculus
ccatgctctacaaagtgagttccaggaagtcaaggctacacagtgagatcctgtcttggaaaagaaatcctggtgcaataaagtgtttaatcagggacagcaaggtggctcagctaaagtcaccaagtctgatgacctgagttcaatttctgggacacatatggtggaaagagaaaactaacttccttgagttgtcttctagttttaatatgcacttctgaggtttacataaacacacacacacacacacagagagagagagagagagagagagtcacacaagtacaattaaaatggagcatagatccatagaaatataaaatgcaaaacaaaacataaaataaagagaagattaaacataaaaagagaatagcgggctggtgagacggctcagtgtttctatactcaaattcaccctatatcacacacacatgcactcacacacactcatacacactcacagaaacacatatatactcacacacacaaactcaagcacactcacaagtgtatacaccttcttgattctgtgagacttgtgtccagccagctctaagatctctctgtctccctcatactccacagaactgagattaaaaacacattggcaccatgtctagttttcaggtgagttctgggcatttgaactcaggtcctcatgcttgcacaaaaatcatttcaccactgagccatctcttgtgtccctctaatttgttgaccttagacaaaagcctagcagcttaaagcgaaggttttgtagaactcattctttcaccagcagtctttcaaggttttttcagccttttaattctttaattggtagagagattgaacctgatcaagactcctaaatggtattatgagtgtgctccttactgccttgttcactgtggcctgcttagcctgctttcttatagcacaaggtcttatatccacagtggtctgggccttcccatatcaatgactgatgaagaaaatgtcttaaaggcttgcctataac

SEQ ID NO: 5157 - DNA, 1000 bp, mus musculus
tactaataagctcagtgtgaagcctacctcacaaaggataggagacagatccgcttgcgaaggttaggtgtacggaacaagtccagtggggagggttttgtctgtgctgcctccaactcctccttcatgatagttttcacaaccttcaacaacattgacaaactgttgtcacaaaatggtaaacattgtgatgcatgttggcaacatatagaggactacctctctctctctgtctctgtctctctctctctctcacacacgcacacacagacagagtctcctaaatatatgaatctaatctgcttatggataaccatagaaatatgcaacctcggggggtgggtggaggtcgggggccctctagaatgtaccagagatctgggaggtgagagactttcaggactcaaagggagggaccttagatgaaatgccctacagtggggagagggaacttggagaacacacctccagtagacagggcatcagttggagggagggtgttgccatcccacagcaaaagactctgacccaaaattgtctttgtctaaaagaactgcagggacaaaaatggagaagagactgagggaaaggaggtccagtgactggcccaacttgggatccatctcaagccgggggcagggggagggtctccaaagtctggcgcactgttactgatgctgtggtgtgcttacagacaggaccctagcatggctgctccccaagaggcccaacaagcacctgacacagatgcttacacccaatcaatggactgaagtctgggaatcctgtggttgaattagtgaaaggctggaagaagttgaggaggaggggagcaaccccataggaagaccagcagtctcaactaacctgagtccccgagatctctcagatactgaaccaccaaccaggcagcatacactagcttgtacgagaacccctacacatatacagcagaggactgcctggtctagccacagtgagagaagatgaatttaactct

SEQ ID NO: 5158 - DNA, 1000 bp, mus musculus
gataatgatgtttctttttttttttaatcaaagtacctgtttaataaaactactattaattaactaattaattagggtattttgtggtacaatggatttactgtagggccttagacatgtcttctttttgttcatttatttaaatttgttgtcgtcgttgttggaagtcttactaaattgcccaggctggcacatttgaacacatgatcctcctgcctaagcctccaagcagctggaattacaggtctgagccacaggacctggctctgcagatgaacccaaacaagatttcatcaagctaatgttcatctttactgcacgttaaagcagtcaatctgcctgccttgaaagctgctatgcagcccaggctagcacaacctcctgagtcttctgctgaaggctcctgagtgccgagttacagatgcgggctgggctgtatgcctggcctcaacaagcaaagcttggccaggaaaagattatgtggacttagagatcatgacgtcaaaaaagcacaatggatgtgtgagtgtgtgtgtgtgagtgtgtgtgtgtgagtgtgtaaatcatgcgacacctaagcagcttcttaagaaaagttgctcactttggttatttgcccaagtaatatccctatttaagagttacatcaataattttggggtatatgatttagaataaacacagcttaatcatcttgaatataacatatatgaaatataataatgggcctggtatttactctaaatgtaagtaaaatgtccgaattcaatttgtttaaatgcactgctatcttaggatagttaaggaaaccagtccacttcaaagctctgaagcaagctgcccgttagcttctgacagggttacagttacgggagtgagagagagggaacgtctctgaataagcaggctccagatcttccagattctgcccccattgtcagtcatttcatagtctgtctacacgccctctataagcccttcagtttatacttgcttgtat

SEQ ID NO: 5159 - DNA, 1000 bp, mus musculus
atttctttaagtgagttattaaagtccttcttgatgtcctctaccatcatcatgagatatgcttttaaatccgggtctagcttgtcaggtgtgttggggtgccctggcatgggctggattctgatgatggtgagtggtcttggttttgttagtaagattcttacatctgcctttcaccatctggtaatctctggagttagttgttatagttgtctctggttagagattgttcctctcgtgattctgttaacctctgtcagcagacctgggagactagatatctcctatgagtttcaatgatcagagtactctctgcaggcaagctctcctcttacagggaaggtgcacagatatctggcgttcgaacctccctcctggcccaagatgaaggcccaaatcaggacctgtcccagaagctgtgttgcttcggcctgtcacagaagctgttagcttctgtagtccacattctcacctgcacagattagtctcagagtgatctgagaaccaagatggctcccccaggtactcctgcaaagccctcctgggcagggtggacacctatcctctgggagggattgtggctggatgtctggagcctgaaaagggggctgcctcagaagctctgtggctcctgcctgtcccagaagctgttagcttcggtagtctacactctcacctgtgcagactagtctcagtggagtcccagaacctttctcaacgtcttctatcatcatcatgagatgtgattttaagtcagagtcttgctttcctcttgctttcctggtgtgatggggctcactgtggtaggagaactatgttctgatgttgccaagtagccttggttcctaatgcttatgttcttagccttgcctcttgccatcttcttatctctggtgttagcttgtcttactatctctgactatagattgtgtctcctgtaagcctgtgtgtcagtactcctgggagaccagttctctccaggtggaatttgggtatggag

SEQ ID NO: 5160 - DNA, 1200 bp, mus musculus
gaacacaggatgtcagcgccatcttgcaacggcgaatgtgagggcggctccccacaactgtaattcttcctttctaatccctgttctcctgtctaaactttgttcatagtgtttattgggcttttgtttctcagaaactttcagtttatgtacacctagccattgtcttaacccaaggactgctacagatgctcttgaacaaggaggaagaagaaggtcacatagggagaagaaagtcacatacatgggagaagaaaatagccaggaagtagatcagataagctccttcaaagtttatataagaagctaatgtaacctagcaacggctccctagaattgaggaatgctgttcctgctgtcctctagtgtgttaacccacaaaagcagtgacccatgcacatgttttgcttgagtatgtacatcttctgcatcctactgctggtacatgcatcttgattgtgaaggttagaatatatttccatgtgtcatgatgtgtctgccattttggaccactgtcttatgtgcagaacttcactcagtgccaccatgtcaaggtctgaatgtgcagctgtcaacgggagcaagctaatttggaaaaatgctactgtcattatctgtgacagtttggttcaaataagtcatttacatagaagactgatgctctaagatgcagctgcaatgaccagctactgagctgccacagaaagggtatcctaggtttgcaacacctcatgatcctgaagtggcccagacaccactcagtgcgatgtttgattcaacttagtagccacagtatagacattaataaaagtaacactataggacatagaaatggaaacactgactatactgggtgactcaatgacattttgatttattccacaggttcttgtagtgctaccatcaaatcctgctgtgactgtgatggcaccccctgtgacgcttcaaccattgccaccatcagaacaccaagggaaaaatgttccagaaaatgtatataagaaccactcagaagaaatagtctaattttcttgtgtgtatgtgaatgtgtgtgtgtgtgtgtgtgtgtgtgtgtatgcatttccctgggaaattaacacttcattgccctggcttttggggggaatatcagacatgccataactttgtaaatctaacatctactagtacaacaacactttaacatcctccattaattgt

SEQ ID NO: 5161 - DNA, 1400 bp, mus musculus
gcagtctgctgccaggacagcaaaggaagtagagcgtgtgcaccgtgaatcgcagtatgtacatcttagagaagacatttaaaaagatttcaaagtgaaaatttgtgaagtgcttgaacaacaggaaagtaatgtttgtcctaaggaagaaggactatatcatatttttaaaggaaaaacaagaataatgaaagtatcccaagaacaagacatggagaaggaataaagtgttgaatatgcatctttccggtcacagccttgtatgagaacaaatgaggcaacagtaggcgagcagaatgcacagcagtacaaacatcggaaggaatagttccgaaaagatttaaaggagatggctcatgaacaatttgaaaattctgaagttattctttattctaaggaagagttgccacctgatgactctagaagagtaaagcacataaaggttgaagaaaagaagacagggtatttgtatgcacccaattttagctctttcgagcatagaattgctgccttgagggctactgcacacgttgagccagctcctgctgcctgcactggtggtgcaggtgacatgggtgccatggacaaagctcagaagactgacctggctctcccacctgctttagctcttcaaactgagcaccccaggggccaacaacactttaaccctgagcctgctcctgtgcactgctctcatgagaccactgaccctgatcacaatgctgactttgctcttgactcttgtcttcttgctcaaggcaagggtgacaggctcagtattgatcctgaatctgctcctctttgtggcccctgtgacatagaggacccttcaactgaccactccagccaaggcataaacaccaacaccaggcctgctcctgttcgtggcagaggtgataccactgatcatgataatggcacagatctggcttctacccttcctgttgttgttgattaaggagatggttgatacaccaaattctacaagggtggtctgaggaatctaaccaagaagatttttaccagtaagaaaactgatgatcaggttaagttaccagacaaagaatggtttaaaatagaagataatttctgtcctagaaaactaaattttcttttggtggtaatacttatggttaataaattccatgcttcatatagggctatttaaactttgtctggtaccagaaaaaagtctctgttccccaataatattgaaaatacaccatataaaaataaaaagtcaattatcccccaaaacataatcaagtaatgttggttggctcatgattgtctcctattctggaatgaggatattgttgtctttccccatgatttctgagttttcagagtagctaagcatatgcagtgatttattactgttaaatatcaatcgatgtcta

SEQ ID NO: 5162 - DNA, 1000 bp, mus musculus
acatttcaaattatatcccccttctaggttacccctccacaaactacccatcccatccctcctcccctctcccctttgccctctataagggtgctcctctacccactcaccccctcagcgctctagcatcctcctatactagggcatcaagcctccacaggactaagggcctcccctcccattgatgtcagataagaccatcttttgctatatatgtatctagagccatggctccctccacgtatagtctttggatggtggtttagtcccggggagctctgggtggtccagttagctgatattgttcttcctagggggttgcaatccccttcagctcctttagttattcccttagctcttccattggggtccttgggctcagtccaatggctgactgtatctgcatttgtattggtcaggtgctggtagaacctttcagggaacagccataccaggcttttgttagcaagcacttgttggtgtcagcaatagtgtgggggtttggtgcctgcagatgggatagatccctaggttgggtggtctctggttggcctttccttcagtctctgttccactttttgtccctgtcttttctttgaacaggaacatttctggattaaaatttttttttttttttttaaagatttatttatttattatatgtaagtacactgtagctgtcttcagacactccagaagagggagtcagatcttgttacggatggttgtgagccaccatgtggttgctgggatttgaactctggaccttcggaagagcagtcgggtgctctaacccactgagccatctcaccagcccatggattaaaatttttgagatgtgtgggtggccccatctctcaactggatggggaggggcatgcctatctactggaagtggtctctacaggttgtagtttcccttttttgtgtttttaggctaaagtcatccctcttgggtcctgggagcctcttgcttccctggagtctggaactttctagt

SEQ ID NO: 5163 - DNA, 1200 bp, mus musculus
caaataaagacattaggcaattatgatataaaataagggatacctttgttatagaaagttagaaggaattttgaaattttccggtgagtaacttatctaagaatttcatgttgactttgttttaggcctaaattcagccataggtaaagttactagattgagatacatcatctcttctaagcgtagtatgatctatttctaatttaagcttgaattttgctgcctcagtctgcttggatcagaatgctgggaaggagcattggcatcctgaaggaaagcatggggaagacagacagacaggaccagcagcactctctccattttcattctcatcttctttctctttgctacagggcagccacataatccccaatggagaatagtacagaggtgactgagttcattctcacagggttaacagataacccagagctccagataccactcttcattgtcttccttctcatctatctcagcactgtgcttgggaacctgggaatggtagggttgatcctgctggactcacatctccacactcccatgtaccttttcctcagtcatctatctctggtggactttggttattcttcagctgtcactcccaaagtaatgccaggtctcctttcaatagacaaaaccataacacacaatgcttgtggcacccaattcttcttctttgtaagctttataactacagaaagcttcctcttggctgccatggcttatgaccgctatgcagcagtatgtaagccactgcagtacaccaccaccatgactacaaacacttgtgcttgtctgaccataggttcctatgtctgtggcgtcctgaattcctctatccacactgggaacattttcaggctttctttctgcaagttcaatgtgatagaccactttttctgtgatgcaccacctctcctggccctatcatgttcagacacttctgtcagtgagatggtgattttatttgtggtgggtttcaatgatatcttctctattgtggtcatcccgatatcctatctgtttatattcatcactattctgaggatgcgttcatctgaaggacgccagaaggccttttccacatgtgcttcccacctcacagtagtcttcatcttttatggatcaggcatcttcatgtacttgcagcctagttccagtcacaccatgggcactgacaagatggcatctgtgttctat

SEQ ID NO: 5164 - DNA, 1000 bp, mus musculus
atggtgtgactggaactgggctgtaagtacatgaagatgacagtcccatagaagatggagactgcagtgaggtgggaagcacaggtagaaaaggccttgtggcgtccttcagatgaacgcatcctcagaatagtgatgaaaataagcagataggagatcgtaatgactacaatagagaaaagagcattaaaacccacaacaaagaaaatcacagtctcactgatataggtgtctgagcacgatagggccaggagaggtggtgcatcacagaaaaagtggtctatcacattgaacttgcagaaggaaagcctgaaaatgttcccagtgtggatagaggaattcaggaagccacagacataggaacctatggtcagacaagcacaagtatttgtagtcatggtggtggtgtaatgcagtggcttacatactgctgcatagcggtcataagccatggcagccaagagaaagctttctgtggttataaagcccacgaagaagaagaattgggtgccacaagtgttatgggatatggttttgtctattgaaaggagacctgacattactttgggagtgacagctgaagaataaccaaagtccaccagagatagatgactgaggaaaaggtacatgggagtgtggagatgtgagtccagcaggatcaaccctaccattcccaggttcccaagcacagtgctgagatagatgagaaggaagacaatgaagagtggtatctggagctttgggtcatctgttaatcctgcgagaatgaactcagtcacctctgtactattctccattggggattatggggctgccctgtatcaaagagaaaggagatgagaatgaggatggaaagagtgctgctggtcctgtctgtctgtcctctgcatgctttccttcaggatgcaatgttcctttccagcattctgatccaagcaggctgaggcagcaaaattcaagcttaaattagaagtagatcatactttgcttagaagagatg

SEQ ID NO: 5165 - DNA, 1200 bp, mus musculus
attgaattgtttctaatgtgcctttctccaggtcacagagttattaccttgatcctggtattgaacactcacaatatcaatgtagaagacaatcctatgtggtttattagttgactgaaaacatcaggaacaattggtgacaatatgggtcagtgtggatatctataaaaacaccaatcagttcaagggcttacaggacaggtggcttgtttgttaagatttgctttttgaaggtttcttattgaccagatgtgttatttacttatctagagatgttaacaaataaaaacaccaaagatctatgttgagctaaaattgagagatgcaattgggagaattggatgcgggatctttctttttattggttattttatttatttacatttcaaatgttgttgtccttccatctgtaacaccccatccaattccccctcccctttgcctctataagagtcctgccccccaataaccccatttccacatcactggtctagtgtccccttatgctggggtagcaagtctccacaggaccaagggtctctcttcctattaatgccagataaggcagtcctctgctacaaatgcaggtggagccattgatacctccatgtatacaacttgtttggtggtttagtccatgggagttttggatagtcaggttagtcgatattgttgttcttccaatggggttgtaatcccattcagtttttttagtttttctcctaattcttccattgggctccctgggatgagtctgatggttggctgttagtgtatacatctgtattggtcagctgctggcattgcctctcaggagacagctataacagtcttctgtcagcaagcacgtcttggggtttgatgtctgcaggtgggatggatcccaaagtggggcagtctctggatggtcttttcttcagtctctgctccacttttttgtccctgtcttttctttggacaggaacaattctgggtcaaaaattttagataagtggatggttctatcactcaactaggagctatgcatatctaccaggggtagtctcctcaggttctatatcccctttgttgtgtatttccacaaaattcatacctgttgggttctgggagcctctttcttgaggagataggaatacttaacctaattttaacattttataatatgtattatgtagagaaactttgcaattgtacctcttg

SEQ ID NO: 5166 - DNA, 1600 bp, mus musculus
agacaaactaacatgaagataaaagatccctacaagcaggaacaagaataaagcaccaaattattcacatactcaggatttccataagggctttccataattgaaaactgtagaatcaacacagaggacataatagaggccttttgattactgcttcagtctctgtgagttaagcaaagcttgatttgctcagttggtgtagaggatattgctctggtgttcttgttcaacctctgtgcttttaactccttttgcatatccattcaagggtttcttgaactgagtgaaggaatttgatggagacatctcatttagagttataggctccacagtctctctgtgtgtataatgtatatctatgggcctctgtttttgtccctaactgttgctgtagaaagcctctcttgtaatggctgaataaggtgtatctttatgaatatttcagaatattactgtattattaagagttgttttatgattactttagtttttagatgtgtactatctgcttttaccttaggtctctgggatatctagtttcttgttattggtaaacaaagcagtgttcattaggggttcaccagtataggggaatggcagggtgaggaggcaggtgtgggagggtgggtgggtgagtgagcaccctcataggaacagaggaagggatagggggttaccagaggggaaatcaggagggagataacatatgaaatgtaaataaataaaatatccaataaaaattcagacattagttgtgtatgtttgtgagttgtgcatttctatgttgatagttttatttaatagctgaaatttcatatactgatataatttatgatgtgcatatccatctaccactacctcactccacctatctaactcttcccagtgcttctcatcttgtctctcaacttcatgtcctccctgtcattacccacccccccgagttcaattagaaattcccataggcacatgattgcccacagttgtaattgattgctactttctgagaaaaaagaagaggagctacaggtattcgcatgaatgaaatctccaggggtatctatgtcatttttattttctggttcttcatgcattagctttttaaataataacatgattttaaattatgtttcagaagcattcatccatgaactgagtggtgttcactgttatcacttttatgaatacaatttggctgaagaccttctttcaggtttcatgcatggttcagaaaaatcacttaaaggtaaaatgctatattttaatttgtatgatgtcatgaagacctttcttatttttctcaggatgcaagggataaaatttgtgagatgtacaatcttctcaattttttttgaaggtaaggtaaatatgtggcccatccttgaacaagaaaaatgggtacaggttcagaagtcaaagcttattacctctatttcctctgttttccatatttaggaaacatgacattgtcagtccactccccgacaaagaactgtgtaaccagcattctgaggctgacttgattatgtcacattcacactacaggatttactgtcctcttcaaaatatctggtggctttatatgtatatgaaataaaca

SEQ ID NO: 5167 - DNA, 1200 bp, mus musculus
attttttcagaaatatcatggaaaatgacttatttgactttatttcaatgacaatgaaattgttcaaattatttaaaacaataaagcgatgtttcttagaaagaatcatcttgttaaagacatgcatttttgtctcaagagacagactcagaagaaaaattttgggttttctgtgctggttgacaaatttttccaacatgactatacacatttcctacataaataggcaataggtatttaattataaagtatgtatatacccagcctgctccttctgccaaaggagatcatcagcttgtctgctcctctgaagaccccacagtctgaaggccttccaggacatcttctgcaggcctggcaacaggtaagggaccctccaaaataattgcagcacatgggaaacacaaggagccaaatggacttcagaccaatccccacaccctcttctcctcaaactccacccctttcaagcctgggccttcctccagggaagattctcaccttctatgctactctaaagaccacacagtctgaaggccacccaacagatctgctgcatgcaggacaacaaatcagcaacttgtctgaatacacgacattctgaaacctcctaggaaagctgctgtagctaaaccaacagatcaccatcatgcatgccccactgaagacatcagagtttgaagatctcctaagaggtctgctacagtcagggacacaggccttccaggagacctgcagcaactcagggacacaggaggcaggtgtcagtcagagacacccaagccagttaactaagagataactagaaattgagatagaagctcaagaccataagaagcagcagaagccaatatacattgacatcatcagaaactagttctccaaccacaagaagccctgtatacaccaacacaactgaaaaccaggatactgacctaaaattctatctcatgaagatgatagatatctttatgcaggatataaataactcactgaaagaaacacaggaaaacgctggtaaacagctagaaacacttaaagaggaaacaaattaatcccttaaagaaaaaaaaacaggaaaacacaatcaattgaaggaattgaacaaatcagtctaatacctaaatatgggagtagaagcaataaaggaaaaagaaatggaggcaaccctggaaaccaaaaccctagaaaagatgtcag

SEQ ID NO: 5168 - DNA, 1000 bp, mus musculus
accatggatctgggcctatgtagtagttgagctgattaacttgccagctctcctatactcataccaccagggtgtgaaccagcccttctctgctcatgccattggtgctagatcacacaagtgccagctctactgtgcaaggcccgctctcctgaatattgctactgttgagtggtggggccagatctcctattatgccaggttaacggtggggaccagttctacatagttctcacacatcaagatggcctttagaggaagataagatcaagaacttatctggactttggtggtaacaaactcttgcatggccataaactaagacatggccctcagcatctggacaggacaggaactcaccttggccttaggtggaatcacctgttcctcacatcaagttgttcctcactacccttgagtgttcagttctgcttatcttcattgggcatacacccttctgcttctctttctctcccatttctccaccacttatttgttcctcttaatggagcccagagacccttcagcagttggctcaagagtgctacaccctgcccatgcagtatagcactggcaggggtcatctctgtcatggtttagtatggtctaatcaccaaagcttgcactgtgctggacctttcctcaactccggctctgggtcattgtagtaagccggcccgcggcctgcttgaaccaggtattcctggaaggcaggctggggctgaaagagacttagactgcaagacaagaatgatgaagccaagacaaatttttctctattcaaggcccacaagtttactaagagactgtgcttataagggagaaggcccatcctgctgccagtccatcctacttggtcaccaggctgttgcttgttcaggaatgtctcaagaagacaggttcagcctctctcctcaggtagcagtatctcagtgcagttgacacttcaaaggaagccagccaagtcggaaagctgcaaggcaggtggccccacctcagt

SEQ ID NO: 5169 - DNA, 1600 bp, mus musculus
caattttcccgattttgttagccttttcatgctgtcatttacaactattgcagacttgcaccatatccttaagtacccttctcctgttgatattttttcatattttgctccattccactgaaaattatagcaaatttttctatatatactttatagacagatgatttgaaaaatgaaattcctcaagacaatattcctgatcaaagggtatgcttttcttacagtccttcactgtacagtatcatgatgtactacaataaaattatatgacaattgcactcagtgtggatatttgagaatagacctgtctctcaaattcaaatgcaacaagcagttatcattcattcattatagtcaatttggtttcagaaagttgtttctcattcgtctgtttatttgaatactaatgaaaatggattttatgtgtttgtttacctttaagattcttaaaatctttaaatatttctcaataattttttttgctatttatttatttactcatttattttgcactttagattttaccctacccctggtctaccctctgactgttctacatcccatatctcctaatcacgcccttgtttccatgaggatgttcccaccactcagcctccacccaatcagacctctaaattccctggggccttcagtctcttaagggttaggtgcatgttctctgattgaacccagaactggcagtcctctgctgtatatgtgttgggggcctcatatcagctgctgtgtgctggctggttggtgaccccgtgtttgagagatcttgggggtccagtctaattgagactgctggtactcctgcagggtcaccctcctcttcagcttctttcagccttccctgattcaaccacagggggcagcagcttctgtccatttattgggtgcaaatatatgcatctgactctttcagctgcttgttgggtcttttggagaaaagtcatgataggtcccattttatgaggactccatagcctcagcaatagtgttaggccttgggacctcccattgagctggatcccactttgggcctgtcgctggacttcttttccttgggctcttctccttttccatcactgcagttctttcagataagaacaattatgggtcagagttttgactgtgggatggcaaccccctccctcacttgatgccctgtctccctactgtcaggcatttcatctaagatccctccctttgagtgctaagagtctctcacttccaaggtctctgttatttttgctgaattataaaatgtcattgttactaagtttgcataatgtgttctttaatcaaagaaattttacattttctgtctcactaccccccccaaaaaaaccataaattctaccagtatattatttggttaaatacatctatgtaccatgagatcttaaaaattatgtgaaccagattttagcttttctttattttcaacttaaattttcccataaggatgaatttttatgtatatgatttgagaataactacaaatgttaggatctcaagcctttgtaattgtgttgaaatagtaatggctggtaattgatatgaaattattggctgttctgcagtgctgttctaa

SEQ ID NO: 5170 - DNA, 1000 bp, mus musculus
acagaactgagggtgggaaaaagaagcagcagtttaccctgaaaggatggctcaggaataaatgaagttccttggcctactctagagctgtgattgtgggtatgcagatggtggtgagcattggggaaaggctacccccctcaaaaaaaagcaacttattctgcaaaggtgactcatgaacaaatagagttcactgaccagatctggagctatgattccctagcccggtccttattcctaacttttctctttttttaattggatattttatttatttatatttcaaatgttattccccttcctggtttcccttccaaaaagcctttatcacaccccctttcacctgcttctatgagggtcctcacccacccacccactcccacctcactgccctagcatttccctacactggggcatcaagccttcacagaatctagagcctccccttccatcgatgccagataagtctatcctctgctacatatgcagctggagccataggaccctcttgtgtacttgtggttggtggtttagtccctgggagctctgggtgcagtggggggaggggggcctggttggttgatatcatagttcttcctatggggttgcaaaccccttcagctccttcagtccttcccctaattcctcagttggggttcccctgcttaatttgatgattggctgcaagctttcatatctgtaaggctctgacagagcctgtcaggacacatccgtatcaggctcctgtcagcaagcacttcttggtatcagcagtagtgactgggtttggtgactgtatatgggataaatccccaggtgaggcagtctctgaatggcctttccttcagtctctgttccactctttgtccctgtatttcctttagaggggaacaatttttgagaagggtgggtggccccatccctcaaccaggggccatgcttaacctctggatatggtctctacagctttttgctcccctttgttgggtatttccactaa

SEQ ID NO: 5171 - DNA, 1000 bp, mus musculus
gctattaggaatcaaggaggaagaaacaattttaagaaaatacttcaaggcatgtagtttcctattgagttatggctttcccagataaataattcttttgaccaagttctcaagtgtaagcctgacacaaataaacattacctctcaagcatctggctcagataaatatacatattccctcatttctactctaattccatgttgatcacatgtacaaacagtcgtcacataataagcctgggggacatgccaagaccgaaagggccaacagctagcatggaaggatgagtcgacaacagttggagatgaggaaaaaaggaactactcagtgaaggctgatctgcttctccgcatgaagaatggccagtgtgcccaggatgacaagaagaatcaaatcctaagaagcttttaaaactgaagcaagacttggcagtcattgaattcaattatcatctacttcagcagagggaaaatctcaactctgaagaagtcatggagctcagccaaaattacacaactgctaaatgggaaagccaaaaggttctgcttccattgaagttatcctactgttctcccaacttcttcacaaagaggattgaaactgatccaatccattcaggtttagcatggagactgatggtaatagttagggaaggaggagaaacgtggaagacagcatctacctgggaaactgatttgtgcagaagcatttgatgacattaagtaccctatgatacttaggatggaaaaatggacaagacaagagctaaacaaacactcaaacagaaacaaaacagagggctggcgctcaggaagggatgacctgtttgtggagaaagtacaaatgtggcctagaggcacgagcactgaatgtctactgtctgtgtgtaggaactacaggctgttggctaagacatgaatgtcattgacagggttcattgaaggttgtcatgtgggcagagggacttcacaaacattttaacctggatgtttcctgtac

SEQ ID NO: 5172 - DNA, 1000 bp, mus musculus
tagctctactatagtttctctttcctagatacttgtctttcagaacaaggttgcttctctctgggtagcttcaattggactcttgacagtttatgtaatattcctatttgatatttgttgggcagtgggcgtaggggaataaagggagtgggagaaaacccacattctgccagagttccggtgctctgctgcacgcaccccgggtgggtttggcagtgggaagccacagaatcccagctgggaggtgggagtggggtgtgtgtggacaaggggcagtcctaggttacagattctcagtctagggtatcccagacattgctggtcactgtggaagagctgagaacaaaatgggggcccaagggccaaagggaagagatggcagggagagagggggcgctgggtggttcccacacaggcaagagtccttggtctggtctgtggttggagcccaagaaggccttctggtgggaggttaggcatggctcgttaggggaaagcctatcccattgttcaatcacagagggccttgatgagcagagacagtctggttttagagctttattgtagaaaggcagagagaaagagaaggtagaaagagggagagaggccagccatgccacatggagagaagggggaagggagagagagagaaggagggttagagatgagagtaagaaaggtaagagcttaaagagagagaggaggggccaagcagcccctttatagtgggctctgctatcttggggttcccaggtagctgtggggaggagcacacctggctatagtcaggtaactgtggtggtggggtctagccagaataccagaagcttggggcattgtcttatagtcacaggattacggagttgggggctctggtgtcaggcacctgtctctgggaacatggctcactgttccatcccttgtagagttttctactgggtcgccgaatcaagcctcattcaaccaaaataggctgcttttcacggccccacagatattg

SEQ ID NO: 5173 - DNA, 1000 bp, mus musculus
gttgctgcccagtacaggcagtgatctgcacacatataaataaaactacctccttagaaagtgctaggcagaaaaatcacagaacacagaagaaagctgaggttcagagacggctaagacccagggcaagctatttaacccctctatctatcctcagcgatcgctgttaaatggagcagaaaattcttgccacacaatgactttgaagaatatagagttggtagcagggttactttctgtctttgtaactttgaagaaggtcatctgacctctgtaaccgtcagtttcttcactccccccccacccccagactggtaagcacactactatctttgccactgtgctgtggggccatgttgtaactggcaaccatgtagaaaacaccccgagtatttagaaagaaagacttcacgttcattataggtcatatctactcatttaaaaccccaggcagtttgaagagacagacagacagacagatgacagacagacagacagacagacagacagacagacagacagggacagagaatgtttttgtttattccatcctgtttggagttccgacaagtcctgggctatgtacgaacccatgataggatcaaagtgtccttctctctttcatagtcacctcctttttctcttgagaaactggtggttacaaaagacatttaagaagataccagactctctctgtctcggcccaagcagtcaccaaaatggaaatcacaacggtggctcgccagggatccagagaggaccggctcaatatgaatgcaaataatccacgtttcaagcaggattatggatataaatgaaagacgaaaagcacatcagggtaccaatttgtcacacattttcacacaaaagctcagccctgtctctctcctccttttggctcaccctgcttcccactgcactttgtagatgaatgtgtgtaatactgagaaagataaagaaggacagcgagacagacaagcaggcaggcaggcaggcagac

SEQ ID NO: 5174 - DNA, 1400 bp, mus musculus
tctatctcatcagttccaaagcaagaatctggagaggtgattgctcacaatagaaaccaaggccttctgcatactaggcaggcactttacctaagccataccaccgacgctgccataccctttttaaagcaatagaaatactccttaaaaagtgcacatgtgctggatgatagtgacacgggcctttaatcccagaaaaaccaatagataaatagatagatagatagatagatagatagatagatagatagatagataaaaattaaatacacatgtatacaaaatatatgcacacatctatataaccatatgggcatgccgagaaggccccacatctcactgcagcaggaaacacagtttaaatctctccagttagcatctcgtcccaggcagtaccctcatgctcagtctctctcagggactgctgtgacatgagcaggataccaactcctgtgtgtaatggcaagccattcacgtgtcttaggatcatgattgcagtgagaagcccaaagtgtgcacttcacccattagtgggcggtgttctctcctctccttacctcggcacaatccctgaaaggcagagccatgaacaccagcagagagtgaagctgcctttgctgcacacacagtttgcaggaaagatgaagcagtccccaggggatgcgcagaagagagggcctgggtgggtagaacagaattccaactggtttcaccaatcacaggtgacttgaatctcaccaggagggagggttgaggtctgatgagaaaaggcattcattccttcatgttatgtctgctcaggaaggagagacctcaggcaagcgacacaggaaggaagtagagtctggtgcacagtcagccaacaggaaggtgagtaagaggtaatgcagtttatcctcatgttgtgcaacttggcttgcttctcagcacactggctgcatgtagtagaaggatgacaaatggtctccctctgtgtctctgtctgtctctctgtctctctgtctctctctctctctctctcacacacacacacacacacacacacacacacacacacacacacacacacacacactaaatccttactaaacatgcacacctgagaagcaggctgcagtttgtaactctgctctgccccaggctcctccaggctcccttacctataaaatgaggaatggctgctgggcccacatttacctttaatcccagcacagaagaggccgaggcaggaggatgtctgtgaattcaaggcctgtctggtctacacagaccattccagtaataatggaagtgttcagaccttttcctaaatggaaggatattaaggaagaatgaagacactactctgaaaattttctttccaagcagcaagttcagagaaaccataaaataaactttgt

SEQ ID NO: 5175 - DNA, 1400 bp, mus musculus; identical to SEQ ID NO: 5174

SEQ ID NO: 5176 - DNA, 1400 bp, mus musculus; identical to SEQ ID NO: 5174

SEQ ID NO: 5177 - DNA, 1000 bp, mus musculus
gttggaattttgatggggattgcattgaatctgtagattgcttttggcaagatagccatttttacaatgttgatcctgccaatccatgagcatgggagatctttccatcttctgagatcttctttaatttctttcttcagagacttgaagtttttatcatacagatctttcacttcctgttgggagccgccctcacattcgccgttgcaagatggcgctgacatcctctgttctaagtggtaaacaaataatctgcgcatgtgccaagggtagttctccactccatgtgctctgccttccccgtgacgacaactcggccgatgggctgcagccaatcagggagtgacacgtcctaggcgtaggataattctccttaaaagggacggggttttgccattttctctctcttgcattcttgcgctctggctcctaaagatgtaagcaataaagctctctgactcctaaagatgtaagcaatagagctcttgctctcttgctctctggctcctaaagatgtaagcaataaagctcttgctcttgcactcttgcactcttgcactcttgcactcttgcactcttgcactcttgcactcttgcactcttgcactcttgctctcttgctctcttgctctcttgctctcttgctctctggctcctgaagatgtaagcaataaagctttgccgcagaagattccggtttgttgcgtctttcctggccggtcgcgaaagagtgtaagaacttccttacttagagtcacgacaagatattttatattatttgtgactattgagaagggtgttgttttcctaatttctttctcagcctgtttattctttgtgtagagaaaggccattgacttgtttgagttaattttatatccagctacttcaccgaagctgtttatcaggtttaggagttctctggtagaatttttagggtcacttatatatactattaaatcattgcaaaaagtgatattttgacttcctcttttccaat

SEQ ID NO: 5178 - DNA, 1200 bp, mus musculus
aatgtttatatttatagtggtattataataataatttcatcataaaatattcttgttcacataaaatagactgtgaataattttattagaatgattatggaactgcataattataggctttatgctctgctttggctccaggccttgaggacattttgttggtgtatcaattttgattaatttcaatggtctttagtcacaggacacctttctcagtctcaagcatagatgtgattttacttagggttgtatgtgaatctgttgtctgtaatgttggttggcactcctcaggtaaggcttgagaatgttaatgactggttgtgtcctaaaggaaaaagagctatggtacaatccagccttctagggtgaagagagcatttaggatgatggcaaccctaaaatgcttgaagaaaaaaaaagacgtagcggttctttatatttggtacttggttagtctataagcagagagtgtttatatagttagacattttggagggatgctggcaatactggcatctgtactggggatgagtgaaagatttcttctacttagcatagctaaagaggctgtgtcactagaaagtttatagcagagatatatagataccttggaatattataaaggcaagggaacaaaaagaaaacttcaaacttgagtctattgagtatgggaaaatcagtactgatgttcaagcttatgaatgcactgaagaaatggatgggcaggtctgatgaagatgcgtgggcagagaattctgttctaggttgggcattctctggaatgtctctaaagagcctttggggttccaggcctgcactgctctagctgtggcatctgagtagtgatctgctttctacctgggaaggcgacccctcaaggtacaggagcaaggattttcctgtagtcaaggagtgcttctgagatgccacaggtcctgggcaattacagcatcctctcttccagtggatgctgagagcaaatggacagaagaattccttgtattttaaactccttaaaatttgggggaagaaaatataaaggttgagattgctcacatgactataaaagtaaatctacctacttttatattcattactagatttattttactcacagaatcttatataatctgtttgtattttcaattctactttcttttaaacatagtttgacaactatgcacattaaaggaaagaaag

SEQ ID NO: 5179 - DNA, 1200 bp, mus musculus
tattccttcatctatgagatgtagcctacatgattttttctatgaattcatggatttagtttggaatcattttattaagtatttttacattatgcccatatgggaacttggtctgtaattctctttatttgttgaattttatattgcttgcatatcaggattaactgatatgcatatcagttatatgcataaaacgaattgggaaatgttcctttgtttttattttgtgaaataatttgaggagtattggcagtaactcttttttgaaagtctggtagaggctggggcagactcctagctggtctgcttctgtgaagacaccatatcctgacccatcctagagaatccactgtactcagagaagttgacactataccctgagccattccagaagatcctctccagtaagagcagttgggcaactgacaccacagtctgaggcaggccaggagatctgctgcacacagggcaactgagcaactgatcaccagcttgtctgtttccctgaagacaccacagcttgaaggcatcccaggagctcttctgtacacagggcagacaccacaatctaaagacctctcaggggctttgtggcatgctgggcaactgactggagagcctgaaagcctgctgggagttctcttgcacaagaaaacataaaccacagtttatagggcccctggagaatatcttcacacaggacaacagcttaatggctcttcttaagacccaacagtttgaaagcctcccaggagatctactgcagccagaataacagatcagtagcttctctgcccttcttaagagaccccagttggaaggctccacaggtggtctgatacagccagggtctacagggctatcaggagacccgaagcaacccaaggaaaaaagagtcatgctccagacacagtctcctagaccagagtcatctaaaacccacatgagggacaagctccagttaagagagagcaagaccaactaacaccagagataaccatatggtgagaggcaagtgcaagacgataagcaacagaagccaatatatatgggcatcatccgaatccagttctcccactacagcaagccccaaatacaccaacaaacctgaaaatcaggaagctgacctaaaatcctatctcatgatgataataaagtccaataccagttcatgttctcctccccccaactccctcccac

SEQ ID NO: 5180 - DNA, 1600 bp, mus musculus
gttcacattcctaaatttttcatttccagaattcccttagtttgtgttttctttattgtttctatttgtgttttcagaccttaaacagttttgtatgtttccttcaacagtttgttgttcttggtttgccttcatggatttattaatttctttccattgtttttgtgtcttcctgtctttctttgaaagccttatttcccctagttgctggagatttcctggatttcattatatgatcgtttgcttcctttttaataatctttatcatcttcatacagttaattttaatatctttttcttgtattgcaactattttaaaatattcagggcctgctgtagtaggctaggtaggctctggaggaaaaggtggcctcatgtgctattgattttgtttttatgttgctgtttagggatcttaatttaaggtcattataggtctaggtgttgatttctgattttatctttgttcggccagtgttttgttctttgttttctgatttctccttagatttttcagacagtgtgatagcagtctattgcctattttattgacattaacagtgttcatgagtatagcttttggtttagaagctggggaaaatggaagccagatggagatgatccatttagcattaagggcagccctgagaattgagtctgtggaaacagaaagagtagagactatctgccatcaacctacctggtcattgtcctctgtggttgaacaaggggagcctgcccaagttggggactggcaaacagtgatggaggagaaggggaattcaggtgaaaatggtctgtgggatccatatgacagaagtgaggggaggctgttgttcacatactgttgcagtgctatgggtgactatcttagtcaatgctctattcctgtgaagagacaccatgaccatggcaatttttataaattaagacatttacttaggacttgctaacagtcagtttcagaggtttaatttaccgtgtcaagataaggaacatggtggcatgcaggcagctatgggacaggagattagcaaagagttctatatccagacccataagaagcaggaagagagagctattgggattggtttgggcttttgaaacctcagagcccattcccagtgacactcttcctccaacaaggccaaacctcccatttttttcaaatcctgccattataagtgattaaacattcaaataaatgagcgtatgaaagccactcttaatcaaaccatcacaatggcatttttaatgtttcaaaaaaaaatcttgtcaacatagatttccatgtacaagaaaaatgcagtaaaacatagtagcaaataaaaggcttatcaggaagaggacaacttcttgtatttaagttagacaccttcttttctacattagccattaagaaaatgaaaagataatcccaacactggcaatatactgcctcatgcttatactgacagaggatttatatttacacagacacacacacacacacacacacagacacacagacacacacacagatatatatatatatatatatatacacatccctggctgctcaattatgaggaggttaatcacttgatagtataatcaacaa

SEQ ID NO: 5181 - DNA, 1000 bp, mus musculus
ggccatcactgcaaaaagaggcccattggacacgcaaactgtatatcccccagtacaggggaacgccagggccaaaaaaaatgggaatgggtgggtagggaagtggggggagggtatgggggacttttgggatagcattggaaatgtaaatgacctaaatacctaataaaaaatgaaaaaaaaagaacaagtgctccattatgttcatagcagctctattagtaatagccagaaactggaaacaacccaaatgcccctcaactgaagaatggatacagaaaatgtggttcatttacacaatggaatactattcagctactaaaaacaaggatatcatgaattttgtaggcaaatggatggaactacgaaatatcatcctgagtgaggtaactcagacccaaaaggatattcatgacaggaacctagcataactgtcctctgagaggctccacccagtagctgactgaatcagacacagagactcacagccaaacattggatagagctcagggactctaatggaagagttgggagaaggagtgaggggccccaaggggataggaattccacaagaaaccaacagagtcaactaacctggacccttagtggctctcagagactgaaccaccaactaaagaacatacacaggctggacctacccccactccaatcccctgcccccgcacatatatagcagaagtgcagctagatgatcatgtgggttccccaacaaccagagtggaggttgctcctaaagctgttgtttgtctgtggaatccattctcctaactggactgctttgtctggcctcagtgggagaggatgtgcctagccctgaataaactttatgtaacagggtgtgtgggggagtactcagggggcctccacctgctcagagaagaaagcagagggggggggatggggagagagactgtgtgagtgggagataggagtggcaatcactttgtaaagtgaataataaatgaatggaaataagtag

SEQ ID NO: 5182 - DNA, 1200 bp, mus musculus
aagtttctacaatagctcaatgtgtaggatggccatttttaacatgggataaagttatgaaccacagccatgtcagtgctagttgatagcattctagctaaggtttatattatttatggctttcataaatttctcacaagaataggacagtttgtagcctttttgatttccttcagtgtctctcacctcacagtgcatagtagttcaaacagagtagatgcatgtcccctgagatgctatggccacagcctaagtaatacagatgcagatgctcaaagccaactaacagagtgagcatggggaccccaatggaggagttaggggaaggacggaaggagctgaacggtttgcaatcccataggaagaacaacagtatcaaccaattagaaccccagagctccagggactaaacaccaaccatagcatatacatggagggacccatggctgcagctgcatatgtagcagaggatggccttatttggcatcaatagtatggaaggcccttggtcctctggaggctccatgcccctgtgtgggggaatgatacggtggtgaggcaagagtgggtaggtgggtgagggagcactctcatagaagcagggggagggggagaggttagggggtgtttataaggggaaaccatgaaggaagataacatataaaatgtaaataaataaaataaccaataataaaaaaactctatcaaaaagagaacatatgattttttgataatttagtttcaattagtagtatttattacatggaaagaaggcagtgtattgccttttcctctgagatcatgagcttgtaagaacaagaaatagatatacagaaaagcaatgatgcataacgaggcaatgcagtcctagatccaagatcagccagagaatatgtgcttgtgctacatagataaagggcatgtgaatacccagcacttacacacatccagctgaagccagcaatgcccaaggagatgccagagatggcctctgaaattcaaaatggttgaagatttagaaatgctataatttgtatgtggtgctctgctgcatcaagatctaccagcacataggataatcttgactcacctgtagtgtttgaactacaacttctgatcacacttgaaataaatctaagctaggcagatataaggatgatctctatagcttaactccaaatggactgaagacttcactgg

SEQ ID NO: 5183 - DNA, 1400 bp, mus musculus
aggaagaacaggacaggacaagacaggacaggctaggctaggcaaggcaaagataggctaggttaggcaaggctaggctagaacagaaaagggccagagagagaagggtactactgaaaagaaccagagtagaacagaatatctgagaacagtgaagcatcattctgagttggaatgtgtgtgtgtgtgtataatttggaaaaattaatagagatgataattctaacaactgcatgtaaatttaaaattaaattcaaatatcagtataggtcatggatgcccacaaaagataaaagaaataaagaaataaatacacaaaatattacatatgggcagatcttacttaatctttagacaaaaaaaaaaaaaaccaccaaaattattttcattaatatttaaatttcttaaagtcattgtttaaagaatgcttgcatgattactgtgtttataccatccttaccctccgctcttccatctccagttcattctgtactactccttcaaaagtcataatgtctttttaaacattactgttgtgcacacgcacacacaacctgctcagtctacatatggttgttcctaggatagtgtttaggactgtctactggggatttgataatctatcaggcaaccaaagactgaagaacactaatttaactgattctcctctcagcagccattatctggaattcttccttaaagtctaggatcatgttaaagttccctcgtctgtgctggcatgactgctggcattttcagtaggcaagtcttattgagattccatgggaaccgcagtccctctctgtctagaagactctgtctcacaacaggcttcatagcccctggcctcttataatctttcaagtccttcttccatgattctccttaaatgtagaagatgtgtttcttcatactggatgggccttaagtccaactaaacatcatgttaacatagatgaacttgcaccactaatgcactataaagatattttgccacactggttattgttgtgttttgcccttttagctatgtaggattattgattcttttcccttttttggtaacttgcattggagctttcaatactatggatacagtcctcagaaaacagccttccaggtccattccatttcaaatttacccaagttctgtgtcaaagtgtaaagtgtcttcaataataagttcttatcttcaagttctggaagacatccaagggtaatgtcaatattccatattgttttgcagtttcttagagccctgtgaccaaaaaaatcaaagggaagcccagcattggggtttttgttaggtattgcatgactcttgagaggaacattatcacccctttatgtgacacatgtcatacaattaaatgtgacacaactgcatttgaacatatgtg

SEQ ID NO: 5184 - DNA, 1000 bp, mus musculus
actgcatactatgttaaataaagctatccagtcatagtactgcatgctgttgtgtgtatgaaatacttatgatttatgagtacccagcatatgggatagtgactgccacagactggaggtcatgggaagtacaaagttatccacaattggcatgaagctccaattaagcaaagcaaagcagaccgtgtccctgctgtatggcatggggcctttagtccagaaaactgtattacaaaaatctcaaactctttaagaggctggttcacattttaccacagacaacaaagtatcaaagtacagctacttttgtttgtgcttctgtgtagactagcctgcttatggtgtgggacctggtggcaggtgtccattctcttcttttagacaggaaacagtgtagcaaactagttgacactcagaataagctacaagtgctcaaagggagcttggaatgtcgtgtctgttgattaaaaaataaaagtgccagtgttgggtttcagttaaataggtcccttggattcaaaatgcaagagggaaagatagaaaatgcagtcactggctcggaagatgaggggaaacgagtggcagtggaagtatgcagctgattgtagggtgttagaggaacatcagcacagacgttgatgctttttcctatgaaaaggattctctcatgatgctctgctcccaccacagacccatggatagcactcagctgcctatggtggagaaggcaaagcacttgaagagaaaattcaaaccaatgctgaagtaaggaagccctggaaacagtacactgggcatccttgaaccttgaaccttggttactgtagtaggaccacaaggcaacagctattagcgcatgtcaactcagatcataaggaatcacttccaaaaatattacaaattgttcttattgtttagtctcctccctcttatccaagtggtctcttcttctaaaggacatgaaagagactaatctcagcgagctccttagggaatttaa

SEQ ID NO: 5185 - DNA, 1000 bp, mus musculus
gtgttaacagtacattttaaagttatgaatgtcttctcgttcattttctgagtttcttccatttttaaaatttcaacaaacatgcagtatgtttgataaaatgggccattttaaagcatgtctaccctctagtctctttcacaacaaaccatgaaatcacagcaaacctgccagaatcaggcaggacacaggaaactgcaagtgttccctgggctggggccaaataggtcacaggatttgagctggttcttccttcaccttcttctccgaagaaacagctattctaggacagaagagtctaagggaccatggtgactgatgggaaatgactgatgggccgggctgggctagaggcaaaatctgatcattgaattctcaatttttatttcttttgaattgctgaatagtctctgtcttctcacagaaattgcagaaatataaactcagtggactccagccaatgtgaaagttgatgatcaattatagaggagagttttctttctttttttattaggtattttcctcatttacatttccactgctatcccaaaagtcccccataccctcccccccactcccccacccacccactcccacttcttggccctggtgttcccctgtactgaggcatataaagtttgcaagaccaatgggcatctctttccactgatggccgactaggccatcttctgatacatatgcagctagagacacgagctctggggtactggttagttcatattgttgttccacctatagggttgcagatccttttagctccttgggtactttctctagctcctccattgggagccctgtgatccatccaatagctgactgtgagcatccacttctgtgtttgctaggccccagcatagtctcacaagagacagctatatcagggtcctttcagcaaaatcttgcttgtgtatgcaatggtgtcagcatttggaggctgattatatagaggagagttttctaaggagatgattgtaacatc

SEQ ID NO: 5186 - DNA, 1000 bp, mus musculus; identical to SEQ ID NO: 5185

SEQ ID NO: 5187 - DNA, 1000 bp, mus musculus
gcttttacctgtttgcctgtgttttcctgtatttctttgatgcagttatttgtatcctcctcaaagatatctatcatctccattagatgggattttaggtcattatcttgcttttcaggcatgttagggtatctagagctgctgtggtgggagaactgggttctggtggtgccaaattgcattgggttctgtggtttatgatcttgcacttgttgcttgccatctggctatctctggagttagctggcctgggtttctctgactggagctggtttccttggaggcaggtagagctctgtgacatgggttagagctagtctcctgggagacaggcagtgctgtctctggttagggtgagccttctgtgtccctggttactgcacatctcctaggaggcagacaggctgtgttcctgtttactgtggccctcctgggtagcaaacaggctgtagagtgtgggagggtatcacacctgctgatctggcctgggtggggcaggagactggaaggaagatggttctcgggtgggtgggtaggtctcgtagcagctgggctctgtgggtgtcccatctggcatgaatatttgggtgagattctcatatgtgtccctggttactatggacctcctgagaagaacattggctgtagggtttgggagggtattgggcccactgatctggcctgggtggggaagcagactggaagcttgctgctgctttaaatgtttcttacatcagtacaaagtatcttttttttttttccattttttattaggtatttagctcatttacatttccaatgctataccaaaagacccccttacccacccacccccactcccctacccacccactccccccctttggccctggcgttcccctgtaccggggcacacaaacagtacaaagtatcttaaagatgtggagtaatcagagactgtctggcagggaaaagagaatatgagctaacactaaagagcctttaatatatgccagacaaa

SEQ ID NO: 5188 - DNA, 1000 bp, mus musculus; identical to SEQ ID NO: 5187

SEQ ID NO: 5189 - DNA, 1000 bp, mus musculus; identical to SEQ ID NO: 5187

SEQ ID NO: 5190 - DNA, 1200 bp, mus musculus
agcctgttactgggcagaacacagttcctccaatagggccacacccactccaacagggccacacctcttttttcttttcattaattattttactttatatctgatctaaacttcccctcccttttctccttccagccccccactctcctctcccctccccataccccctcttctcttcagagaaagggagtcctcccatggattttaaccttccttggcatatcatcaagttgcagtaggaccaggtgcatcttctattgaggctagacaaggcagttaggggaaaagtacccgaaggcagatggctgagtcagagacagctcctgttcctgctgtcaggggatctacatgaagaccaagctgcatgtctgttacatatgtgtagggggcataggtctgtcctgtgcatgctctctggttggtggttcagtctctgtgagcccctgtgggcccaggttagttgagtcttcaggttttcttgtgatgttcataacctctctggctccttcaatccttcttcctcctcttccgtaagattccctgagctccacctaatgtttggctgttgtcctttgcatccgtttccatcagttgctgggtaaagcctctctgatgatggctatgctagactcctgtctgcaagtacagcagagtactattaatagtaccagggatgggctctctttcatggcatgagtctcaagcttgaccagtcattggttggtcattccctcaatttctgcatctttatccctgcacatcttgtaggcaggacaaattctgtggctgggttggtgtactaactcctcccacttctgcctccattggaagccttgccaggttataggagggagtcatttcaggttccatattctccatttctaggagtgttatctagggtcaccctcatagattcctgggagtttccattgtcctaggtttctatctcatcccagagatgcccccaccccccaccaccaccaccatgccctgactgcactgattccggttctctagagggttcaagtctagggaagacagagagggagtggtggtgagagaggaccacacctcttaatagtgccactcactcatataggccaagtattcaaactcattaatttatggatgctattcctattcaaaccatcacaatcactataacaaaataaagcagactgctttaaaaagaaaggcatg

SEQ ID NO: 5191 - DNA, 1000 bp, mus musculus
taagtggtaacagggctgttgggaaatcaatagtattctaactgccctcattaaagagcagcttgcttaggacaaagaaataaccatctttaagggataaatcagctttttggtgggttcaaggcaaaggtgtgggcagtccacttggcatcagcgagccccgcccatcagtcatacagatcgtgcagtgctagatccagtgcactatagagcaggtggttttgcttgcgtggtagcaatgaccagaatgtaagtctctgcctacaaagacctgactgctgaccactcacaagcctaggtaaaggcagaaagaaaagtaagtgaaatgggtctgcttctagcaggacagcaggcaaagtccaatcagagttataaaaactggttaaaccttttctatcttttttttctttagtatcatgagatcattgagatcaaaagaaagaaaaggagactggagagataattcagtggttacgtgcactggctgtcctcatagaggacccagatttgatttctgacacctacacaacagctcataaccactggtaactccagcaccaaggcatcatctgatgccctttaatggttccaggcatgaacatggggcatagacaggcatgcagtcaaaacacccatacatataaaaataaagaaaacaggaagtcagtgggtagaagaaaggaagaggaagctcagaggagccagggaagacaagccatggtagcagctgggggctgctagctctagagacagacacccacctggattccgatatattcaagggcagtagtcaggacttgacctgtgtgtgcagagaaatgtaagtcttatatgtacaatatcaaccctatgagctaagcacctcacggttcttttccttcttctatgaactgatgagggagtccacacctctcctcccaggacagatgtctgaggttctgaggtcggcttctaaaagaagggatcataaggctgtagacatcccataagggatggacat

SEQ ID NO: 5192 - DNA, 1000 bp, mus musculus
catgttatcaggaatacatcattccgatgaccagtgcaatgtgtgcctgttcaaatcaagatgctaacacgtttcccatagtgcagtaaggtacctcacaccttaatcaataaaagcttccccctccttttttttttttttaatatgctgcctcttatcatctagagggggaaaaattgagctttctggcattctagactcagtgaacagcatcactaaattttgtgctacgacttttaacatgtcatataaattgttgataaaatctagctgcacagggctagaggacggcatattgttccactgaggatacattggataccacagtctatcttgagcagtcgcaaacaccccttactccagccaaggtgcctcaggcctccaagggcacctgcactcatatgctcatactccccactccaacccccatatacacgggattaagagtcacgtaaaactctagaggtggaagaagttccaacttgagaagctgagatcttccttttgcgcctgtccattggctcatatggaagccatctgtaataccgactttggtatcaggagtcgggttgctgtagccagactcgtcaggctcatgacctagtttttttccctgagaatcctagtaatcatcaaaagctactttctttctttttttttaaaatatttttattaggtattttcctcaattacatttccaatgctatcccaaaagtcccccataccctcgcccccactcccctacccacccactcccactttttggccctggtgttcccctgtactggggcatataaagtttgcaagtccaatgggcctctctttccagtgatggtcgattaggccatcttttgatacatatgcagctagagtcaagagctccagggtactggttagttcataatgttgttccacctatagggttgcaaaagctactttctataaagaaaaaggttaataaaagttgtaaacttgtggtagttaaaattttctgtcattt

SEQ ID NO: 5193 - DNA, 1000 bp, mus musculus; identical to SEQ ID NO: 5192

SEQ ID NO: 5194 - DNA, 1000 bp, mus musculus
ctagcctgtgtgaagccttaggttttctctctaggatgatggggggagggggataagggaggggagcctcgtttaataaactacggctctgttttgaatagactcattctgagatcgttttctgcagttttacctgggaggagagaggcctctgaacactactgcccaggctacagaaagcaggagtgtggacctgccgccgctcacagtgaattacgtcaggttagcacagacctgaagtgaaggacgccgtgtgaagagaatgcagtggagagcacgtgctcatattttattaagggaaatgaaaaatggtacaatacacagagagggagatttgacaatatttaagtacgatttcatagatacctatctgttaatacagaaatcccatttctaagactctcttctcaaagatattctagcgatctcagcacgctggtacaggtttgtaactagcactcgggtgactgaagcaagaagactgagagctcaaggctagcctgggctacatagagagtatgtatgtagcctgtttctgaaagaaaagaatcttggaaaaaacaaaaaacaaaataaaacaacaacaacaaaagcatctttaaaacaaaagaattcaatgaacaatgcttgagacaatgggagaattggggagggggtggggggagaacccccaaatctattcatcgtagatggctctgagtaactgtgacagtttgcgtatgcttggcccagggcatggcactattagacagtgtagccttgttggaataggtgtatcactgtgggcaaaggtttaagaccctcatcgtagcttcctggaatccggtattctgctagcagccttcagatgaagatgtagaactctcagctcctcctgcaccatgcctgcctggaggctgccctgctcccaccttgatgacaatggactgaacctctgaacctgtaggccagccccaattaaatgttgtccttatttaagagttgccttggtcatggtgtc

SEQ ID NO: 5195 - DNA, 1000 bp, mus musculus
aaggaggggtatatctgtctcagtctgagagtgcgtcatggcagcaagagctgaagtggcttgtttcttgtaccatcaggagagggatgaggccacaggtcacgtccctttctcttgtttgttcagtccagggtcccctccatacttaggatgagcctttccatctcaattaccctactacagaaaattccttacagatacccctttccacagcatttcaaagttccaccaggtcaacaacagcattagcccatcacagactccatagtaaaacatttagtcaaaaatttccaatcacttcttgtcatgtatgatactacaagctactctccttctaatttttttttttttttgggggggataactactacactataactagtccaactgctttcatctttacagttaattcaacagcagctagagcaactgctttaaaacttaatgtcaggtagttgcggagatggttcatatgggtaaaggtgcctgctaccaagattcacatggtaggaaggaaacaatcaactccttgcgcattgttctctgatctccacatgtacaccacggcaaacactagtgtattttaggccacagcctatacccaaccttcacacacacaaaatcaatcaaccaaccaactaaccaatcaatgtaaaaacaaaaacctaaccaaaccaaaacaacttaaggttagaaatacagctcagtggtgtttgcttagccatgtgcaaagatctagattcaagtttcagcattgctagcaagcaagcaagcccaacagagaggataacagccggtctctgttaaaaacctttggaaaacgtttcatcttggttaacagaaactcttcaattcctgacctggctacctttaccttttgtgtccaaccacaatcttattcatcacttttctttggctataactgactttgtgcttcctgcatataccaaatgtttctatatttagagattgtgccccttctactctggttttctctcta

SEQ ID NO: 5196 - DNA, 1000 bp, mus musculus
aatatttatatatacatatatagagatcagaaccattgtgtgtatgtgtgtatgtgtgcatgtgcatgtgcgtgtgcgtgtgtgttctctcctgtctctgccttccatctccctgatagaacactgtaacgcaaaccttcaagcattatgtctagctttttacataggtaggtcctgggaatttgaactgaggtcatcattgcttgtgtggaaagcacttttacacatttgagccatctccccagcccagaaccactgttaagggtacaaatataattagaaattgtcacaagtaccaaatcttgtaattggtaggattttttagatttctttctttctactctctatattctcttcagtgaacttaaacttcttccagtgaacacagttgcaagaaaagctttattcttatttatttatttttaaaagattcatttactttatttatatgaatacactgtagctgtcttcagacacaccagaagagggcgtcagatcccattacagatgggtgtgagccaccatgtggttgctgggaattgaactcaggacctctggaagagcagtcagtgctcttaactgctgagccatctctccagccccaagctttatttttaagatgagtttctttccctctgtttgtaatccaaagtccaagtagcaggcttttgattgtatagcagctagtccgcttgctaggggttttgacctgattccagatcttctgcaacttataagaacctgtgctgtggtcccccagactctggaggcaagatatagatgagccttgggcttttgttctgccaccaatatccccaggtgacgctttataggtttagatattggtcctttaaaatccaaggcagtaagaacagtaagaagagccgggcgtggtggcacacgcctttaatcccagcactcgggaggcagaggcaggcgaatttctgagttcgaggccagcctggtctacagagtgagttccaggagagccagggctaca

SEQ ID NO: 5197 - DNA, 1000 bp, mus musculus
gaccaccaggccagggaaggaaggcaccacccaccatgggctgggtcctctcccactgatcactgattgagaaaatgccttacagctggatctcatggaggcatttcctcaatggagcctcctttccctctagtactccagcttgcgacaagcgacacaaaaccagctaatacccaccccagcacacaaaacagcatccagactgagtgtcctacactaagcccgatgtatatgagaagtaacattcaactacctcatccagtctccaaatcagccaactaacaacccctgctgccagccatcagtggtgtgtgccagactaggacaccaattgagtaagttggtcacaggagactctacagaaacatcctcctaattggctgcaggccagactcaggaccttcaggctggcatagcacactgtcaggatggtgtggcaacacgagggagaagctctcttctgacctggggctccaacctgtgctccctcagttaccatgagttccaacgcaacctgacactgcgtgaagcctactaaagacccttgataaatctacgcagggacaacttacagggtaactgctgaaggtcatctaccgctagccccagccattcaacagtctcacggccacctcagacacccaaaggtgctggtgagagaacactctagttaaaacgacagtcagtggatccttgaagtttgagaggttttggttttgaaaggaaaaacaaaaaaaaacaaacaaacaaaaaaaaccaaacaaaaaacccataccgacatatcaaggcatggccctgcaggacgctgactcctctgcactctgtggtgacctcaagctgcccttccctgctctggtccaccttaccaagtggtgacttcccctttctcctgtgtgaccccacaatgactcatgacaggcacatgcataggcccttggttaatgatcagcaattgtttgtttactcaactgagctgcctactgaacagaaataagatcaa

SEQ ID NO: 5198 - DNA, 1000 bp, mus musculus; identical to SEQ ID NO: 5197

SEQ ID NO: 5199 - DNA, 1400 bp, mus musculus
agaaagcagacagcaacatcttcccacaatatcccattgagagttaacattaaaggttcatgttttctgactatgaaaccatctatctggaaaaagctcacagagtaaatactttgtatctaattgtatagtacaacatttctctcggtatatctatgagcaggtattctatagtagactgccaaaataaatgtcaattaaaaaaaaaatctgtggccatgagaatgggtgtcattcactttttttttctaagttatagggaacctgggttttatttttagcactcatacagtttctcatagaagtttatagttgaggagccatcttgggttttgggtccctcagagaccagtctgggaaggtcatctcatgaattgcgaagggtgagcaagtggacatagcttctgggacaggcagaagtaacacagcttctgggacaaaccccttttgggctcctcccctgccagaggagaggtgtccaccctggagggctcctccagagcaggtaagggagccatcttgggtcccagatccctaagagactagtctgctcaagcctactagtgagagtgcggactacagaagcaacacagcttctgagcaggcaaagcaacacagtttctgggacagaccccattttgggctccagacatttgggcaccttccccaccagaggagtggtgttgcccaggatggctctttcagagcatgtgagggagaaattcttgggtctcagatccctcagaaactcctctgtgcaggtgagagtgcagactacagaagttacacagcttctgtgacagacagaagcaacacagcttctgggacagaccctgtttcgggctccagtcatctgggcaccttccccgcaagagaagaggtgtctgcccgggaggaatctgaccaccagagcaggtaagagagccatcttttgtcccatgtccctcagagaccagtctgtgcaggtgagcgtgcagactgcagaggcaacacatcttctggacaggccctgttttggccttcatcttccgccagggggcagatctcaatgccagatatctgtgcaccttccgtgcaagaggagagcttgcctgcagagagtactctgaccactgagactgaggacagagctagactcccaagtttgctgacagaggctaacagaatcacaggaggaagaagttccaaccagagacaaccatgacaactaactcaattgccagatggcaaaaggcaaatgtaagaatcagtctggcggttcctcagaaaattggacatagtactaccggaggaccagcaatacctctcctgggcatatatccagaagatgtcccaacaggtaagaaggacacatgctccactatgttcatagcagccttatttataatagccagaatctg

SEQ ID NO: 5200 - DNA, 1000 bp, mus musculus
acccgggttttatttttagcactcatacagtttctcatagaagtttatagttgaggagccatcttgggtcttgggtccctcagagacttgtctgggaaggtcatctcatggatttcgaagggtgagcaagtggacatagcttctgggacaggcagaagtaacacagcttctgggacaaacccctttcgggctcctcccctgccagaggagaggtgtccaccctggagggctcctccagagcaggtaagggagtcatcttgggtcccagatccctaagagactagtctgctcaggcctactagtgagagtgcggactacagaagcaacacagcttctgggcaggcaaagcaacacagtttctgggagagaccccattttgggctccagacatttgggcaccttccccatcagaggagtggtgttgcccgggagggctctttcagagcatgtgagggagccattcttgggtctcagatcccttagagactcctctgtgcaggtgagagtgcagactacagaaattacgcagcttctgtgacagacagaagcaacacagcttctgggacagaccctgtttcaggctccagacatctgggccccttccctgccagaggagaggtgtctgcccgggaggattctgaccaccagagcaggtgagagagccatttttgtcccatgtccctcggagaccagtctctgcaggtgagcatgcagactgcagaggcaacacatcttctggacaggccctgttttgggccttcatcttcagccagggggcagatctgaatgccagatatctgtgcaccttccctgcaagaggagagcttacctgcagagagtactctgaccactgagactgaggacagagctagactcccaagtctgctgacagaggctaacagaatcacatgaggaacaagttccaaccagagacaaccatgacaactaactccagagattgccagatggcgaaaggcaaatgtaagaatcttactaacag

SEQ ID NO: 5201 - DNA, 1000 bp, mus musculus
cataacagcttttatcttgagttaaaggagaatgccaccatctacaactgataaaaaatgaattaggaagagagaaaatgaccatagaggaagagatcaatttgtacatgctgagcctcagagttattgcaaatgtttataaggaactttgtttctaggacctccaaacaacaaagtgctgcaagcattgatttgtaaggctttgtcacattttaaggcataatcattaatgtaacattcaaaagaaaagatagcaatacaggaaacaaagtcagtaaaatcagaagagcaagttgtagaaaaagttttaaagaatagtttaagttgctagacaacaaaattatttcgcaaaaaaaatggaggtgatattgaaagtgtaggaaagagaaaagagaggtaagagaaaactgttccagaagagatgtaagacatcgatgccactgaggggaagagagggagagaaccctgtcctctggatgtagaggaacgaatccagtcctctggatgtagaaggaagttactcttggcaatggatgggcttttcctgtagggcaagctatgcttcaaagctttcaggaaagcttcgctatccaccttctgagagtgaggagtattcggttggatttgagttttgagcagagtgatgagagcttcagataatttttgaagcatttcgaaggagaagagaattgaagaaatattaaatgggtcagtctaggtgtacaagttctcctggatgctcttgagagcctcagcaggatgtcaaaggcatgccgcagtgtggatctcagggcaaagtgctgtcgtaagtaatatagtagcacatggcatcatggagctcagttcccgatgagacagctgactggaaaagccacaaggctctggacaaatgaaaaaataaggtcatatagatcctaaaggtgcagaagaaagagaagcaaaacaaagtttgattgtctctgtgatttaaaacaatgtaggagagatataaaataataga

SEQ ID NO: 5202 - DNA, 1200 bp, mus musculus
cctaccccaaccaggtcacacctattccaacaaggccacacctccaaatggtgccactccctggtccaagaatatacaaaccatcacagtaataaaaaattttttttaaagtgtagacaatgccagtttaaagagccacacattcaaataaattccaggctatgggagctgagttggttctcaaaggctaaatgtttgcacataatattgaacaagtcgtttctcactttaagcttagaataagaaacgacatcgcagtctgcgttactggggtgtttccaaaatgtgctgacccactggaagttcccaaatggcttcttggtgtactgttaacgaccatctggctagctatagataaacaagtctcaacatatgggctatagcgcatgcacagctctgctccaccagtgcagaaaattgagaaaaggtcgctctcttgatacgagtatgtcacgcgaaacaagtgggccccggcattggaggccctgccctgagaggaacagagacgcattaaccacggtcccttccctgctcctcactggacaagtcacaacatgtctcctcacttcttgcaaaaaaatattttaaagtgccaaattgactctggttctcctctccttcctttctctttctcctcccccccttccttctctcttcccattcagaaacacatgtgacacaccaaccatagatctgttcccagcatgttgctcaatattggttgtcttagtcggtgttctattgctgtggaatgacaccatgaccatgccaaccctcataaaggaaagcatgtaactgcagctggcctacagtccagaggtttaatccattatcgccatggcaggaagtatggcagcaggcaggcagatgtggtgctggagaggtagctaagagttctacatctgagccaacaggcaacaggaatagaaagagacactcagcctgtcttgagcacttgaaacctcaagacccacccccaggaacacacttcctctaacaaggccacaagttctaatagcaccactccctataagcttatgggagccactttctttttttttccattcttaattaggtatttagctcatttacatttccagtgctatgccaaaagtcccccatacccacccacccccactcccctacccacccactccccctttttggccctggcgttcccctgtactggggcatataaag

SEQ ID NO: 5203 - DNA, 1800 bp, mus musculus
ccatcctggtccatctagtcccagcaagactagacacaccctctttcactgaggcacaaccagacagtccatgtagggggaagggaatccaatgacaggaaacagagaccaaaacaccccatactccacttgttaagggccccatatgaaggctaacttgtaaatttctacaaatatatgggagggggtctaagtcaactcttgcatactttctggctggtagtaggacacagattttatgtagtaatgaatatttaaccaataaatacaacacagttgcccttttggactcagggaaattagtttatatttaatacatctaccaaatatgaaactcctattcccacatgaagaagaattaaatttctccaatgatagataagaatgaagtagtcattccacataattataaatttcaggagaaattgttggaatgtggccatatttggaaactacacgcagacattcacacaacaccattgaaatttattttaaaatgtattgcattgtttttgtataaatataatatttgtttaatagttttcttctgtaagagctgttttctttactcaatattcttctgtttattatttgaaatcaatactgatattgatttttacatatgctaatttatatgtaagggctctatattgttacacctaatagataggatattagtatgcatatcacagcaactgtcacttcattagcaaatattatgctttcagaatactgtcaagcatcttcatcttgctacaagtgaccccgagttggggccagtgtgccaattcattccatttctgtcatttcccactgtgttaaaacagccaaagtccaggcagagatcgactgtgtgattggcagacacaggagcccctgcatgcaggacaggcatagcatgccctacactgatgctgtgttgcatgagatccagagatacattgatctccttcccaccagccttccccatgccgtgacccgtgacgtgaaattcagagagtatctcattcccaaggtaagcgtccttcttctacactgtgccttaatgctcttgatctcaaattagagtgagtgaaactagatcacttgcccaagatactgagtcttgcaatttccagattaccaatattaaagagaaagttatgcaaaaccttcagagaaattaggagattaagccaaccaaaccacacacagtatattcaaaaccaggctgtactagaatttttgttttagaagtaattagaggtctttattgaaaattattgaaaattcttcataactttccagcaatactaaacatgtctttatctgagtaatttacttttcctttatttcaaataacatagagatactcagtgtatattgtttaccttcttttttttatatattccttctctttatttaaattttttttaccttcttaagaatttactgagtggttggtggcaatttttttgtccctacaatataagaaaaatgtaaacactttaaatatggaacctggatacattttatgctatttccaataaaagcttataaatttttagatcacatcttggtttgtgacactgtagacctttcacattttctcttggctgtttttactttcaaataaaattaaaagttcatattgttagtctttgaaaaggcccttctagtattttaccagaatgctaagaagtacattggcacatttatcataattcatatattaacctattaaatattccagttcatataatgttctctgtttcagggttggtttatatgtcagtgtcctctaatagtttgctcccagtt

SEQ ID NO: 5204 - DNA, 1000 bp, mus musculus
agtgcttgctgtcctcaatatatccaattggagccggtccttcctagaattccagtttattcaggactccttagagtccaactttctctgtgattctgtgattccaggttcttgtgtacctgagattctgggtatgtcagagttcttggcagtcaagtttcttctgagaccctgagatcctggtgtgaccaaggtcctgttatcctgggatcctggaatcctaagatcctgggaatgttatattgcctggaagtggtatatcctctgaggactggggggctctctggtgtgttcgaaaccaaagtataccagtactgatcaagaggaacacaaactgctggtcaggcatggctcctgtgtccttgctcctgctgtcacaggcccgtcacaattggatttgaaccgatgttgtgttccactcaacaattatcctacgatcccgtggagtgtactctggggccgtgggaccaggagctggtgcccactggaagggatttgtgcccctggtctggcaggatttcagattccctgcccctgggtcaggcccggcctgactggattggaactgatgttgtgttcccctcaccaatgatcctaagattgcatgaagagtcctctgtggactatgggacagaccgcagagttcgtgccccaattagtgattctcatgtgaggcctacagaattaaattcaggatcacctttgatataaagagtaccaatcactttatcgaagcaaattcactctagagagaacaacagaagaaagttttctgagagctgtagagatggcttatcatctgagagagtatagtatgtttctctagaggagcagtttggagggttcccagcaaccatatcatgtagctccatgagagctgacatggtctcctggacttcccaggtattcagacacacacacacacacacaaatctgagcctgaatggacacatgtaaaatgaaatttaaaaaatttccttgtgatatttaaacatgtaag

SEQ ID NO: 5205 - DNA, 1000 bp, mus musculus
tttctgttagtaagattcttgcttttggctttcgccatctggtaatctctggagatagattttatagttgtctctggttagagtttgttcctctcctgattctgttagcctctatcagccaacctggggggctagatctctcctgagtttcagtggttagagtactctctgcaggcaagctctcctcttgcagagaaggtgcacagatatctggcattctggcctgcctcctggcagaaaatgaaggtctgaaacagggcctgtcccagaagctgttagcttctgtagtccacactcttacctgcacagactagtctcggcaggatctggtaaccaaggttgctcccccacgtgctacagaaaagccctcccagtgtgtggcagaacctctcctcttgcagggaaggtgcccggatgtctggagcccaaaacgtgtctgcctcagtagatctgtggcttctgcctgtcccagaagctgttagcttctgtagtccacactctcacctgagcagactagtctcagcaggattcgggaaccaaggtggctccccaaggtgccaaacaaagccctcctgggtggggcagacacctctcctctgaaagggaaagtgcccagctatctggtgcctgaaatgggatctgcctcaggagctctgtgatttatttagattgagatttcaacaaatgtttgatttccactctcacctattgttgcaaattatgaactaaccagtaccccagagctcttgactatagctgcatatgtatcaaaagatggcctagttggccatcactggaaagagaggcccattggacaggcaaactttatatgccccagtacaggggaacgccagggccaaaaaaaaaaatggcatgggtggttaggggcgtggggggggggaggatgtgggggacttttgggctagcattggaaatgtaattgaggaaaatatgtaataaaaaaaagctacgtttaaaaaaaaagtgcaccatagcttgc

SEQ ID NO: 5206 - DNA, 1200 bp, mus musculus
agatccaaatcttgcttttcgggtgtgttggggtatccagggctcactgtggtgtgtgtaaaggtttctgatgatgcccggtggtgttggtttctgtttgtaagatatttttcatttgcctttcaccatctggtaatctctagtgttggctgttctagctgtctctggctggaagttgttcctccagagattctctagcttctgtcagcactcctgtgagaacaactcctcctgtgtcccagtcacagaacactctctgcaggcaagctctcctctttcagggaaggtacacaaaattctggagctcagatccacctcctgatttctaaggtcagagcgctccctggaggccgacactcctttgtcagggaatgtgtccaattgtctgggtttctgctctgtctcctaactgaggatgaaggcccaaatggaccctgtccaagaagctttgttgcttctgctgcccatgtgttctcctgaatagactggtctcagtgatctcaagtttctgggtgtgctagggcctgcctttttcctttgaccctattgctgctatcagagaccctctgggttttttgaactgatgctgtgttccactcaccagtgatctcaagatcccgggtatgctagagtgcctgcagtgtggagactcctctggggaccttggggccctctgccgagattgcacccaagatggcacaggggtggcacggaccaaaacgaacgccagccactggccaggcaggtgttctttgtccctgttcctgctagcacaaaaccctctgggtgttttggaacagatgttgcattccactcaccagtgatctcaagaaccagggtgctagggtgtctgcagtgtgcagagccctctggggaccttgggagcctccactgagatcatgcccaagatggcatgggctcatcagacattctacagaacatgataaaactctctatcctctaaatttgacaccataaccttgacatcaagggcaatccaattataatgaaaaaaaaaatgtaaaatgcttcacagaataaaaaaattccgaagaaattgctttaaatattggaccttattttatgctttagtgagctgagttttcttttatgtaccccagaattagatttgtcacaatgaagaaagcaactgcaagaattcctctgctatgaattggaggaattggaggaagaagcatt

SEQ ID NO: 5207 - DNA, 1000 bp, mus musculus
aacataccatcaagtaatgtctgcacagatataaataggtaaataactaagagagctctaaggtagaaataatgcaaggatatatgaatgatatgcaagtgcattgtactttccatgcttgtaaactgaagtttgttgtatcaaaaaaaaagatagtacagaaagaagttggcaggtgaagggtaatctctaaagattaccagcttgtctgctcctctgaatgcaccttagtttgcaggcctcccaggagttctactgcacacagggcagccaataggggatggtcccaaatagctgcagcagatggaaatcttgatgaggtacagtggacttgggactcatcactcctcacacccctgttccactccccttcaagcctgaaccttctacaggagcagactctcagcttgcctgctcctctgaagaaatcattctcaaggcttcccaggaattccactgctagcaggataatagacaacatagcctgaaggccagataagagttccactgcatgcacaacaacagaccacatagactgaaggtctcccaagagaacagggcacaacagctgaactgctcttttgaggacccatcagtctgaaggcatcctaggacatctgcagccgccaggaaaacaaatcagcagcttgaatgcctcttgaagacaccacattctgaagacctccctgaagagccactgtagccaggccaacaggtcaatggcatacattccccctctgaagaccccacagtccaaaagcctcacaggaggtctgctgcagccagagccataagtctgccaggagacctgcagcaaccaaaggacacaggaggcagcctccagacagagatatccagaccagctaacaccaggaataacaagatggtgagagttaagcacgagaccataagcagcagaagccaatatcctttagaacaatctaaacccacttctcctaccatggcaaatcctggatacaccaaaacacctgattatcag

SEQ ID NO: 5208 - DNA, 1000 bp, mus musculus
tatttctttaagtgatttattaaagtccttcttgatgttctctactatcatcatgagatatgcttttaaatcctggtctagcttctcaggtgtgtcggggtgcccaggacaggctgaggtgggagtgcagggttctgataatggtgagtggtcttgttttctgttagtaagattcttgcttttggctttcgccatctggtaatctctggagttagattttatagttgtctctggttagagtttgtttctctcctgattctgttagcctctatcagccaacctggggggctagatctctcctgagtttcagtggttagagtactctctgcaggcaagctctcctcttgcagagaaggtgcacagatatctggcattctggcctgcctcctggcagaaaatgaaggtctgaaacagggcctgtcccagaagctgttagcttctgtagtctacattcttacctgcacagactagtctcggtaggatctggcaacggaggttgctcccccaagtgctacagcaaagccctcccggtgtgtggcagaacctctcctcttgcaggaaaggtgcccggatgtctggagcccaacatgtgtctgcctcagtagatctgtggcttctgcctgtcccagaagctgttagcttctgtagtccacactctcacctgagcagactagtctcagcaggattcaggaaccaaggtggctccccaaggtgccaaagcaaagccctcctgggtggggtagacacctctcctctgaaagggaaagtgcccagctatctggtgcctgaaatgggatctgcctcaggacctctgtgatttatttagattgagatttcaacaaatgtttgatttccactctcacctattgttgcaaattatgaactaaccagtaccccagatgtcttgactctacctgtatgtgtatcaaaagatggcctagtcggccatcactggaaagagaggcccattggacaggcaaactttatatgccccagtaca

SEQ ID NO: 5209 - DNA, 1000 bp, mus musculus
ctctggaagagcaggaagtgctcttaggtgctaagccatctctccagcctcttagcaacatggaaccattcttcagtacctgcaaaagtattcacggttctcatactattcatctgacaactccctagcacagcttggctgcctgaccagggccagttggatggtctcacacccatctcttaaatagcagagctagtttttcactgagttcagcaggcctggtatggagtaggcttccggcctcctccgttcgacatctaggataccaaccaaagtcaacacagtccataaacataggtcctagatgggccactctggtctgtgacatgtactgtgggtgtgtccaggccacctggtagagagccagtgtcctgaatatgcctcttccttttgccatcttctatcagagaactctaaaaccctttttgctaatggagagctggagccttccttgatgctgcatccctggcccagaagcttgtccatgatagatgttcgataaacagcaaattaaaagacaaatctgtccatccaggctcatctcacacaatccagtccccagttggcaaagtcggttccatggtggcttcaggttgtggtaccattgccacaagatcagagcctctgagactgaatgtccttctgacccagaaattggccctccgcaggcattcctctcagagacatctgtgcccacgtcttgcttgcccttgctctttcctcactgaatcttgttttggatgtggtattcatagcccttgctttgcaatgcacggcgacttagacagggtagtcaccatcacacctttctgagacgcagacccattcaccgtttgcagccaccctttcttaatttcttaagatttgcatcacatacacttaatgtgtttgtgtgtatatatgtgtgtgtgcccatgtgcacgtgtgtatacaactcacaagagtaaattctctccttctaccatctgggtccccaggactgaactcaagttgtcagatt

SEQ ID NO: 5210 - DNA, 1000 bp, mus musculus
ccccaagtgaggtgactcagacccaaaggacatgcatgatatgtactcactaataagtggatattagccaaaaaaaaaaaaaaaaaaaaaagtacagaatacccaggatacaatccacagaattcaagaaagttaacaagctgaagggcccaaatgaggatacctcaatcccacttgggagagagaagaaagcaatcacagaggggtgggggcagaaggagggaggcatctgggtgggaaaggggacaaggaggaaaaagggggaacatgatcaggtatagggggagggaacaggactgaagccctgaggggcagcagaaagaatggaaacaggcaacctcaggaggtaggaggtggggggccctcaagaatgtaccagaaacctgggaggtgagagactctcaggactcaaagggagggaccttagataaaagggaccttagatgccctatagtggggagagggaacttgtagagcccacctccagtagaaagacagggcatcaaatggagggatggagttgacatcctacagtcgaaaactctaacccatatttgttcctgtctgaaagaacttcagggacagaaatggagaggagtctgatgaaaagaaggtccagtgacaagcccaaagtgggatccagctcaaggggaggccccaaggcctgacactattgctaattctatgatgtgctcacaaaaagggacctatcatgactgccctctgaaagacccaacaagcagctgaaagagtcagatgtagatatttataccaaaccaatgaacagaagctgttgacccttgtggttgaattagggaaaagctggaagaatctgaggattagggtgaccctataggaagaccagcagtctcaactaacctggactccaaagatctctcagacactgagccaccaaccaggcagcatacagcagctgatatgaggccaccaacacatatacagcagaggactgctgggactggactcagtcaaagatgca

SEQ ID NO: 5211 - DNA, 1200 bp, mus musculus
aataggctatggccataccccaaagataagaaattttttacaattggataaggaaggtcgctctgctgctgaacgacatgctaataccagccccagtaaactggggtatgctaaatggaaggatgtgcttacaggatcatggaatggtccggatcctgtgttagcctgggggagagggtctgtttgcatgtttccacagaatcgtgcagagccagtgtgggttccagagtggctagggcgacgctgtcaaaatgaagaagctgatcttgctggtgatgagcacgtgtctgcccctgatgggtgcagaacccagatggggaatactgtcggtgtttaaattggactgtaaaaattttgatggcaagatgaatgagctttgctcagcgattgtcaccatgaattatacctgagtggatcctggattgacatcgggaaagaatggactgggataggtgccctcgctgtggcccttgttttggcatgcatgttgtgtgtatggtgtatgcgtcggttgtggaatgcccaggtccacactgccgccatggtggtacaagcttttgccacagtggaagcagggcagtcacctcagatttggcttgctgccatgaagaatgaacaatgaagccatcgctccgtagggttgttcggctaagcactgcacagaggttagtctggaagctgtttgacaatctctgggaggtatgtctgattgcatgagtgttgagtgtcctactgtccttcccccaggaaaaacagcacgggagcaggtcagggttgctctgggtcactgtgagcctaagagtcaatcctgtacatggcccctatttctgcacactggggatcagacctctatcttcacccacggagcttgttcaaaaaaatataaaagggggaattgtggggagccattctggacatcctggccagctggatggaaatctactccaggcagtaaacaagcccatgtttggtggatggcacgcccctaatccctgattggctgagcaagcctgcctggtgaggtgatgttacctgtggtgattggttggggcgtggttgtggctggagtggagaaaaacacttgtaaccagagaggctgggggattttaagaaagaagctgcctgagtaaaactgctttaagaagaaccggtggttacgtctttcttgctggtcgagtgggatgtgacacttagtctatc

SEQ ID NO: 5212 - DNA, 1000 bp, mus musculus
tcagctaaaaagactctagatgctgtgcactgtgaggcagagggctagcgcagtggacctaggttatctctcagaagcccattacaacctcctatgctctcctcggctcccttgttggttgactcatctttctgtgaggtgagttcctgtctcagtcatcaatatagcaattgacaaagtatgtcaactgtcaaataccaggaaggcctggataaaaatggtgtcccctttcccacagtatccctaacttaagatctgggaggttctttttcatacagttgattagctagctaggtaggtaaacgtctcgtaagtgagaaagaataattaaccagtactctctctatcaggataggcgctggtctaagggattctctcgggtcagtgttgtccttcaggaacatggagtaggaggatgcgagcggctggcttttgttttcacagactcggatcttggttacacatggcattcacttccttccccaagtggatgagattgtcgttctggggaaaggcaccatcttagagaagggatcctatagtgacctgatggacaagaaaggagtgttcgctaagaactggaagacattcatgaagcattcgggacctgaaggagaggctacaggtgtgtaagcagggttggaacagggtggaacttggggtcttaatgggatggtaaaccaggatctatatcctgagctatttagtgtccagtgaattacatttggagctgaactgcccagagattcaaactccgttcctctgtgttctgggtctctgtaaaggaacatagaaatcaaaattctgtgtctgcatcaaataagtgggactttctattctgctgcctctgacatgcaatcaaaacaaacttcagcatgtacaactgaatgtttgaatgagaggcccctattggccggggggtgggagggagggcaatggtacaaagcatccacttatagggatgacacactcctttttattcaagtcacacaccctaccc

SEQ ID NO: 5213 - DNA, 1400 bp, mus musculus
tgggagcaccttacccagctcagttgacccaagcctccccactctccaggggttcaaactcaaagagtactgggaaatgtagtgaattaattaccatcagacctcggccgctgttcatctctgtaaacaaacattttaatatgctgtaattaattacatctgccatagcgaccctcctctcgttcatccttcttcagcttttcttctgcataccctggaccacccttctccttccaccgggagcctgaaaacctggcaggccccctcctgaccctctccctcgccttctcgacccccagcaggtgctcgcatctgccacaactgctctgcagctttttgtccctttttggtctttctgaaagtcctttgtctctaatcctgtcctggcctgggttttcttcctcaaccaagtttgatgttaagaacacatcctggagagaggaggaaatggaagagaaggggatcttccccaggagcctgagcacactccttagtgagctaggaccaggctaatttacaaggattatctaaaagtgggaaggatccctgacccgttttctgtcttcatccctcccctgagtccctccctgcctccacagcacctcagtttgaaaaacacaggggcagtccagctgcccgggtgagcccacctggctaggccacaattacttcccttcaaacacagaaggaccacggcaggatgatgcccgttagggtagatcgtttagtactaccacagggctgctgccccagctagcacggtggaccgtatcctttttctgtgtaggttcaccttgacctgtgaagagcttgagccagggcagggaagggatcaccctgaccagaggtggaaaccttagatgaaaatgaggagagtcacacgcccagatcgccaggaaggacagggtgagggctggccgcccgaggggttgttggccagccaagtcgtgctgggggagccgggagctgggtgggcggggtagggcgggcgccaccaggcgtggcgcagggaacagagcagaatgaaatgcagatgcaaaacgtgctcgtaagagtttcctctctctctccatctgccaaagccgagattttaatctttaatccatgagcaatcagcgagcagcggcgaatggcacattacagatgttttactgtcgcgggcgttcgcagcttccgtgctctgcacaggcgcggagcgcgggcgcctctaaccttcccccctcctctccttccttcctccccaaccccacttaacaataccccccccccccaacctgcactctgcaggctggttaataaaggaagagccgggaagcggggccttttaaccctttcctacaagaactggggattctgttcctggggctacactggtggcacaggcatgggctgcataaagg

SEQ ID NO: 5214 - DNA, 1000 bp, mus musculus
taatggtgccaaagtacatttgcttctgttgcttattattgttgttcttgccatctagttatgtctagtgttaactggtctgggtatctctgtctaaaacctgccttctgtgtctctggttctagcagatctcctgggagacctgtagactatgggggtggggagaatggcagacatgcctatctgccccagcagaggtgcagactggaagggaaatatggttaacgtggaggggaaggattccacatcttctgggttgcttgggggtcccagctggtgcagttacttgggtaggagttctcacctgtgtccctggttctagcagatctcctgggagacctgcagactacacctgctgctcgtgagagaggcagacacagagatctgcccaagcagaggtgcaaaccagaagggagtaaatgttttcattagtctgagataaatactgtaaactatatttgctgaatcatgtaataagtgcatatttaatttattaaaacttacatgcctggatttaaaatgagtttgttgctttgcttcctgtttgtttgtttgtttttgtaaaaccctttgcacattttatgcacattttagttgccttccaacctttgcagtgctgagttgttttaactttgagctgttccagaggtcctcaagtataatctcagtgaaattttgctttctattttcctaactacttgcatatttggtcctttatatgtcttcatgattcctctgcataactaacttagtgaagcctcacttatcaccaccagccccgtttaaatcgactatttgccttaactttgagtttttaagagttctattaatccacatgttatttttttctgataattaaaatatttcctcttatattacttctggtttacagtttacaattccattttgttacttttttgccccgagagctgggaaagtttttatttccttcacattgtcttttggaaagttagcctgattctctttaactgtcaacttg

SEQ ID NO: 5215 - DNA, 1400 bp, mus musculus
attattcctcaccaaatgaattatatttttttctaagatatcatgtcttaataataatataatattaaaccagtaatttcatttttcctatgctaaatttgcaccataatgttaagcttcatctcacaaatttgccaggatttaacaaaataatgtaaataagacatttaaacttcttacctgagtcttcatcactcacaaactttctttgagaataacaacagtggttcctgttattgctcggatcttctcttctacacaacttaaagttatagtaacacctgtcaataatagacatggtcctgaaacagataaagacatactcgcaaagggcatctttgcttttcagagttacacaggggtgactcttaactaagtttcacaaactacttatttggcattctggtatcggtcatttcatctctctttagcatctgttaggattagccttttgggaatcaagcaaaaagaattttttttttttttttttttttttttttttttttttttttgggaagccacatgttgtctgactttaaattacaggtgaaacatagcgtgctatggcagtcatccaaaatttgggggctacaccaactttctgtttaaattcattttctgtgaagtcaaaactcatctttcaagtttgaaagcatgggaggtaattagctgagacggcagagagcagaaatgaggaggaggcccctggtggccaaaatgaggcctctccctctcaggctgtgtgaaaggcattaatccacactttcatatcctattaggcgaatagaaatgtctggaggtaatgtgaatactttagtgtgtaagtgacatctccaagcatctcattggaactctctagctgtgtaaattaggcagcatcagggtttgacagccaagcacagatcctttaagactgagagctgggagccgcacacacaaaagtactaccagggaaacctcaggaggacatgatagttggttcatttcttctaccttgctgcctgtcatgtcagatgctggcgacttcttggcagtggctttatgtaacgatgaaaccagatttcctagatgcccctcaagcacaattagaacaaatcagactgctgtgagtagaagtcaggattaggctgcagaagactaggagaaaaatcttccccctcagggagtcttcattgtgcttctgagaatggcagcacaggtttcaaggactgtgtatttgattcacagtagctaaatcatagaaccaactaaggtgtccatcaacaaagggatgcatacaaatgaggattgtcttgtcagccataaggagaacaagctcataccatttgcaaaaaaaaaaaaaaaaaaaaaagaatagttgagataatcatattgaataaattatgtctatgaaaaaaaga

SEQ ID NO: 5216 - DNA, 1600 bp, mus musculus
aattcaaagtgtattccaataagagtttgttttcaaatctaatttctagatatcataccacaagagactcaacaaatgtgtatttctgtttatgttatataaaacggtgtgtaacacagaaaatagtcactccagcaatgccactttttagatctccctacaaggcaacatgcatttttattaagggacagtttacaagtagaaggaaagaaaattacaagtagtaggaaaggaaattacagtgtataatcttcaatgttaaatgcatgtactgtcaaaatataaaagcttatcatactatcaaaaacattattagcatggctgttgtgttttcattgctacagtaacacatctgtccacttactggaataaggaacacccactcatcctcaaatttctatgaattagacttctgatcagagctagctgttcagtgaagggcctcgcaaatgctagggtggctcttaattgcaggttctgaaggagattgctgttctttttattttaattttaattaatttatttattcactttaaatttcaatatcagccgctcctctcctcctagtaagccctcacccaagtcctctctccactcctccttgcccttctcttttgagaaggggaagtcccactgtgtgtcaccctccacatccccactccccaccttcctacatcaagaggctgtgggactaggtgcacactctcccattgaggccagacaaggcactcagtccatttaggggcatgggatccacagttagggaaacaggcaacaggctcaggacagcccctaatccagttgcaggcaggaactgcatgaaaacctagctgctcatctgctacacatgtacaggtgcctaggtccagcctgagctcgctctttgggtggggattcagtctttgggaacccccaaggttccaagttacttgactctgttggtcttcctgtggagtccctcagtccctcttccaactcttctgtaaaatactctgagctcaatctaatgtttgggtgtgagtctccgcatctctttccatggctcctgagtggagcctctcagaggacagtaacgttagggtcctgtctgcaagtggaatagagtatcattaatagtgtcagggattttgttcttgtccattggatgggtctcaatttggggcagtcattggttgactattctattagtctctgctctgtctttgtccctgcacatattattggagaaatttagtttcttacagttgcatcacagcgtacccttccatctttaagcaaacaagggtatgttgaatgagcattttagtaatgtctgattttttttttcccaaaggagaatcttgtaggaggtcatgttattatattaagcctacttacatgagttcatctttcattgtaaacattgtgtagccagttatcttaattgcatctgtaaagtttcatttgtgtatgtattcatggtgctcaccaagaagtaaagttgaatcatgccaaaagtcttcctactgtaaagtcacattacgaaatgaaaataagaaattatattgagcataataccctcctcccatcatttttaaaaatgattgccccagcaggatga

SEQ ID NO: 5217 - DNA, 1000 bp, mus musculus
agacacctcagagtagagtgtatgtactacccagtgtcaaaaacataccagcatctgagaaggccaatagaaggagagagaagtaaaacgaggcatctctgatggattcactctcactccaaaaaaatttaacaataattgcatataacaatgaattcaatcaggtttctaacttttcatacttgtgactcttaattttaacagaaatattttaaacaaccctagacatataggcatttaattttttcccattttaatagatattttcttcatttacactttaaatgctatcctgaaagtcccctatcccctccgcccaccctgtttctctactcaccgactcccacttcttgtccttggtgttcccctgtactggggcatataaagtttgcaataccaaggggcctatcttcccaatgatggctgactaggccatcttctgctacatatgcagctagagatatgatctctgggggtactggttagttcatattgttgttccatctatcgggttgcagaccccttcagctccttggtactttctctagttcctccattgggcatcccgtgttccagccaatagctgactgtgaacatccacttctgcatttgccaggcactgcatagcctcacaagagacagctatatcagggtccttttagcaaaatcttgctggcatgtgcaatagtatctgcgtttggtggctgattatgggatggatccccgagtggggtagtctctggatggtccattctttcgtctcagctccaaactttgtctctgtaaccccttccatgggtattttgttcgctattctaaggaggaatgaagtatccatatgttggtcttccttcttgattttcttgtgtttttcaaattgtatcttgggtatcctaagcttctgggctaatatctacttatttgtgagtgcatatcaagtgaattcttttgttattgggttacctcactcaggatgatatccttcagatacatctatttg

SEQ ID NO: 5218 - DNA, 1400 bp, mus musculus
gaagcagttacccaaaggcctcctcctttggagttttgtaaagaacgttcattacagcggagttgctcagaggcttcttccgtgcagttttacagttgaaggagtggtgaggtgtggattttgttgcctggtttgtagagatgttctataagaggatgaaaatcaagacttgaccatggggaaatggcctaccgttcaacaccagttggacacactcagttcaaagttgtaatgggttatctgagttatttaaaatttttaaaggtatgatcaataattagattccttttgtatgggccaccaaaaccatctgagacattgtatcttgttgtgtaatatgttgtcatggtaattggctcacagattgtatcttgatttgatttcttttagaacattatttctgtatcagaacaaaggcaagttttgtctggcttcatcttaaagagcatgttttgattgacctaggctaagtcaaagccactatgactgctcaatctttaggtgaacaatttactatctgtgatagacttgctttctgtatccttttaatggcaacatggttgtcaaaatttacattcccctaccctagttcagaacttgccatgtggctgattttcagtgatggaatactgacagtcataatagagtagattattgatgtggttttgttggttttattttaatgtgtgttctcatgttcctatgagatgaaatatactccgagtattatgattcagaaggtgagtaaaaaatatccccggagtaaatatgataagtggttttaaactgatgtcatcaaactgtaataaagttacaatacattgagtagaaacacacacacttacatacatggatgcatgcatgcgttcccacacacgcgcgcgcgcacacacacacacacactgatgtaaaattgactttccttgttgtgtaatatgttgtcatggtaattggctcacaaagaactcagtactgaaggtacagtgctgccagggcaaaataaaaattgtgatctgaaattgagaaataaaaaaaatcaagctggtaatataaggtgtaagaaagtcaatacatgtacacaaatgagaaagaacaaagtatacatttctgaatgtaaagacttgtatttggaaatttcaaagtagaatattgaaaagaaatataaggagcttaagacatagaatatcattgtcttttttttcatctaattaactggcccaacatactgtaatactataaatgttttatatatagacctgaggtcaaaggttttcagctatctcaactgccctcacatagctttatgttactccattgttctcttcctgatcctgatttatgagacagtttgccatgttacaatatactttatcaaatctttttctgcatctctcagaagg

SEQ ID NO: 5219 - DNA, 1000 bp, mus musculus
tatattcactacctacacacaattcttttgaaatataacatgttttcctatccatgtgttaaaataaatctttccttgatattattttttttttactggatattttatttatttacattttaaatgttatccccattcctggtttcccctctgaaaaataccctccccatttttccctcctgctcaccaacaaacccactccagcttcatggccctggcattctcccacactggggcatagagccctcacaggaccaagggcttctcctccattgatgtcccacaaggccatcctctgctacaaatgtggctggagccatgggtccctccatgtgtactctttggttggtgatttagtccctgggaactctggggagcggttctggttggttgatattgttgttcttcctatggtgttgaaaactcctacagctccttgggttctttcttgaactctccattggggacagtgtgctcaggccaatggtttgctgcaagcatccacttctgtatttgtcagcgctggcagagactctcaggagaaagctatatcagactcctgtcagcaagcacttcctggcctctgaaatagtgtctgggtttggtgtctgtatatgggatggatccccatgtggggcagtctctggttggcctttcctttagtctctctccacactttgtctctatatttcctctcttgagtgttttgttcctctttagaaggactgaagtatccacacttcgttattccttcttcttgagtttcatgtggtctgtgaattgtatcttgggcattccgagcttttggacaaatctccacttatcagtgagtgcatatcatgtgtgttcttttgggactgtgttacctcactcaggatgatatttttgtattccatccatttgcctaataatttgataaattcattactttttcttatttttattatttaaatgcattttaaaaataaacttaataacattgagtattttgaaaatcata

SEQ ID NO: 5220 - DNA, 1600 bp, mus musculus
cacacacacgaacacaaggatcctgaattttgacaagctgtaaagcaatctactggcatgcagggaagggaccgcaaataactcacagacaaggagagtcttgctgatctaagaaagaggaatttctcactggaaaatggtggtcatggtcctggaaagactgaatttcaaaatacatatttttcctaaagtgggtttattttctccttaaatgctggtcattaggtgctataagagataaatattttaaatttattgtaatcattattcaactatatggctgtgtatgtctctgcaaatgagtacaggtgcctgcagaagccacaactggagttagttagtgatgatttttgagatgcccaatatatacagaggcttgggaaacttaaattctctggaggaacagtccgtactctgttaaggaaagccatctctttagcccagaggtttagtttttaattataaactatcacaaacaagaatcatcaaagaatagagctacaggagaggattatccagatcatgttgtcctgtgggtacatctgtggtgaatttttctcgattgttatttgatgtgggaagttgtggagagctgcgccgtgagcaatcgccattataagatggcgctggcttccattgcgtctaactagtaaacaagcctcatgtgcaagtgcaagagtgaactcacgcctagtcactgctcatctcgggagtagtaatggggtgatgggcgagcaacgaatcagaagctgtcacgctacatcaggtgctgaaacgtcacactgcgggctatataaacagtgccattttctgggttcggggtcttcctcctgagaagtaagcaataaagctttttgccacagaagattccggttgtcctgagtgtgttcttgccagcagggacaaaagctcgggataggaagtcccaactcactgtgtgtgggggagggtacaatctctaagcattggtcaggaactgtacaagataaagcgaggtgaaagctagcagcgcccatacgttcttacactgtgcgcttagctgcagatacgatacggtgtgagcatttatctcaagcctctatttttgtgccttgctctcactggtgagcccatcatatatacagccccatataagctgaattgtcagacagatacttcctgttgctcctggcatttttttcacagtgacagaaatgaaactagaatgagtgtcctacaaaattctttgaagatgctaaacgccgtgaagatcccaaccttcttgcactttactcttcattaatttgtaagaacagaaatatgactttgtccatgccattaggatatttcatgaatttcagagatgatgataaaattgtgaaattacattttaaacatatgtgctactatatatatacatatatatatatttacatatgtgtaatatatattatatacatatataaataacatatgcatgttatttttcttgcttttatctgtaaaataataatataatagttgctatgagatgtggcatattataaacaatcctaagttttagacctacctaaacagcgtcatagaccatagttgaaaatgttgtcatctttagatagtg

SEQ ID NO: 5221 - DNA, 1400 bp, mus musculus
acactccatattccagtccctgctcccctgcccaccctctgactgctccacatcccacacttcctcccgacccctatctccacgtggatgcctccacccccacccctcctgacctctaaactccctggggcctccagtctcttgagggttaggtgcatcatctctgaatgaacacagacttggaagtcctctacagtatgtgtgttgggggcctcatatcagctggtgtatgctgtctgttttggtggtccagtgtttgatagatctccaaggtccagattgagactgctggtcctcctagaggattgcccttctcctcagcttctttcagccttccataattcaacaacaatgtgactgatgtttctgtccattgattgggtgcaaataactgcatctgagtctttcagctacttgttgggtctttcagggggcagtcatgataggtccctttttgtgagtgttccatagtctcagtaagcgtgtcagaccttgggacttccccttgagctggatcccactttgggcctgtcactggaccttcttttcctcaggctcttctccatttccatccctgtaattttttcacacaggaacaattatgtgtcagagatgtgactgtgggatggcaacctcatccctcacttgatgccctgtcttcctgctagaggtgggctctataagttccctctccttactgtcaggaattccatctaagttccctccctttgagtcttgagagtctctcatgtcccatgtctctagtgcattctagggagttcccccaacctcctatttcctgaggttgcctgtttccattctttgtgctggccctcagggcctcagtctttttccctcacccaataccagatcaggtacccctctccccccaactcccacacattcactttccctcccaattcctcccctccctctccacttgtgattactttcttctccctcccaagtgggactgaggtgttctcacttgggcacttcagcttgttgaccttttttagttctgtggactatatcttgggtgttctgtactgttcaagggaacagcatcttctagacaaaaatgcaatgataaacacgagacagcagacacaagacctacacaggataaaattctagaactgagacgtttcactcctaaccaagatgttatatggaattgaatattgctatggaaagaaaatcagttttctccagagcaatgtgattaggtaggtcaacttaaaaagggactctatggtttttgtgaaatttttgttagtttaggttttattttattgttgttgatgttgctatgattgttgcttttttgttttgtcttatttctttttagagggtaggatgatttgttttgattttttagatatatagaaggaacatgt

SEQ ID NO: 5222 - DNA, 1000 bp, mus musculus
cctgcagagtaacggtgtctgcctctttttgcatacagacttcacatacacacctacacctccgggggaaatgcatatttgaattccagccacttctaagttcaggggtttcttgttttgtcctctttgtttttgcttctgttcagttttcggcacacatacactaactgcgtcactgttctgtgatccatctttagatgtctgagttcacagttacactttcgacaaacgtgggccaagtctgggtcttattcaaacccacatcctctcctcttgggcccggtgcgcctacgatggtgcctggcaagtgcctgggtgattgggcacccagccttggacacacgggcttggacacctggtcttggacacccagccttggacacccaggctgtccaacccagccttgaacacataggcttagacacccaggcttggacacctggccttgggcacccagccttggacacacaggcttgggcacccagccttggacacacaggcttgggcacccaggcttggacacctggccttgggcacccagccttggacacacagccttgggcacccaggcttggacacccggccttgggcactcagctttggacagcgtctttgtgttttcttctaaggcctttctaagcacccatgtttccaacttacctctgtgtggaggcaggcccatggtggggttaaggggactttgctatgaagtggagtctgagcacaaaagtctgtattctggaacattctggcatgttacctaaggagaccttctgtgcctttaccctccctccaggtctcaggcttcctctctcgtctttgtcggggttgtggaaagtaggaatggttgttttccagccaaggcgaatacagctccagaaggatgagtgccaaaaatattgttgccctccaagtacatgaccaccaccttccacacagctaccaatggctgccaggtgacccagaaggtacagctaaacctgcccttcctccatcttgt

SEQ ID NO: 5223 - DNA, 1000 bp, mus musculus
gtcaagagctgcagcggaagtacagtgtatccatagggaagagatagagtcacgtgggaaagaggagcaggagcataatggttgggggtctggtttgaactgtttgagccctggccacaaggtggggttcagagctcctcaggaatatggggtctgagggtgtgacacacctcagagggttgtcttcctcttatccatcttaagtggagcagtgtgacccactgaaaccaacagtgggaggccttgcctgtaggcctgtgcttgattctctctagagtgctatgggttttcccggggttatgaaccagagaaccctattgattactgtttgttaatcaaagaagacacaggaaactggccttgtctcccattctgtggtaattttcaacaggtggcacttgttcccgtgttcattgatgaatagatgtgctaccgatcccatagggtgctttctgcagagtggcacactgtatgcttgcctttatagtgcttccttctctgactgagctattcggatcagacatcagcagagtaatcacttcaagaaataatgtcctttctaacaatggataatggcaggttggacaatatatttgcttatggactctgcccatcttatcagtatctcacagaatctgatggaggaaatactggattggggtgcatgtcggcacagttggtgtgatcggggtccatgccggcacagttggtgtttttctggagagaggacatgcacctctcacctgcctcttggctgtgcgacatccatgacgtctgtcctgactgacttgggcagactccatgactctcagcctaagtttttgacagctctctcctagaatactgaccactcctgggtggtttggtagccttccttgcctctgtttgtatctatgcttctcaacactatgcatttagtagctgcagcacccactgcagctcttggtctgttgtgtctgtgtgtgctggctgttggcagaatgaatgcataaatgagcag

SEQ ID NO: 5224 - DNA, 1000 bp, mus musculus
ttctattgtcaaatgtcttatccaaacataatttacagaatatttctctcccctgcagtcttctcacagggtgcctctgtggtgcaggtgtttgcttccattcttaaagatttatctttttatatgtataaatgtttagtctacaggtatgtaagttcatcacgtgtaagttcaccatgtgtgtgcaggatcccaaggaagccagagagggcattagatcccctggagctagagtgacaagtgcctgtgggccaccatgtgtgtgggtgcttggagctgaacccaggtcatcttaagagccacaagcatggctctgcgccatctctccaggccttgtttgcattctttatttttgagcctgtcttcctgggagttacctcctttgtgttacctcctaggttaatggttacccagtgatgctcaaaattcacgatcaaaatcttctgcgtaggaaggatcccaccctctgccaaatggtcttaatgtggcctgggggcagtggggtgtccagccagctcccaaccccgccatggctctggctcctcattagcctttctctggtgtccccacgtgcatcctatcttctcgtcattggatatgtggagaccctttgtggcacttacacaggctctcatctccagtcactttaggttggcctgccactcacaagaactaatactaaggctagcggggcttcgagcttccctgttcattctcccagagttcgccgcacgcagtgctgctggctgcggggtttcccctaagctcctcatcagatctgccagtggaagcttcatcccagacacccaccatgctagcccactaaccaggagggcaagatggacatgttcttacccggttctgccaagccttccattttcagtttgcatttcaccttgagtcttccccagagccctaagggagtgtcaagtgccgagtccttgtctgtcataagcggagtaagtttgccacgtgtctcttcaggcataactaaatgtgt

SEQ ID NO: 5225 - DNA, 3000 bp, mus musculus
tggtgtgctggcctgggactgactggtgtgctggcctggcactgatgctggtgtgctgtcctggcactgactggtgtgctgtcctgggactgactggtgtgttctcctggcactgttgctgagttgttctgtcctgggactgactggtgtgctgtcctggcattgacactgagttgtgctgtcttggcactgaggctgggttgtgctgtcctggcactgatgctgggttgtgctgtcctgggactgactggtgtgctgtcctggcactgacgctgtgcgctgccctctggttcatgtgctcttgtcctctgtgtcctctgcttcccctaccagggagcatcagatggaggccgggatggtggttggtgtttctttttcactgagtcaccgtgctgtggctctgtgcttctcagctgccctgtcattcctctgtccctcggtgacgtcctgtgttctttatcctgcttcgattcttcaccgtcctggctctgctcctgctgcgtgtcacacggggcagcgtttcatccgccatattactgccagtgctctgcccattttacaggctgtgtgctctgtaatagtggttcaggttcaaggtctgaggcacggttctcagccttcccaaccctgtgaccctttaatactgcctcacggtgtgctgaccccaaccataagattattccattgctacttcataactgtaatttttctactgttgtggattgtcatgtaaatgtctgacatgcagcccatctgatatgtgacccctgtgaaagagtcctttgaccccaaaagggccacaacctacaggttgagaacctctggtctaagatgacaatttaagaataaaataagattcttcattctattttatatataatatatatatatatatctcacaggagagcctgcaaaataaactaatatatctggaggcaagagcagttccctggagttacatcatcttcatctctactcctccgagcatgctaggctgtgtcatgagggggcagccagggttaaaattgccgagcagatgatttaataagattacctggagtttccaggagagcccagtgagcatccttagacgtggaagaggcacaagaaagccaggacatgtggaagtgctggctgcagggatgtgattgccggcttgggaggtggaagggaccacaagccaagaatgtgggcagcgggtccctgagagctggaaaaggcaagatccccttagcttagcttggggatgcgtttagctgagcttctccccctggggctacagaaggaacacagccacgccaggccctacagttcttttaaaattgctgtgaatcatggccgtagctcatggtagcctgctttagatttctgacctgagaactgtctgtcaggggtggtggggtgtctttaaaggaaagtttgtcacaatagctataggagaacttaaaaaaaaagaaaagcctatgtcaggtcccaccaggacactagtttctaggtataaggggtctgcacatggcgcccacaggcgagggcactgtgctgcctgccgtacacagcttccacacttgggagctcttgctggggtttatttaagtctctaacaccctgagctagcggtgccactacagttggaggaatctccttagtaatgcaaagcacccgagaggccgactgggaaggatgctcttagagatgtcagccttctgaacagagctctggtaaagacctccgtgggcctcagctggagaaccaatcagagctctggtaacgacctccgtggctcagctggagaaccaatcagagctctggtaactacctccgtggcctcagctggagaaccaatcacaccatcgtatttttactgccacaaagataagaaaaagataatgtgtacaacatgttttcaaagtatcgtagttttaaaactatcatgaaaactacttctgttaagtgtaaaccggagcaggaaaccacgcgcagagctcagttttggaacaacaggcctggagagaggtagagacgcggctctgtgcctgggcacggctttgcggttaagagctccgactgctcttccagaggactggggttcagttcccggcacccacgtggcaggttataaccaaccataaccctaatctccaggggatccaacactctcctctggcatcactcagcgacaccaaataaagtaaaaaataagcgagaccacaactaagagatacagcagacagagttaagaatggtcatttggtagaagtagcaatcgtaaataattatttatcggctatgtttgcaatacttctgaaagttttcaccgtgcttttttataacctgtaaagttaaacgtatctagttaaagtgataagaagaaacttggtttccatcttaaggggctgatgtaagattgccagttagtctcctagatgccactgttacacccgcgttctccaaattctactttcactaaccaccccacctctggccttgtttcttcttgaatacacaatgagagggtttttctgggtggctctcagtgtgtccttgacagttcctcactctggaccgcctcgctaggctggaagccacctccctgtgcagcatgccgctgagttagaatcccatgtcagcctgcttgtcacgttgatgaacccactgcccccactctggtccggagactgtgtgcagatgttccctgagggcgcgagtttcttcttcatgtgtgtcctcaccaacttactgcatttgcagtgctgatggacggagcctcctttggcctcagacttcggaatgctcctctcacgacctctcccagttgctcctccccctgggcacatggacacttctgtgcactgtcacatgacatgtagcagcattcacccattagctgggccaacagttttgagcactttgatttcttcctatctatcatctgcttccccctgagaatatttaagcttcaaagcaggaaacagttctccagccctgtgtcgtcctctcagg

SEQ ID NO: 5226 - DNA, 3000 bp, mus musculus; identical to SEQ ID NO: 5225

SEQ ID NO: 5227 - DNA, 1000 bp, mus musculus
agcgttagtactgtcagctccaacagactcactcctggagttagccaacctaaactgtcagtgccacaacctcccggtggttctgtgcttgttttgcaggtcattgtgttgcgtattgtatcatcagcagggttaaataacaatatccaggctgctttaggagggaactacctgttgtccttagctctgaattatgccatctgcgaattatttatctgacttctaaaggcctggttcctaatgtggttcttttaaagttttctaaaaacaagacaaaggaaaaaaaaatcccatttaactatgagaatctacacagaagtaactgtaaactttcaagacaagaaggaagaagtttgaattaagagcccaggagagacaaagattattaactttaaaaataaaaagacctttccactcaaaagaataagcaagccattggcttttagagcctctttcaactctctggagttggtctgcccaggtgtgaggcccagacctatgggtagtgtttcccatgtgggtggtggagggtaccttcccttcctggggacatttgacctgggtttcagtcctctgtgcctctttgtcatctttctgattgctactgagtgtcccactgaagcaggcttgtcagctgaatttgtgtgtgtattgccctagttaactgtgatgctacatacgtagcattttctatttcctacttagcaggttatagggaactctagtttatattcacaagattggcccttttgttacacatgccacctgtgagttgaacactgagtagcatcacactgagacccagactcctcctctgatccacctcaaacctcctctcctgctcacttaccgttctgcctgtttcaccactgcccctcttctgctttctaacattatggaaacagtgctgtgccacggggcctcttggctctgcttttaaaattgagcatagtacatttgccattcatctgtagtattgcattgcgagagatcgtagcaa

SEQ ID NO: 5228 - DNA, 1000 bp, mus musculus
agacatgtccttgtacccctatgtatgtgtgcatgagtttcttttgtctgccactaatattatgaacagagctgagtttactctgccccgtagttggttttctctcccaagaaacttggagtggcgactgagagaagggagcaggagcctccaggatggaggaaatgaatcaggaagggatacattgtttcacttctcttcagattagtctcaattaagtagcttggcttgaggaggggctgggcttgagcagagttgggggcaacctgacaccgaaactaggatctcagtctatcagtgtactaaattgatggcaatgaaaaagatcctccagagacacaaaagtacacttgttttcagattaatgtaccctgaatgtaagcttttcaggcctggcctgaaggagttaacatgtgcctgctccagggtagcttcggagcctggtggtattactttgtgaagtattcacttgcaggggtgacctggccacttgctcatgaatacactgaagggttgttctttcctaacatctcacagtgcacactcacagggacactaaagggtttgtttaagtcagtgtcgacagagggacaacccagaatgtgtgctgggtggaccttacacgcttccccaggccaagtccaagtcacgttgacagagctctatttcctccttccctggcagcacggcatctcagttacctgctgttaagcatcttggccttatcttcatgtaaccaatgcctgtttctcttttcaaaaatgacttaacaggaattcagggtattgtgttgaatcttaatggcttattttgtctcttgtgtgctggtttctaaaggccccacagttgcttcctctctctctctcctgctcctttaaaaataagaacaggaatcttgctgtctggtgatggtctgagtcagtatcttcttaactgctagggaggctcagtggtttaagactctgggctaaaatcatattgtaatcagtactttaggttc

SEQ ID NO: 5229 - DNA, 1200 bp, mus musculus
ttaattgcagctttaaaaacaaaaatcctagtggctgcagtccccttcccagcacctagagtatccattaacctccaaggaaaaaaatgatttctgcctctccatcctaggcttgcccaaccttcctcaaatggctgtcagtattgcactttgttcaattgaatctcaaaaggatcctgcttcacggaagtctgttctatggtgttgtgagtcagccttgggatgtgctggcccagcatgggggccacttgcagaggagtctggtccccagcccctccttcccttcctcctacacaaagggcagcttcacttaggaagctgagtgctctcaattggtttctaactgcagcagcaggtactagcgctgttgcatgctgcttctggttactcacttggaatcagatcagccaagaagctgaaattagcttcatcttaccagcatgaaatcgaaacacacagcgtgccctgggcttaggagaggcaggcatctgcgatttttctcttctctgtcaacaccagtgcttagggtgacacaggagtctctgttgcacagtaatctggaagtctgagtattgaacactgtggtgtcaccaacctcctgtaaaagaaaagcaggcagagggagaaggcttccaggaggacaaagggacagccagccactaaaagtaaccacattcacttcagctggcaagggacatggtgttcatgaccctgagccatgcataccaccaccttgaccacatttttttatcctctgggttttattatattttgacatcctgggatttgccaatgccagagagcctgtccttttgagggaacaaattcctacagatagttaaggctgtcctacaaatacatgggtcttagttagggcttctattggtgtgataaaacaccttagctaaagaaacataggggcaaaagggcttatttcagcttatagcttggagtccatcatccagggatgtcagagaaggaacttagagcaggaacctggaggttctgatgcagaggccttggaggagtgcttatgacctgctcagactgttttctcaggccattcaggaccacctatccaagggtgtcaccacccacatcaataaaccaatccaaaaaaatcaccataggccaatcctattaaggcattttcttaattaatattccctcttcccagatatgtataagtttgtgttaact

SEQ ID NO: 5230 - DNA, 600 bp, mus musculus
ctttatctttagtgctgaagacaaatcatagcacataatagatattcaataaatatattttagatgcgtatagatgttgtagactcataccattcactccaagattcaagtctcctcatgttgtcaagcaaatatctgaaactagcttgagctacgtattctttgagttgagattatctttagatgtttcaacaaaggtgtgacattattgcctctttagccttcatctggctatcttctgattgctctctcgtgtccattttttcacacctttcctagagatacttccataaatcaactccagcaccatcaacaataaaatctggtacagatatcctacctgtgcattttcattacaactgatatttaccccaacataaatttcaattaaattaattaaaacttaaacatctgaataataaagcacattaatgcctgaacatgaaaatatattaatgtctgaatattaaagtataaagaatctgggctcaagtatagttgtttccccgcacttagcatagtgtctagcttgtagcaagtatcaataaatggtttttcatgaacaaatgaatgaatgaatgaaatattttggaatataca

SEQ ID NO: 5231 - DNA, 1451 bp, mus musculus
gccatcggtcagtgcctcgccaccctgtctttgaggagatgccttatggagtggtggttgggccttggagtcagacagattcaagcccaaatcccagctctgtcccttggtggccatgagctcttatgcaagttacctgcttttattctggaaaatgggcagagtaatgcctgcctataagaaatacttcaaggcaaggaattattattctcctaggtagcataatgcacataaaatggctagcacaggtctggcatgtagtaagcacttgataaatgaatgttgtcattatgttctcttccccaaataaaggatttctctctatttgccccagagcttttaaaccctgtggatcttatagtaattctacctataaacattgctagcagttttcactcttaacaaactacagaatgaaaatataatctcgattatatttttgcatttatttgagtaatatgctatcaactttataaagcactttcacatatactgttctatttatctcccacatcacacctgagaggtttagaccgtaatgaaaaaaagacttgaagcagacatgtgtcttaaccagtttatctgagtgtgtctgagtgtaccaacagatgtggatgagcgcacgagagatgtgtgagcccatgtctccacgtgtctgtgactatgagtgttggagccctacaatatattcaatgattttatactctggggggctatagatcttctgcctctattctgttcccaccaaaatgtccttctccatttatttgtgtgctgttgaactgctgcataggctttgatggtgctgagagggaggattgcctgaaaatatctgggccgggcgcgatggctcacgcctgtaatcccagcactttgggaggccgaggtgggcagatcacgaggtcaggagttcgagaccagcctgggcaacatggcgaaaccttgtctctactaaaaatacaaaaattagctgggtgtggtggcaggtgcctgtaatcccagctactcaggaggctgaggcaggagaatcgcttgaacccgggaggcagaggttgcaatgagccaagatcatgccactgcactccagcctgctcgacagagcaagactccatctcaaaataaataaataaaataaaataaaataaaaataaaagaaaatatctgagaagcctactgtgggctcagtccattactctcatgggacttttgtattgactgacttattgattgatgtaatcttcatggttacacataccaatgtggtttatttagaatgaccactgtaaaataaagtatccacaactctttctgataaatacacacaggaaggtacacacacacacacacacacacacacacacacacacacacacacacacggctggtcacttgcctgttgtctttagatcctttcctctgctcagcaaactacatttcccaagctcccctga

SEQ ID NO: 5232 - DNA, 934 bp, mus musculus
agtcttcccttctatctgattcagtggaccaagtaaatgactctctggtaacagaatttgtattacttggacttgcacaatccttggaaatgcagtttttcctttttctcttcttctctttattctatgtgggaattatcctgggaaaactcttcattgtgttcacagtgatctttgatcctcacttacactcccccatgtatattctgctggccaacctatcgctcattgacttgagcctttcatctaccacagttcctaggttgatctacgatctttttactgattgtaaagttatttccttccataattgcatgatacaaaagttctttatccatgttatgggaggagttgaaatggtgctgctgatagtcatggcatatgataggtacactgcgatctgcaagcctctccactatccaactattatgaatcccaaaatgtgcatgtttttggtagcagcagcttgggtcattggggtgattcatgctatgtctcagtttgtttttgtcataaatttacccttctgtggccctaataatgtggggagcttttattgtgattttcctcgggttattaaacttgcatgcatggacacttatgggctagaatttgtggtcactgccaacagtggattcatatcgatgggcaccttctttttcttaattgtatcatacatttttattctggtcactgtccaacgacattcctcaaatgatttatccaaagcattcttcacttcgtcggctcacatcaccgtagtggttttgttttttgctccatgcatgtttctctacgtgtggcctttccctactaagtcattggataaattttttgccatcatgaactttgttgtcacccctgtcgtaaatcctgccatctatactttaaggaacaaagatatgaagtttgcaatgagaaggctgaatcaaca

SEQ ID NO: 5233 - DNA, 1342 bp, mus musculus
cagcgtcctcctgttccctggccagcccagccctgcccgatgcctggcccagcagcccttgtcccacctcccgctcacgggctgcctgagcacactcttcctgcaggcggccgagatcttcgtggagtcagaactgcctctgagctgggcagaccggctgagtggctgcctgcgggggccctgggcctggctggtggtgctgctggccatgctggtggaggtcgcactgtgcacctggtacctggtggccttcccgccggaggtggtgacggactggcacatgctgcccacggaggcgctggtgcactgccgcacacgctcctgggtcagcttcggcctagcgcacgccaccaatgccacgctggcctttctctgcttcctgggcactttcctggtgcggagccagccgggctgctacaaccgtgcccgtggcctcacctttgccatgctggcctacttcatcacctgggtctcctttgtgcccctcctggccaatgtgcaggtggtcctcaggcccgccgtgcagatgggcgccctcctgctctgtgtcctgggcatcctggctgccttccacctgcccaggtgttacctgctcatgcggcagccagggctcaacacccccgagttcttcctgggagggggccctggggatgcccaaggccagaatgacgggaacacaggaaatcaggggaaacatgagtgacccaaccctgtgatctcagccccggtgaacccagacttagctgcgatcccccccaagccagcaatgacccgtgtctcgctacagagaccctcccgctctaggttctgaccccaggttgtctcctgaccctgaccccacagtgagccctaggcctggagcacgtggacacccctgtgaccatctgggccccagagccaagctgtgtccctgtccctctgtgcccagaccaggcctgcccaggtaacccagacccactgttctggaaagaggcccggagggctcccagggtacccgcaacccacaccgtgagctcaggaaaaggacgcagggaggccccggccagatggctggaagcccaaatcaggccctgccgacctgaccatgtcccaccagggcccccatcctgcaccctgccaggcaccacagcagtgggaggccaggtgggggcacacaggcatatgcccagggcagagcccgccgaggtaggggtggcacccagcttcctactctgccctttgcccagtgggtagacagcatcatgactgtcaccagtaccagggacagagcccaggtggggtgggggcggggtccagcaccacggccagcaccgaccaccaggaccccggagccagcaccatg

SEQ ID NO: 5234 - DNA, 2466 bp, mus musculus
tccagttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtacgtggccatggggcctttctgtgtcttgtggacatttacgtggtatctttagagcaaacacagagtggttgcataagctgcagtgttttagtatcggtgggactgtggcatggcgtagcaggagtgacagtcgcaaactgatggcccagctctgaccctccaggcaagtggactccgaggagtaccagcagatcttcccacatgcgtcggggagggctctggggagagtcagtgggcaggagagggtcagctgtgcaggctccagggcccagccccgtgctttcccctctgaactctgcttcagggggaggagttccatgcagggacacctctgggtgccgttacagttaacatatcaaaggcaagcgtgttattgccaggtgtacaaaagatgagacttccttactaaaaatggtcatttgggcatttgaatttgagaactgttgacacttacagacttagattcatttgtctcagtacctgggaggacagaagggagcatggctccaggtcttggcccttaccggggcttcctgcttccggatgggtgccactcccacctcctggttaaacacatttctttttctccccagcctggggggaccagagtggagccatttccagccaagtctcacagtcacagtgctgttgaagggcggtggaagccagcccaggccttggcagagcacacgccggcccctgtactcagctgtgtggtggctgcaggaggtggaggagggtggctgaaatgggccttcggatccccctgggaggaagtggagcttctggctggtgatgatccaagccaaggttattgggagtgttgacagaaggccccctcatcacatgacagtgacagtgcagtgccagtggtctcagccaccatcgctactcctgtgttctgtgccttgtgctgggctctagggatcacagacaaaggaaaaacggctcatgcctctaagctcctgtgttacagattgctttgagattggggcggttttgattttttttttttttttttgagatggagtctcgctctgtcgcccaggctggagagcactggcacgatcttggctcactgcaagctccacctcctgggttccaatgattctcctaccctagcctcctgagtagctgggactacggcccgcaccaccacgccctgctggtttttgtatttttagtagaaatggggtttcaccatattggccaggctggtctcaaagtcctgacctcatgatctgcctgcctcggccttccaacgtgctgggattacaggcctaagccactgcgtctgatgatagttttgatttttttgatagtggcctttgcttctttttttaagttttataagtgagtgctgagaagtcaatgccaggggctctggatttatcgattgcgtgtgtgtgcgtgtctttgaattttaacaaggctggccatatgctgcaggttaattccccacgtggatgcaactttccctcccttcctggccgtgggagactctgggtcttgtcccatgagagatgcaccatccgtcctcgtcacaacatggcacacaggtgagatcgatgcctctgggctttggtgtgattctgctgttgtttgctcccaggtgtcttggctgggcatgacaaccgcgtcagctgcctgggcgtgactgacgatggcatggctgtggcgacagggtcctgggatagcttcctcaagatctggaactaacgccagtaggtaatgcagcagcccaaatgcccttctctgaggagaactgtgcgtgtttctcatagaacatttgaagttgtcattaacggtttctagataaatgttgatgtagcattgatttggaattgtgttgtgggaaacgtttacagaaagctgaagtcacgtgccctcagctgcagacactcatgcagtgatgggaagagcagtgacctggctgtgcgtctgcacttagattctctgcctcttttcacatttctttaaactctgtttaaaacagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttctt

SEQ ID NO: 5235 - DNA, 1326 bp, mus musculus
ggggccccttgtgctgtgagggctggcaagtacctcctgtacccagcacagcaggaggggctgggggggccggcctcagagacaccccaggcacctcttgctttgcaaatgtgctcctgggagactggctggtttctgtaaagcgactcctgttttgcctttaaatttcatcaagctgtggggaaagtgtcaacacagagaaacagctggagcatggaggaagctgtggcctcgggtccctggtcttctggcttcctctgtgactgccccagagacttggggtttcagggcagggtcctgtggctctcctcccctgccctttggttcttcccacctgactcttcagacacagctacccagccccactgcgctggcctatttacctatgaggggcagtgaagctgggctgcaatgcagcgcctgccagcaggggtcactgggcacacactgtgctccctcccccgagttatgcacctgcctggacagacctcacccaccaactccctctggccttcttgctctctctaggtgtgtgatgcgctgctggcccaggctacaccccgacaagggacaccgggggccccgggagcagagagacctcagagcagcctcctcctgcctcctgtggacggccggccccagctggtgatcccagccagtcccagctttcagttgctgcccccaccgacagtcctcagtccctccatgatggctcccccgacagccggcccccttcctggcccagctcttccgcctgaggacccagggccggatccggagagcaggtggcttttcttgagcgccaacattctgcccgtgggtgagtgaggccctggctacccacaccaagccagagaacattgttcttctcctgctgagtgcgtctctgtttcctggagcccagggacaatacggttcagggttcagttcagtgaccctgatgtcccgtgatgtcacctggggagaactggggctctgctagcaccccagggcaggtggggccgccacgtgcagaggagcctggcgtgcaattcaagagctctcagtgtgtgtcccttcgtgtgggcagagagggggtgggttcattcttgggggatggctctctgcccacctgctgcactgggggggtctgggagaggtgcccctgcagctcacgatgcttccttcttggtcgtgttgtcactgtcagaagggcgaaggcctcccgatgtggcggacagctctggggtctagtgtggagactttggggtgtggagctggtcccctgagctcctgagcttctgctgggatgccctggagtggcaggcctgtggctggctgccctgc

SEQ ID NO: 5236 - DNA, 2061 bp, mus musculus
cctatgtgggggctggggagggggctgttggcagccatgccccagcaagcagggggcttgctgagggctgggccactgaccacctccccggcatcccctcaggcgtgttcaaccccaactcggaggaccccctgcccgggcagctcaagaagcagctggtgctccggatcatcagtggccagcagcttcccaagccgcgcgactccatgctgggggaccgtggggaggtgggggccagccccacacaggcgggaggggtgggagttgggggcgggccgggcatcgcgatgggccctgatgccacccccactcctgtgtcccagatcatcgacccctttgtggaggtggagatcattgggctccctgtggactgcagcagggagcagacccgcgtggtggacgacaacggtgaggctgggccgtggctccgtcacacctgtgatggaagtctgaggggggagggttggggctacctggtgtgcccgggtgccctgcccaggcctccctcagtgacagtcctgggcgccctcccctctaggtgggcagtcccggaagcagcaccgggagtggcactgggagtggtgtgggccgggggctccaggctggagcggtgctgggccgggccctccccatgggacactcctcctggcgctgcttccccagggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggtgggcaggagtggacacggtgccccccacactggccgagggccccagggcagggcaggtactctttcccctgtgagtcagtgcctgtgtaggtgggcctgcacctggcaccaaagagacaggagctgaggacgggaggagagccagcctggggatctgcgggtcaggcaggggcatggcctgtgggggaggggccacccccaggaagaggtccctgcaggctggtgcaatgccaatgggcttcctggaggaggtggggtagtgctgggcccacaggaggcagaggccccaggcctgggcttgttgggtgtatctggggtcttgggacctttaagtagaatggggggcagagcaggtgggggccctgggaggctgtgacctcatgaccctgctgacccacactgctccaggctacagacacgtgtacctagaagggatggaagaggcctccatcttcgtgcatgtggctgtcagtgacatcagcggtaaggtgagtgtcaccccctgccaccagccatcatggggaggggccacaccagccccttgtcccatgcccccccatgtgtccccagtgctgggtcctgaactcaggcagtgaggcctagggtcccctccccgggcctctgctcctctatctcaagaggggctgctgtgggggcctggctcctgagccaccagtgcccacctctgatctcagggctggctttgggcatctcgggcaggacaggtcctgagtgctccgggccttgccccgccctgtgtcacccatgcctgtctcagactcttgggggccttgcagcctccacccctacagtgctgccatctggcttctcagcagggaccgagtgatgcccctctcccctctactaccccccacccctctacttcctggtgtcacgtggaaggcagctgcccgggtttgcctgtgactccacacccagcatgtctgtcccctgccccaggtcagggtggggcctcggcttccgcaggaagtggtcttggtgccagccctgctgccctggctttgagctggggcccagtgccctctgggtcctgctggctgcagctggccctcggggaacccgcacacacagcaggaggggcctgcccaggcccagtgctgactctctcctgccatgctctcgggcccagaggtgccatccagcccctgccgtctatccacccatctgttcctcgtcccccaggctgcagggctccccacgccactgctgtggccgcctcacctgctcc

SEQ ID NO: 5237 - DNA, 575 bp, mus musculus
cacagaccctccacctccaccatatatgaccccaccatctctaccacacacggaacctccacctctaccacacacagaccttccacctccaccacacacagaccttccgcttccaccttacatgaccacaccatctccaccacagatgaactctccaccttttctacaaacagaccttccacttctaccacacacagaccctccaactccaccacacatgaccccaccatctccaccacacacagaccctccacctacaccacacatgaaccctccacctccaccatacatgaccccaccatctctaccacacatagaccctccacctccaccatacacggaccctccacctccaccacagacagaccctctacctccattacaaacagaccctccatctccaccacacatagaccctccacctccaccatacatgaccccaccatctctaccacacacagaacctccacttccaccatacacggaccctccacctccaccacagacagaccctctacctccattacaaacagaccctccatctccaccacacgcagaccctccacctccaccat

SEQ ID NO: 5238 - DNA, 2014 bp, mus musculus
tggtggttgtggttgtggtaatggtgatactgataatggttgtgatgatggtagtggtgatgatgatggtggtgatggtagctaatatctattccggactttcaggacttgctctttgtcacctgctgctgaaccttttccatggctaacttcatccaccccatgagacaaataccatggctagccacctttaatagctaaggcactcagtggttagaaaatttctcaaggtcgtgcagccaatactgagatcccttctagctctaaaatgttttagctctatggatgaaagtaaacgcctgagtgcccttctaagaattcttgggacttgggtaaaaacacctgcccctggcagcatccacaggaagttccatgagaggtcacaggaaggaagggaagaacaagaggacaggggctggagggatggcgggggagacgtgaggtaaatactgtagtaagcaggtgcaaagggaaagagacagagaccagaccagctgccaaaggaggcagaggggacccccagcctccctagggaggattaggcctttgtcaaacgtttgatgcaaacccgtgctctggcagcattcagcgggtaatgtatgctgctaacaagtatcaaagcctcgtggaggggtcctctgaggagatgctgtgtgaacaggtcatttcgttttgtgccattagccactgtacttcactggaataagtgcaccctgcaaagcccagaacttcacactccagctgagaaacttgcacacccacaactagaagacaaaacataatgacattccaccgctctgagcaggcttccacacccctagtcaatggagccccggtccctggcacccctaagtggctttaagcacttgacgatagactgctggccctattgctcaaaaataatacccgatgcactcgggagacaggctgcaatccaataaaccaacagccccaaagtcagcaagatcataatttggaaattgttctccccctgccccagtctattccacagacttcaaattgatctgtctaatctcttatctgtagctatgaaattgtatttccctcttaataggcctacaaatgttatagatgaatagttcaatagcaggcaaagagggaagcagcaggcatactaaaaagggacattagctcctcgcacccttgttttttgagtcttgctctgtcacccaggctggagtgcaaaggcgtgatctcagctcactgcaacctccacctcccgggttcaagcaattctcctgcctcagtctcccaagtagctgggattacaggcatgtgccaccccacccagctaatttttgtatttttagtagaaacggggtttcaccatgttggccaggctggtctcgaactcttgacctgtgatcttcccacctcggcttcccaaagtgctgggattaccaggcgagagacaccatgcccggccaaattcccattgttttaagccacccagtttgtagtcctttgttatggcaaccccagaaaactcttacacactccaagctgggttaagtccctgcacacacactgcgtgccccagaaccaagcctcgccagcactgtgttgatgccatttcctccggcatgttgacgtcaccaccaccacccctccccatgcgtcatattgacgtcacttcctccaccatgttgatgtcacttcctccaccgtgttgacgtcacttccttcctcagtaaggtgtgagttccttggcagagggtctgcttgtcgtcttcgttggactgccccacccagagcctgggacacttcagggacacatctactcttgtcctgtgggttgaataaaatggaacagactggaatttctagggctgctggaaggacctcctgttctcagatgccaaaaggaaacttctgttccccgtgtcctctcttctcatgggtcaggagcccaggcctccctcccgaagctggcagggtgaccccccactccttttgacaagctctcagtttttagcccccgccctccacagcc

SEQ ID NO: 5239 - DNA, 1201 bp, mus musculus
ggctggctccatgtatccagaatcaacgacgggctccccggctcggctctcgctgcggcagacgggctcccccgggatgatctacaggtgaccccctgccccctcacccaggccccctcccagggtcagtcctgcttcgaggacgggttcccaaggccactgtcctcccctctggaggtggaagggcccaagcagggcccacaggcttctgccttccacggggttttgaggtgcacgctggtgagcgttttctccaagaaaggagcaggggctttaaaaacccaagtgggaaagaaaaaccaaaacttttccagggcgtttgagccagagtagactcctttcttgtccctgacccttccgaaatatctcgtttgaggttaacagagcggccggacagtgagtgcacggccaaccccggcatcctgttcctcccactttatacatcgcagcccctgtggccctgccagtttctcctgagcgaggatgacgaccttgcaggcctttggggaaccacgtctgccggtttcccaacactggagggagtgggggcggccaaatgctcctggggcatcctgaccccctccttgtggaactcacttccgcttgcagccctgggtgtttctgtctgcaccataaacagcgctgaacatcagcgacagctgcggagggcgttcagtgagagctgagcctctggggacagagcatagaacccacgaaagacgcaggcacaggcagtaccccagcagcccatcagtcttgggaagccagacctttccggataatcactggggcctgagccagagcccgtgtctgtgacagccacagggaaaggcagtgtctgtcctaagaagagccaggcgggcaggtgcgggtttgccagcacgcgggtgctctgcacgtctgggttggagggttttcagccattgcccacaagcatattgcaaagcaagtcctgaagcacattcaatccaaaccaaccctcactcggaggttcaccacggaaaacagggcctggcatggaaggagcccttggtgtccaggaaactggctccgggtctctgccccgtggccaccgggtggcgctgctgcagagcacttggcaccggctgcgcttcctcagagactgccctgagcaggcgactggtgggggcccgggggcatgggacattggtggttctttctgacctgcacctgctggggt

SEQ ID NO: 5240 - DNA, 1201 bp, mus musculus; identical to SEQ ID NO: 5239

SEQ ID NO: 5241 - DNA, 1201 bp, mus musculus; identical to SEQ ID NO: 5239

SEQ ID NO: 5242 - DNA, 636 bp, mus musculus
tgaactccagtaagatcacagactgtttgctgggctcgggtccagcacgggaggggctgtgttggctggaagctgggcagcgccgcgctaacgtggggcttgtgttcctctcgcgtaagggaattggagaagcagagggaaagcgccgccaccgatgtgctgcagaagaagcaagaggcggagtccgctgtgagtgctgccccaccgttcccaagcgagggctgtaggggacacactccacaccccacatgttggtctcagggccttagaggtcagacttctcttctccaacaacttggctctccacttagtctttattgtgggatgcgacactgggctctgcagtccctgccctgaagataattaccctccaaaggcctaacaagggcttttttaaagtggtgagtattggcctctttttcttccctctgagtgttctgccttttactgagcaggagggagcaggcttcctgggtatgtggcgagcatactgccaggtggccatgggccgtgtgcgcggcctggcgagcacatgcctgtctgagggggcggcacagctatgcccagcagaatggcaccacaggagaacacaggtcctttctcaagaggagctgggattccagcttctcctgtgaa

SEQ ID NO: 5243 - DNA, 1210 bp, mus musculus
gtcaggtgcctctgcccagcagtggcagcccaacactctgtgtcattgggagtgtacttaaatcgcaaggaaagttataacaagggggctggtgaggtgccaggtgcagtgctcgcccttctggaagtttcctggaagagggatggagacgtctgtgcaatcccgagcaggtcgggggtgccagcaacacagcctggccctgggaccattgcttccaagaaggtcactttggtttttacttgaccatggtttgttgcaaaattcctggcaccagctcagctcggccacgtctcggctccctggcgcctctagagagaacgaatatgctaaagatagtgaggcgtcttctctgggtgacctcgtgtgaccttgcaatcccgtcaagtctttggttctgcagaaacaactgtcagatcgggagttagtcacctccaaagacagaaaccaaaaaccaaaacagtgaccttgttctttctgttcatgaccctggaggtatggggggaggaggaggaagcggagattggttttgctcgttaactcattatcagtgactgagcggctactcatggctgggaacttgttgggtgccctccattacacttcccttaatcctctcaatggcttttgatatcctcaggtagatgggaggatccccattttacctgggagggatacaaggccaagaggggttaagtaacttgcccaagatcacacagcgtttgaagtggccaaggtgaaatttgatctaacttccacttggatgtgtgattccactccacatccaagttctttccatcatctggctgcaggcaagataacagattggtgtattctttctatcttatttgaattccaaagttagtatccgctattgaaaacagctgacttcattataacccatcattgactcctttctttaacaaataaccagcaaaacagagcgttctttcggagtaagccttccaccacctgaactttgacaactttctccctaatgggtttctccctgtgagtatttgatcttggccaccagcatgagcctatcctggtgatctcaaaatgctgaggtttttcttctgttaagagattgaatcttctgttccatgtggaggcttattcaacattaaagcgttcctgaaccatttcatttattcaacaaatattttccaagcccagctctgggccagatgccaggctcaaggcttagcaa

SEQ ID NO: 5244 - DNA, 799 bp, mus musculus
gatggtgtttgaaggtagactcctgaggacttgagggaaggaaggggttaaacaaggcactgggcaagcgtggggcagacttctcgtcaggaaatctggtatttcaggttggactggactttggagatggctgctcctttgttcaagtgaaaaaatgctttagatctggctgcgctctcagatgtgacttgtacaaaatgaattctagacttttctcgcatcaagaaagtgaagtggggccttccggtaacttgaacagactttaccccgggaatcccagacagcagcatctccgattccctaaagtgtgcacaattacagctgtggcaaccgaccctaggaaggctcagcaccacagcgaacccgagaatattgggaataaacttggaaatgtggagataggttcaacaaacctttgggtgttcagctgtttttttacacaaagccgtttatttagtattagattactgtgagatttcacattttctgtgagaggaattcttaagtaacagtgatagtgaagttgccaggtttacctccacatgattttgttttcttagtctctatattttgggattcatttatttatatttctccaatgaccagcacctatcctgtagattacttcttgcagaaactttttttttttagttgcttcatttaacctgtgactaattggttaaataaaaacaacatgtactcctcgtatttacaagtacatttcgttctgggccagataaaaaggagtaaattacactgttcattcctgtcgttttttatccctccctttccttcaaaa

SEQ ID NO: 5245 - DNA, 829 bp, mus musculus
gaggtgctcatgtgggcagggccgccctgtcttctgtgtggtgggggttccacctgtccagagagaattttgaacacatgttcctggtggccaccttgaaataagtcgttcccagtcttcttttacaaaaaagaaaggacttcctaggcgtgtggatctgaactgacccatgttttttcatttcaaatgtattttgcattttgcaaagtcttatctcactccctgtggcacagatagtgtcctgtggccacactgtgggcacacctgaaatggaattctagccttagctgctccggggcctcggaaacaatgccctgaatttgttcctctgaggttggcgtcgacacggggctcatgccgtcagataagaagacagacccttgcagcctccgtgcggtgtttccgagagcgcattcccctgagcagagcagggtctgcgctgtgtgatgggggtgcggggctctgatgaggggtttgtgggctcttcccaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctgggtgagctcccggccaagcctccccgtgagtcctggtcctgctcagggctctcgccccactggcctcccaggatgcccctgagcctcccttcccagaacctttctgagttcaccagcccccaacaacagcaccaagggcaggcctggggtgtggtggctgccctggagggcttttctccagggtg

SEQ ID NO: 5246 - DNA, 6047 bp, mus musculus
cctcacacatacctcctgccggcagaccccctgctgctccagggaggctcgcaggagaaaggtgccgtaccatagccagccttcttcttcttcttcttctttttttttttttttgagacgaagtctctcgcttctctcccaggctggagtgcaatggcacggtcttggcacactgcaacctctgcctcctgggttcaagcgattctcctgcctcagcctcctgagtagctggtattacagttgcctgccaccacgcccggctaatttttgtaattttttttttttagtacagacggggttttaccatgttggccaggctggtctcgaactcctgacctcaggtgatccacccgccttggcctcccaaagtgctaagattacaggcgtgagccaccgcatccggccccttattctcttcttagccagtctcttgtttcagagcagcctatggacggggggagaagacggatttcaaagacacttttatttttggtctttatggtctgggtttgatttcatattaagtccctctgtaatctaaccttccataacttaaccttttccagactgatgtcttttgacctgttggtttcgtgcgttgtctctagattttctagctctcttgctcagaacatccacctggagaaacaaacaaaaataaaaaaaaacaccttcgcagtatcttttgaattcccagctccaaagctatcttctccatgagagaattcataaatcagggcaactgatctgatttgcgcatttgaggtttcttatatactcatttcccaaatagttcctgcatgtgtgctaagcataattccaggtactgggaattagagaatgaaaaggccactttctcacagtctgcgtgtgtgtgtgtgtgtgtgtgtgtgtgtgtgtgtgtgtgtgtgtgttggggaggagaaataacaccaccaccttttgatacttactgagtgccagacactcttctgaacattttatatgtaatgaactgtgattgcatgtttaatcacacaacgacctatgagatggggactattattgtccccattttctagatgaggaagcgaaggccctgaggtcgcgggccctttggagcccaggcaggtcccacccaggcctttgggcactgggctccagtgccctcccctgccgtcttctccccaggtgttggaacagagggacagagcgaggttggtgagagcagcaggaaggaccttttcaacagagcccgagtgagatactgagtccctgaaaccctggcaggatgcgagagggcagaactgtaacaatattaagacattatttgccgttttctcatcctcttaggctgcactgtggcattttctagagactatgttaaggggagcaaggcagcaggctgagtgcagggggagcgggggtagagacgagaactcaggtgtcttctgtgaaggtggacaacaaagatttgcaaaaacaaaactgttgccactcttcttagtaagctttgttttcaaaaagttattttcataaaaatattgtttatgtgaatgtattatataatgtgtttgttttttaaatgagttaataagtattaaaattatcttttttgttgtcgtcgttgttttttgagacatagtctcgctctgttgtccaggctggagtgcagtggcgagatcttggctcactgcaacctttacctcccggtttcaagtgattctcctgcctcagcctcctgagtagctgggactacaggtgtgtgccaccacgcccagctaatttttgtatttatagtaaagacaggaggattttaccatattggtcaggctggccttgaactcctgacttcaagtgatccgcctgccttggcctcccaaagtgccaggatcacaggcttgagccaccactcccaggcttttttttttttttttttttgagacagtctcgctctgtcgcccaggctggagtgcagtggtacaatcttggctcactgcaacctgcacctcccaggttcaagcaattctcctgcctcagccgcccgagaagctgggtctacaggtgcgtgtcaccacacccggctaatttttgtatttttagtaaagacaggagggtttcaccatgttggccaggctggtctcaaactcctgacctcaagtgatctgtgtggccagcctcccaacacgctgggattacaggcatgagacactgctcctggactggttttaattttcagtgtagtaaatgctgatagatagatagatagatagatagatagatagatagatagataaatgctgatagatgatagataaatgctgatagatgatagataaatgctgatagatagatagatagatagatagagataggtgggtggatggatggataatcaactgactgaccaatccatttaaacaaaagctatttgggtccctcagtaactttttggtgtacaggggttctgagaccccaaagttgaagacccattgttgtagaagcttccctctggctgccgagtaagtgccgggataaggacagggaggcttgttacttggcttttgtgacctttcaggaaggaggtaagaaatggctgtgtctgagtttgtgtgtatgtggatttttttttttaaatgtaaactacagcaaaattttcctgtctaccattttgaagcgttcagttcagtagcatcaagtacattcacactattgtgcaaccaacctccaaattcctttcatctcacaaaaccgaaattttatacccattaaacaacaactccccggggtctgggtttatttaggaagtgaagccagaaggatttgctcttggcttggatgtagtgtgtacaaatgtctggtaaatgtttcattaattagagaggaggcagcggcttggcgcagtggctcacgcctgtaatcccagcactttgggaggcgaggtgggcggaacacgaggtcaggagttggtagaccagcctggccagcatggtgaaatcccgtctctactaaaaatacagaaactgagcgtggtggtgagcgcctgtagtcccagctactcgggaggctgaggcaggagaattgcttgaacctgagaggcgaaggttgcagtgagctgagatcgcgccattgcactccagcctgggcgacagagcaaggctccatctcaaaaaaaaaaaaaagagaggaggcagctttgttctggtctgtcttccttccagatgcaagccttcacacgcctactctgagccttacacgtgagcgtgacccccctccctgggtgccactctggggaaagtgcaggtacagcagaggtagcatcacatcctggaatgttgcacgaagatccttctggattgactcacacttaacagaacctgagtggttcattcaataagtaggccccgtctacttggaaacaacgttttcaagccatttctttccatcttttcagatcagcttaatcgaggagtcccctggttcattcatagtctgaggttataatggaagctgttaaccctcttaaggtgaacataaaaggaaaatggaaatatttgagctgtggaacagggcccccagtgtgcgtgtggagatactgctggctcagggagggattcatggctaccaggaggacgtctgacatcgacacttaggagccgagccccaggcaaagcaaagcagacaggggctaaatgatcatcttctcagggaagtgaggtcagcagcggccagaaaagcaaaagtagcagttctggtagagtcccaatcaagaagggacaagatagcacttctccagtgatccgggccatcaccgagaggagggtgggggtgtccctggtttacgaacgaggaacttgagatcagtttgtcagaggcatttgaaccagagcgactccatcttgaatagggtctgggtgaaataaggttgagatctattgggctgcattcctaggaggttaaggcattctaagtcacaggatgaggtaggaggtcagtacaagacacaggtcacaaagaccttgcttataaaacaggttgccataaagaagcccgccgaaacccaccaaaaccaagatggggacaaaagtgacttctggtcgtcctcactgctcattatacactaattaaaatacattagcatgctaagagacccaccagcaccatgacagtttacaaatgccatggcaacgtgaggaagttactgtatgtgctctaaaatggggaggagtcctcagtttccgggaatttcccatatctttccgggaaaactcatgaataatccacccttcgtttagcgtgtaatcaagaaataaccataaaaatagccgaccagcagccctcagggctgctctgcctgtggagtagccattctttcttccttcactttcttaataaagttgctttcacttgactctgtggacttgccccgaattcttactgcatgaagttcagtaacactgtctcgggggctggattgggacccttttccggcagtaagttaatgtacttaattaaggtcacacagctcataatagagggaggctggaattggaccccaagcctaactcaaaagtggattatttttttttttttgaggcggagtctcactctgtcgcccagtctggagtgcggtggcgtgatcttggctcactgcaacctccacctcccaggttcaggcgattcttctgcctcagcctcccgagtagctgggattacaggtgtgtgccaccacacctggctcatttttgtatttttagtaaagacagggtttcaacatattggccaggctggtcacaaactcctgacctcaggtgatccgccctcgtcagcctcccaaagtgctgggattataggcgtgagccaccacgcccggatggattattcttaaacactcttgttttcagtcaagtggtgggtttttctgaaattctgcagagttttattttaatactttattgtgttttgcatctttgctttacattattatttgtaatacaaatttaaaattaatattgggcagctgggtgcggtggtttaatgagtgagtgagctgagatcctaccactacattccagccttggcaacagagaaaaaagaaaaaataataataatactggggccaggtgccgtggctcacgcctgtaatcccaacactttgggaggccaaggcaggcggatcacttgagcccgggggttcaagaccagcctgggcaacatggtgaaaccctgtctgtacaaagagtaaaaaaaaaaaaaaaataagtcaagtatggtggtgcacacacatagtcccagctacctgggaggctgagtgggaggatcacctgaacctgggaggttgaggctgcagtgagtcatgattacaccattgtgctccagcctgggtgacagagcaagactctgtctcaaaaaatcataaagaagtgaaaatacctttctttgtaacttttcagtgataggctgaaaacagagatagtcttcccgtagccatcagtctttttttttcccttgatttctagagcaatttatttcttatttctggttgcttcatggattcagataatttcaacattacttattctggaatttagaatttcatctcatttgggtcttgataccaaattttgcgacagaactgtgagcactgtcttcaagcctaatgagagttttattattttaatagcaggtgtgtgtcttcaaaagtagtggagttgaaaataatatttctaaccttgtctatttttttctcttgttttaaacacagttaacaagcacaagccctggctggagcccacctaccacggcatagtcacagagaacgacaacaccgtgctcctcgaccccccactgatcgcgctggataaagatgcgcctctgcgatttgcaggtaggaacggggctttcattgactcttgatgaatcgggcctggtcaggaagcattctgcacatcccatttgggtaatgctgagcgtttctgaaaatgtctccatagctgagggttatttgtagcgtcctttgtagcatgtttttttttccttttaatagttggggtagctgacaaaaaggc

SEQ ID NO: 5247 - DNA, 1056 bp, mus musculus
aggacgtcctgtgcaattaattttttaatggtgtgctagagctgctttttgagacaatctgtcttaaattacatttgcctatttttagctcatattgtaaattgagaggaagaaacatccttagcttagcctgacttaaagccagataacaaccctgaagattctaagggcagggctgcctttgcaagtggggattcacattttcaaagaattcccagaagtcctaagacaaagaattccagcctgccgtcctcgccacggagcctgtggggcctgctgctgggtctgtcccaggctttcttctctgttccctccccccagcagtagctgacaaagaagcgccttccccttacaaaaggcaatgtatatgcctttattgaaggctgatttccttctaaacctgggggcctcacaggggccctttgattgctgttcctttggatagatttttcgctggtagaacgggctttgttttctttttcagtcgtgggctctcagtagattagagtttgctttgctttgtccccgcagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccaggtagaggagggtgcagtttgaggtgcagcgctggcgtcagtaccaagagataaagcccaagtcacatattggagatgaagcagaagggaaatttatcaaatgcagaaactacctactttatgacactctgtagcaaagacccaaaacactcttggccctttttccctgcagacatccagtccctccctctcatgtcccagtccttctggagtcttcggctcaatgagggaaagaatggccttttcttcccatttatacagagcgacaagcatcctctctcaggaagagccctcccatctggggcattaatcctcctttttttcttttctcagtgccagaactgaaagagcagattcaggcgtggatgagagagaaaca

SEQ ID NO: 5248 - DNA, 1102 bp, mus musculus
gctggctggcttctctgtgaccccacgtctccccgacagctgcagttgaactacctgggcaactacatcccgcgcttctggaccttcgaaacaggctgcaccgtgtgtgacgaaggcttgcgcagcctcaagggcattggggtgaggctgcgcccaggcctgtgcctgagggacacggggggctcagtcccctgagatggcgagatgggtgattctggaatagactccattgtctttggtggaaagtgaaggggtcacctccctgcctggggttctatcccggttgccacccaagtgcctcctcctggaagccctctcagattgcatgtctctagcttcccccgagatgtccaggttctggtttcttctgcctggtccttcaggctctcctgcagccccctccccatcccatgaacctcatcctcatttatgactcacctcgaacaccacgccagccacgatctcctgacagcaggccctcaaccgagtccttgttccaggcctgggctcctgctgctctctccccggggcaccctcctgctgcttccctgcccccccgtaccccctgactggagttccccggcccgggcacctttcttgggaagtctacatgcttctgattctggctctgactcccttgggccaccctggggtggagtggcagtgctgtgactggacactgctggactcttgtgccgccctccctggtgcaggatgaagctctgcccacggtcctggtcggcgtgttcatcgaacagcccacgccgtttgtgtccctgttcttccagcggctcctgcggctccactacccccagaaacacatgcgacttttcatccacaaccacgtgagtaacaggcgctctgtggggtcgtcatgtggcttagatccagggcccagcttcacaaggtagcccgagacctctgagggtctcaccgaatctagcttatctgggccaaatgacaatcaccagtggactgtgtccccaaatcactgagttaactttggagtcagactgggtgagtttgaatcccagcgccgctattttattggctgtgtgaccttgggcacattactcaacctctctgtgctttagtttctcat

SEQ ID NO: 5249 - DNA, 592 bp, mus musculus
gtcatctaactatagccataacatttcaccatggtcaactagaaaaagcagttgaggtattgtgatttgtcaagccatgtgggatataagaaacaattcataagaaggcctattgctaattttaatcatgtcagaagaaggaaagtttaacaacattgtccagggagtgcggcttcctctggcgttggtttctctctctgaaagtagacataatcctgactggcataagagaatgttaatgaggcttcagtcttgctagtaaatttttttgacatttgctctcagagtagcatgcataaaaagagtattattaatatttagctttccatagtgccatcattatgcattgcatcatgaaatcaatctaggagacaaggtccccctccagtctgcatgaagcatgagtttgttgatatttttagatcaggtacccgcagtaagcggaaatgaagctctggttttctcattgtaagggggttttagttggttgtcgggcatgctgcctctttgcctctactaagcacagtcttcacggattttataatgaggagccaggtggcatgaagaacattcattattaagaataatgaga

SEQ ID NO: 5250 - DNA, 1142 bp, mus musculus
catcattgcagaaagttctaccagacagtgctgccccaccacttggtaaccctctcacaggaccatgaaggatgttctggaaggaaataaattagaggcaaggaggcgtcacggccaaaggtgctcagggcctagcctcagaccatgtgtattagtccgttttcacaccgctgttaaagacacacccgaaactgggaagaaaaagaggtttaattggacttacagttccacatggctagggaggcctcagaatcatggcgggaggcgaaaggcacttcttacatggcggtggcaagggaaaaataaggaagaaacaaaagtggaaacccctgataaacccgtcaatttcgtgagacttattcaccatcaggagaacagcacgggaaagtccggcccccatgattcagttacctccccctgggtcccgcccacaacacttaggaattctgggagatacaattgaagttgagatttgggtggacacacagccaaaccctatcaccatgcacagaggaggagctcaataaataaatctctgacagctggtgccaaaggcctgctgtgtggcagtgatatgaagaacaggactgccagagctggggctgggggcggggaggccagtcattgagaggaggagccagaacagagcccaggacagcctctgctttcgcagcatttgaaaaacgtccgccgaaacagaagctggggtatgtttacacctgagaggatgtaagtgaggaaactgaggcccagcgagcttagccggccttcccgggaaacagctcactggggactggctgcaccctgccactcagaagaaagctttacaggttgctctgggtgttttacatgaaatctgtgtgacccctctctagccccctaataaaccacttgtgaggctgtttcagaacaaaatcctctcatctaggagagtttgtctcatttcctgcaagtgcctgagccctggctcagcagatgcccaaaatgttcatggttcagacatgaactgagcagctgcagggtcctgtaatggccagcagagggcagcaccgaacacgcccaagctcacctcgagttgcccattactcgagcaagcgggggaaaatgggcaagtttccccactttaaacgccttcttttgca

SEQ ID NO: 5251 - DNA, 2127 bp, mus musculus
tgctctgtgatcctgggcaggctcctgcccctctctgggcctcagtcatctcatttgcacaagggagagaggcctgaatgttcccaagagctcttcctcctctgagctctctgcctcctcttccagccaccctgtttcttctccttccctcctccatgccctggggcagagtgggggcacttccctataacactaagcttggtgcttcctccccatcccaccccatccctcagcagcctgcctccaccctgaggcctccctggaagagggggtgtgggcaggaagggtctaagacactttctctggagaccctcagctgccagaagcagcacctactatggtgttacggtgtttggtgcttcacacctgtgtcatgtagttctcagtggccctttagtctttaacgtctttagtcttcaatgagcctgtgaggaagagcccatcacgagcccacttggcagatggggaaactgaggctcagagaggctgagtggcttgcccaaggtcactcagctaggcagtggtaaacctgggatatggacccagggtcgtactcctgcctcttcttgggggtctgcacctcactgtgtggcctggtcctcccctcttcgtgactccatttcctggtcagtaagtgggcaccacagcgtctggccccgagggctgcagaggctgtgggtgcctccctgatacccggctgtccccagcgcaccagtggctgtacagggagattggggacagccacctgctccggtatctctcctggactgtgtaccctgtggccctcgtctctttctcttcaggcttctctcagagcatcacaccctcctctggaggtgagtccacagtcgctacgccagtccccactggccaaaaccttctcagatcccaggggggagtcgggaaggggcagcctcatttcacagacaaaggcccaggaagagtcatgtggcttgcccaaagggacacagcaagaaggccagatcttgacttttgggtcactgctggccctacctgctttccaggggctccgctgggacttgatgggaggcctggtgggaggatcttctgcgaagcctgttccagtggccagtgccagggaggggccagtggaggaggcacagctcccccaggccgctcagccctgcctcctgctccaggccagcagaggggagctcaaagctcactcagtggtggcctgagatttcatccgggcttcccctatcctgccacagccttctgccaggcctggcgggaggaacgtgaacaactcacattccctctgtgatgctcggtgtccaaatctgctaaatgagtttaaggaccttaccctaggctgggtgcagtgactcatgcctgtaatcccagcactttaggaggctgaggcaggaggatcacttgtgcctagagtttgagaccagcctgggcaacacagggagaccctgtctctacaacaaatagaaaaaaatcagctgggcatgattgcatgtgcccgtggtccgagctactcaggaggctgaggcgggaggactgcttgacctggggaatttgatcctgcactgagcagtgtttgcaccactgtactccagtctgggggatagagtgagacccctgtctgaaacaaacaaacaaacaaacaaacaaacaaacaaaggaatcctaacccagctgggcacactggctcatacctataatcccagcactttgggaggcggaagtggacagatcgtttgaggtcaggagttctagagcagcccgggcaacatagctagactccatctctttagaaaaataaggtgggcgaagtggtctccacctatagtcccagctattcaggaggctgacgcaggaggataacttgagccctggcaactgaggctgctgtaagctatgatcctaccactgtactccagcctggccaacagagcaagatcttgtccccaaaggaaaataatcctaacttcagagggttctgctgatctggcgagatcgtaatgtgaaaacatcacacaggtagagtgttgagatttttaacctagagattgtccccctcctggccctgcccacccccgccaaggttctggaatcccggaggtgaagaccatgttggcgggtgtggtcttggag

SEQ ID NO: 5252 - DNA, 787 bp, mus musculus
tttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggact

SEQ ID NO: 5253 - DNA, 1090 bp, mus musculus
aggagggcttgtacctcaccttccatctgttctcccctcctctgggccgaagccccacacaagcagctccccaggtccagggatgtcccagcctcatgggttcctggtctgtgccctttggttccatgctgggtgggtcccaagcaggggaaggtctcagctgttgtctagtgtgtaccccgggccagacccagtgctacccatgctgagatggaaagaagcccagtgcccccagagaggtcacaggctcttggggagggcaacagttataatggggctgtgtctgcaggcatgtacctgtcccagcaccacccatgctctttgaaaacagcctgttggccccctatcagctgcacctctgagccactgaatcagaatctctgggtgtgggcctgggacataaatatttttaaaaagcttcacaactggaaaccactgtgtgaaatgggtctaaggaagctttgcagaggagaaatggggtctggttttgatgactgaacaggaatttgcttgctggttgtgagagagaattccatgtggagggaacagacagcttaagcaaaggcctggagatgtcaaacaggtcaggtggcatggtcatggggctgaaagccattcgtgagagccagagcagagttccaggccaggcccggagccgatgagatccgagaggtcggtggagggggcgaatcttggagggccttgcttaggacccaggctccattctgacagtgatggggaagggtttgaagcaataaggtgatgtgacaggtgtgtttgcggagtgtctctgtggcagcggaggtggcaggtgggttggcctagcgtgtgtctaatgagagttgaaagccagagagacctctcagagaacacaggtacgtggaggagttctggtcctgaccagcccaagcacctggtctttccccccattccccaccttctttctgcttcaggaggtgggccctgcagagggcctctgaggccagagcttgacaagcgtgcttgggccagaaccgattccttgcttctctctgggcagggctgggtggccgctgcccagctcatcccagcagtccagctgctgcttccc

SEQ ID NO: 5254 - DNA, 976 bp, mus musculus
gcgatggagctaagacaggggccagccttcctcatgtccagctaagagctatagttttctttccagctcacaacttaggtcctttctctgtgcatcatggcttcttgccacctgagtttcttctacacccacccagcagccagagtgagctttctaaagtgaaatcaggtcacctgctgcttgaagccctccatgggcttcccactcacttgggatagaacccagtctcccatcaggcctaggataccctgtatgctcggccccatccacctggccagcctcatctcctaccctctccctcttcagcttcctaaacatcagcttccggacaccttggccttctcgccaagcttgttcttacctcaggacatttactcatgctttttctctgccagatacattcttcttctaccctggtgtcagatcaaatgtccctctgcagagatgctttccctgactgcctcacctccacccagaatttcccacccctgtgtcccatcattcttaacccattgatccgatttgtttgcttgttttttaaagcattgattactacccagtaagactcatttatttatctgaatatacattttcctttttccctctcatatcaagcaccccgaggataaagacttggtccccctgcccctcctctgtccccctagctttcagaatggcaccaggcagcccctccctagtcaggggccaatgtagatttcatatacggataagcgaattcctgatcagagggcctggctgttgggccatcagctggcattgagcagagaggcctgggttctagtcctgatcctgtgacagagccatagggtgagctggccagtcacacaatgtgtctgagcctcagtttcctttttgtccaatgcacaaatgtgtttgtgctggatgatgggaagccccctcagcttcacttatcggccccttcctcggtgcacgattgagagaaacaggcaataga

SEQ ID NO: 5255 - DNA, 534 bp, mus musculus
ggagacgacgtgcagaaatggcacctggaaaggggaaggaaaagaaggaagaacaggtcatcaacctcggacctcaggtggctgaaggggagaatgtatttggtgtctgccatatctttgcatccttcaatgacacttttgtccatgtcacggatctttctggcaaacaaaccatctgccgtgtgactggtgggatgaaggtgaaggcagaccgagatgaatcctcgccatatgctgctatgttgaccacccaggatgtggcccagaggtgcaaggagctgggtatcattgccctacacatccaactccgggccacaggaggaaataggaccaagacccttggacctggggcccagtcggccctcagagcccttgcctgctcgggtatgaagatcgggaggattgaggacgtcacccccatcccctctgacagcactctcaggaagggggtcaccgtggtcgccgtctgtgaacaagattcctcaaaatattttctgttaataaattgccttcatgtaaaaaataaataaaaaa

SEQ ID NO: 5256 - DNA, 534 bp, mus musculus; identical to SEQ ID NO: 5255

SEQ ID NO: 5257 - DNA, 3698 bp, mus musculus
aaatcacatatttggagtcagaatagcagaactgttaagagcatgggctttgaccttaaaaaattctagaggggagagtatggaggcaggagggggccagttaggaggccaacggagtcatccaggggaatgaggacaatgaccgagtggtggacagaggacacagatgggacagacttttctcagggagaatggagttgacttgggaagaggttgagtgttgcgggtgaggcagaggcaggagctcactatggctccaaaggttcagagggggaagagagcgtaggagcactgagataccgttactaggacagggagcacaagacttgggccaggagatggtgagaagctcttgcatctgcagtgttttcaagacacggcccccacatacactcagtggtcccccatgagtaaacttccttcatgccttgggtcttagctgtttggggtttttgtttttctgtctttgtctgtccactggactgaacagttgaacatactcaactccttgggggttaccgccaggaagccttcccttatctgtcctccagaccagggcattgttccacctgtatgcccagcgacccatctctgcaaccaccacactgtgcaggaactctccatacctgctacccctccagtctgagctcgggagggcaggggctaccttgttcatctcagagttcccagtgccttgcacacagctcagtatagcaaagatacctggtaaaggttcgtgaaaagaagaggtaggttaatgctggctttgtcaacaaggagatggtccataggctctggactcagatctgggttcaaatcttaactctgccactttccagtctcatgtgacctcgagcagtttatttaacttccctaagcctcagtttatttatctgtagaatggggctaatgatacccatgctgcagggtgattgcaggaattaaatgagatgatgtagccgggtgcagtggctcacgcctgtaatcctaccacttttggcaggtggatcgcctgtgctcaggagtttgagaccagcctggtcaacatggtgaaaccccatctctactaaaaatacaaaaattagccaggcatggtggtgcacacctgtggtcccagccactcaggaggctgaggcaggagaatcgcttgaacccgggaggcagaggttgcaatgagccaagatcgtgctactgcactccagcctgggcaacagagcaagactctgtctcaaaaataaataaataaataaataaataaataaataaataaataaatataaataatgagatgatgtagacaaagcacacagcacagtgcctagcacatagtaggcactcaataaatggtagtggttgcttgctgaatctctgagttactttctttgccctagttgtttcttcatccagaaaatgaagataataccacacttactcctaccacttaggatatttttgtggttttttggttgtttaatttttgttttttagagatggggtctcagtcacccaggctggagtacagtgatacagacatagctcactgtaacctcaaactcctgggcccaagtggtcttcccccaccccagccttctgagtagctgggactacagatgcatgccaccatgcctggctaactttttattcttctagagacagagtctcacaatgctgcctgggctggcctcaagcagtcctcccatctcagcctcccaagtagctgagattacaggttcaagccactatgcccagcagtcaggctacaagtaatagaacacagtactaagagagatttaaacaacaggagatttgtttttttcacttaacaagaaatcccaaggttccagggttgattcagtgcctcaagaggtttttggcgctgggcgcagtggcttacgctgtaatcccaacactttgggaggccgaggcatgtagatcacatgaggccaagagttcaagaccagcctggccaacatggcagaaccccgaatctattaaaaatataaaaattagccagacgtgagtggtacacactgacaatcccagctactaggtaggatgaggcacaagaatcacttgaacctgggaagcagaggttgcagtgagctgtgatcgtgccactgcactcctgcctgggtgacagggtgagactctgtctcaaaaaaaaaaaaaaaaaaggcctttgggttggcttctgaacagttctgttggccttcccctcctgatcacaaaatagctgctgcagctccatacatcacaccctcacaggacaaggcccaaggcaggaaggaagagggcagagggcagggattctccccaagtctcccgtcagggaggacatctttcccaaaataccccgagaagccaagaagccttcctttggtgtcattggctagatcctgtcacgtgcccaacctgcaggtacaggtacagggaagcctgggaacaaatagaggcttttgctgttttcttttctttttttttttttttttttttttgagacagtgtctcgttctgtggcccaggctggagtgcagtggtgtgatcttggctcactgcaacctctgcctcctggattcaagcaattctcttgcctcagcttcttgaatagctgggattacaggcgcacgccaccatgcctggctaattttcgtatttttagtacagacggggtttcaccgtgttggccaggctagtcttgaactcctgacttcaagtgatctgcccaccttggcctccaaagtgctgggattacaggcgtgagccaccgcggccgcctggcttttgctgttttcaacctccatcatgggagatgagttctgccagccaggaagaaggggctggggaattactgtttcagagaagctgttggcaacaccatccaagagggtgattgtaaggagggtatgtgttgatggcccttgcagaacctgacaccaaactactaccaagcaaatattggttggtcttgttgttaataatgaaactcctacctgataaaccagtacctagccaaggaagagctttgtgtactttgtttccatgaacaaatgtttatgaatctggactgtgtgccaggcccatactaggcgctacttaggagggcacataaggcagcgagttactgtcctgtgtctcccacccccactccacaatatccaagcgttgttataaacacaggtggctgttgcctggccataagcatttgccgtggagtgtttccttctcgaatgtttcccgttcagtatgccggttgtttccacatggttgctctgttttctgatgcacaaaacatgttttttaaaaacctcaatattggccgagtgtggtggttcatgcctgtaatcccagcactctgggatgctgaggcgggcagatcacttgaggttaggagtttgagaccagcctggccaacatggtgaaaccctgtctctactaaaaatacaaagattagccggatgtggtggtatatgcctgtaatcctagctacttgggtggctgaggtagaagaatcgcttgaatccgggaggtgggggttgcagtgagtcgagatcatgccacagcctgggcgacagagcgatactccatctcaaaaaataaaactaataaacaaaataaataaatacctcaatatttttaaagcccagatatgctcttggttttagtaatctttagaaaacactgtgtggccgttcttgatc

SEQ ID NO: 5258 - DNA, 376 bp, mus musculus
acttgtcacgtcctctgacagcaactcagtgtatattatctcatttaaacctttcatcctggggaggaagatattggtattatctcctgcagtgccccctctgggggtcttctttggctcaaccagatgttagactcacaagacccaaataggacataaatggcactggctttgcctagaaggatgcagggacaggaaagagtgcgtctgcgggagggcctccagcatttctctacagagagttcccataggagaccgcacggcagtctagagctcttctctggcccacccaggcaacagcctaggtgcggggaaacaagaccacagcgggtataagcctcacatcccgaatcttgtaacagtcccaaagacaaag

SEQ ID NO: 5259 - DNA, 570 bp, mus musculus
tctgtgactaccctctgatcacaggaatctggccaggaatggtggtgcttaaaagacacacattgaaacggactgctagagccatggaccctttaaactgtaggctcagtaatgatttttccctgctcagctccctggcacaagacctcagtcatgaagcagcttctgggactgcagtcccatctcagtctgggtcccagtcttgttcactcctgtctttggctgagctcagaccagagccccggtcagagaattagtgtgcagctggtggtggccggagtgtgctgcccagaggccctttctgccttcccttgcagagtaaacataaagttaatgagcagccaggctccctgccctcagggcacacagtagttgagccatcaagggaagaaatggccatgaattatttaaggaaactcagagcacttgattttgtaggagagaactttgaatagaagaggctttgctctctgcatttgatcttcccagtgaagagcctggagcatctttgaccctgggtgaaggctgggcctctggcaagtttggggttttgaagaattttctggtggt

SEQ ID NO: 5260 - DNA, 912 bp, mus musculus
acaaaacagtgccccaccctcaccccgtcaaccgtcagtgcagcagtgggctgggtgcttgcgtcccacagtgaggaaggcagaaggggtccctgccctcaaagggggagacacagtgcaaaggcagacaccaaatgagtcagtacaagcacggtgagtgttctacaggggacagtccagagtggcaccagagtgtataactgggggtcagggaaggctttgtgaagacagtgatatttacgctgagactttgaaggatgagtaggagtttctcaagtgaccggatggagtgttccaggtagaggaacagcctgtgtgaaggccctgggacacagagcgttcattggatttaagaagctgtcactgtctgcaagtccccagggccaggtagaacccctaaccctaatctcagcccaggatgctggtatattattgatgttaattccaactatcatttattcagcacctactctacctcaggctctttgaatctgttatttcacttgggtgcagagactgtcctgcagcccgtgaggtctccccaaagcaagattgcaccccagcaagatgtgggggcgcctcacccttctgtcttcctgaacaggttcagggcggactctccgggagactgtcctggaaagttcgcccatcctcaccctgctcaacgagagcttcatcagcacctggtccctggtgaaggagctggaggaactgcaggtgagcgggcaggtggcaggaacaggagcgtccggaacagtggtgggggccgcggcatcaggagtgtgcaactgtccccacagaacaaccaggagaactcgtcccaccagaagctggctggcctgcacctggagaagtacagcttccccgtggagatgatgatctgcctgcccaatggcaccgtggtaggcaccc

SEQ ID NO: 5261 - DNA, 582 bp, mus musculus
cgcggtgttctcgcgagacttggttctagctgatcatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtaagagtgagaaagttaatagactgggcctacgggcctggaacagaggcaccttttcagaggagtggtgaggataagtca

SEQ ID NO: 5262 - DNA, 532 bp, mus musculus
aggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgag

SEQ ID NO: 5263 - DNA, 1049 bp, mus musculus
agacaagtcacgccgcctctcttgagtgggctttcccatctccacaatgcttataagattccctgtctcactgcgccgtcaagatggcatgtgataatgtgcagggcttattatgtacaatgcccagcgtcatgggtgctgagtaaatgccagtcgttattactgggcttggtggtgagcagtgaaagtgagcaggggctcctgcctgggcatctgtggacacgacactggccacaaacaggctccgggctcctgagtcctcagaaattgcaggctggttttcactagtgggtttgatttttctgagaaaaggacccatagcttccatcaaactctcagaggggtctgtgacccaaagaaggttaaagcccttcctgtggggaagacaattctggtggcgcgatccgagccaggagcctgtgagcaatctgagatctgtcccaggggctcctgggaagggcctggctcctcccgcagctgttcctttgctcccttgggcagagaagctggcgttcggagccagcctttccagcctcactcctcgtggcttgtcctcgcagtgggtgcaggttgcaggaacagccgggacagatggtccctctgcgggcccctcgcctccacccacatgcctgtctggaaagtggctttggcttagctgtaccagagcttcttcctggaggaaactcaaagccaattgttgggagtgggtcccccgaggatggagcaaagctgccgcagggatgcggctggggagggagggagtgtgggaggagggaagacggcagggcagggagccctggctctgggttctcactggggctccccagttggcccatcctgcccatctctaacccaggccccactcctctccccactccctgatcagagtatctgcggggactgtgtccaggggcagagggcccacccagggtacctcgtggagaagggagagaagggagaccagggcatccctggtgtgccaggcctcgacaactgcgcccaggtaagggactgggcttggggctgccctatgcaggagggttccctgg

SEQ ID NO: 5264 - DNA, 1982 bp, mus musculus
ggggcgacgtgaccgccgaggaggcagcaggcgcttcccccgcgaaggccaacggccaggtgggtacgcttggcccggccggccccagcccctcctctcgcacctcgccccttctagggcccggggccggggccggggccgcgcgctttgtccggcccgggacacgcggcgccccctcccccgcccggtccctttgttctcggcgccgcagcccccgcgggcgaagcgaggggaggggcggggagggggcgccggccgggccctgccgccttctttgttcgcggccccggtccccggcgctgccccccggccgccccgagtgccgcgcggggaacaaaggcgctgctgggccacgccaagggggcgcccaggggccgcggagctggggcccggcggggagcgcactccacccgccgacccgacctcggtggcccacggtctttttttttttaagggggagccgagatgcgggagagcctggggtgggtgggggccacttacacaaagcgggaggctgggaaaataggccgtccaggtgcagagagacagcgccccggggcggcttcccgcccaatgtcgcctagagcggctcgcccgcctgcccgggatccgcacagcagatccggagcggttccgcgcggaatagagagcgcgccccgggggacgggggtgggggccacgggaccccagcgcctcctgccggtcgcgccctctgcgcgctcgctccccgcgcgcccgtgaggggcgagagggaggtgtttgacgggatcctgggtgtgggtgaggctgaagccagactttcgggttgcagtagaatcgaatcgaggaccccttcctctagaagggatcagaagcgggctgggggagggggagcccctgccctcattgctattccctctgccctgcaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggc

SEQ ID NO: 5265 - DNA, 568 bp, mus musculus
ctaattgtttctctacaaaaaccaactggaatacaggatagctctgtcctatagcaacctaaaccagcacctcccttgatgtgcatatagaaaatctatgtcttgtggccgggcatggtagctcatgcctgtaatcgcagtaccttgggaggccaaggtgggcggatcacaaggtcaggagatcaagaccatcctagctaacacagtgaaaccccgtctctactaaagatacaaaaattagccgggcatggtggcgggtgcctatagtcccagctactcgggaggctgaggtaggagaatggcgtgaacccgggaggtggagcttgcagtaagccgagctcacaccactgcgcttcagcctgggctacagagcgagactccgtctcaaaaaaaaaaaaaaaaaagaaacaaaatatatgtcttaaccaacttggaagaaaaacaaaattctgtgtgtggaaatatattttttcaagttattcttctttcaacctggattcagcctcaggctgctgctgacatcagtgatcctctctggggtgaggctggagggcttgcattgcactgg

SEQ ID NO: 5266 - DNA, 513 bp, mus musculus
actctttcattcatttgttcatgccacactgagctgcatgtcagagtctgtgctaggtgttgaggaaacaaatataaagaagaataagacattcccatggcccctgtcctcagggggttgagagtttattgagaacagcgttaaacagcaaagcatgattgattactccagaagagatatagcatgtgatggaaataagaagggctcctagctcagcctatgggaaagggcaggtgagaaccagcactttctaggaagaaagcacagagtgggccagctcagggagggaggacacagtgtgtaaatctgcagcactcacagggtaccaaggaagggtgtggggtggaaatagacctctcttctgactcaacagtctctccataattgctggctttcttatttgtccctgctggtggatgggcaactctaggatggaaacctcttttctcccaagtcccagggtctgtattgtatctggcattctctctcctcagatgtctcataggagcccca

SEQ ID NO: 5267 - DNA, 573 bp, mus musculus
ttggggcctgcctttgaaaggctcacaggccagaatttccttctagttgtattatttctagctggctggcctctggcaaggcagggagggtccctggtcctgctccatctcaagggggtcctgtggcaacaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggtgagtctgtagttacagtctgtccagctagatcattctaccgaaaagcgttaacacaaggacacccctccccacaaactgagctgtgccaggcttcctgattgggccatgagatatcccttagggttatttctgttttggggggcttgttcccacaggactcctcggctgccaggtgtcacttgccaaccccagattt

SEQ ID NO: 5268 - DNA, 1062 bp, mus musculus
tgcagatctgtgggtgggactctgctccatgcaatcattcagggactcaagctcctttcatctagttactccatcgtctcttagggactcagagtcctccactcgattgctgaaatagccagaaaacaagggagaaggggaacataaagggtctcttgaggggccaagcccagaagaggtagagtcacttctgcccatgttcatcagcatgagtcacatggtcctacatgccagggaaatatagggtgtcatggaaggaggggaaaacgctgatgctgatgctgatggagaattcgaagtcttgccataaattttttaagtgcttctttgagtatgaattattttcccaagtgccttggaagaatatttctgtgagcccctagccagccccccatacctgtggttattccccaagtgggaccacctgactacacagggctagacatagaacttttattttttcaagttagaggaagtggacctttcaggcttatagagcaaaatctctctatatattttcttccaacatagctgagtaaaagggcaaacagaaatttgaaagcaatgattgcttcctttgtcggggagaaggatacccactgagttgggaacatatatgaattctgatttgcaatcatttccactatttatgaggtcactggacttactcctgctgagtccaatttacaaagagctttggttggatcagggaaaggaatattagaatcctgttgacttggtgatggccagagtactatggataccaaatgcaagaaaagtatcaataaacttcaaggaagcaaaatcctcaacatcagctctgacatgccacatccaaaagtgtacaaagatatacgtttccagggaaactattgatgttgggtgcaccaacattgctatttgactacacaccccagaagcaagtggggggattttccaaataaaaaacttgttagaaaaacatccaaaatgcctaagataagcaaaagagttttccttacatcatcagcatattccactcccaaggcaattgtaggatgctgatgctgtctgatcattggt

SEQ ID NO: 5269 - DNA, 712 bp, mus musculus
aggtggtggggcctagatgctgacactatggataactacacccattctggactacctacctggttctttttatttaagctactgtttttctgtcactcaaagccacgtgcataatcctaagtaatcgagatagagtcattcattcttcaaaagaatattcatgtatgctagacattgcatttcatgctttctcagcgctctccatttctcccacctgcccctctcaaatccattctactcaccacagccagagtgacctttccaaaacacaaacccaactgtttccactcggctcatgtcgtctgtgactccccattactaacagaatcaagttcaagctcctcagcctgccactaagggtcacccctctttgacccttgcctactccgagcacaacccttcccccgctgaccatgcaccctacacactaaccaccccggacttgttgcctttcctagtaaagtcttattcattcatgtcactcggcatttgcacacattgtcacctcccttggaatttccttctttcacgtgctcatgttcaaattctaccccatccttcccactgtgtaagtacctagtatgtgttatgaactgtggtcagtgttttcacagcagcaactcatgggtaaggccccttactatcctcattttacagacaaggaaactgagactcaaagaagggaagtgagttgccacagatgagtattcat

SEQ ID NO: 5270 - DNA, 1146 bp, mus musculus
agaatagaagtctgcactaggtgtgttcatacacagaatgaaaaagtccagaaggcctacagtaaaattctgaggaatattgacatctgaaatgggggtcaaggaagtggagcctacatggagactgaagattatcaaagaggtcaaaagaacttaaagattactgaaattaagaggaaaaacattttctggaaaaaggcaaggtcaacagtgtgaatgctcctgagagaccaaatgaggcaaagtgtcctagaatcagttagtcattggtgactttggagagtaggttcggtagaggcaaaggctagactgcagtggggttgaggagtgaatgggaggtgagtggatgtttataataactatgcatagcactttcttccaaaaacttctgctttcccagaggaggagagaaggtagtaattgaaggagaggcagggatgagtgagggttttgaggtggccattgttgctttttgaagctgggaaaggcttgggcatgtgtaagtgcatataggaaggagcctgccaaagataagaggttgaagatccagtgggagagcatagggcctggaatggggcaggtgctccttgaataccaaatgttttctgaaacaaatgagcagggagaaagttcctgtgggtacagtctctgggttttgtcacaccccactaactgttctaaaaatgttgctgtgcttcctctttctgaaacagccaggacattaagaattgcacaaaaaccaccttttcaaactccctagagagggctcaatttcagatcccagccaaggtgcttcctctctgaagtgcctatgtggctggattggcccctcctccaacagcacctaaccctggctcccagcacaagggtagatccccaaagcagcaacaaacagaaaagtttccaatggggcttcttgaccaccagggtcgatgtgcctggcccactcttgaggaatcagcatggccaggcatattctctaactgatgactttatacccgctttgaaaaggcattgaggctgactagataacctaaacagcttgaaagagtgtgcttagagataataatgttattatatttaattcagataccccttcaatgtcagtcattcccctttataagctcctactaccttgtgtaaggt

SEQ ID NO: 5271 - DNA, 935 bp, mus musculus
tgctgtgggagcctctaatccatttggggtggtggtcagggaaggcttcctagaggcagtgacctctaagtgagacattatagccaaagaggagttgtccaagcaaagagaaagagaactactttagtatgaggaaatggaattgcagacactatcctgaaataaagagaaagtgtatactgttcaaagaattataagagttcagcatagctggagtagagagggaaaggaagggatatgacctagccacttccttttcagagagctccattatggaaaatcctttctgtctgaactcccagcacggtagttacaggcttctgcaagttggccctaatttacttttgcaaatttatctctctattttgtacactttgcttttgctgtttccccaccaaggaacgtttcctacagtgggctcttaggatttgtagtttctcataccatttttggaggtagcagaatccctcttttctataggacacccattccatgtgattcaggtgagctcaccatgatctgaacccactttcaggctatgttgcacaaagaataacccattctctgaccatagtaatgggttcagggatgggcacataacccacactgagccacccagagtcctcccttatctttttctgttggaactagcattcctttggtgttgctcagctgggaagacatgagttgggactgccagactgtctttccagccccagaaaggagtcattctgaggaacagtgctaagtagggaaaagcagaaccataagatggcaagagagacagaggcaagataatctcacctgagctcctggatggaggcctgccaagaacagctgtattattcctggacttctcagttatgtaacccagtaagttctctctcttttgtttgtttcttaagctgctttgagttgggtttttgtcacttcaa

SEQ ID NO: 5272 - DNA, 1036 bp, mus musculus
tcgggggaattcatgtggaggtcaaagtggaaacaggtgtgagaggtccagcagaagaaaacatggctgccaaagtgtttgagtccataggcaagtttggcctggtctaagctgttgcaggaggcgtggtgaactctgccttatataatgtggatgctgggcacagagctgtcatccttgaccgattccgtggagtacaggaaattgtggtaggggaagggactcactttctcatcctctgggtacagaaaccagttatctttgactgccattcttgaccacgtaatgtgtcagtcatcactggtagcaaagatttacagaatgtcaacatcacactgcacatccccttccagcccgtcgctagccagcttcctcgcatcttcaccagcatcggagaggactatgatgagcctgtgctgccatccatcacaactgagatgctcaagtcagtggtggtttgctttgatgctggagaactaatcacccagagagagctggtctccaggcaggtgagcgacaaccttacggagtgagcagccacctttaggctcatcctggacgacgtgtccttgacatatctgaccttcaggaaggacttcacagaagcagtgggagccaaacaggtggctcagcaggaagcagaaagggccagatttgtgatggaaaaggctaagcagcagaaaaaggcagctatcatctctgctgagggtgactccaaggcagctgagctgattgccaactcactggccactgcaggggacggcctgatcgagctgcgcaagctgtaagctgcggaggacatcgcctaccagctctcacgctctcagaacatcacctacctgccagcggggcagtccgtgctcctccagctgccccagtgagggcccaccttgcctgcacctccacaggctgactggaccacagccctgatgatatttaacatcgacttccttctgcccccaccccagaaatcactgtgaaatttcatgattggcttaaagtgacggaattaaaggtaaaatcacttcagatctca

SEQ ID NO: 5273 - DNA, 883 bp, mus musculus
gctagtaagctcattttaaaggtgaaaaaaaaaataaagcttagtgaaattaaacaacctgaaaaaagtcacacagagagtaaattattgcgtctgattccaaagaactctgtgctagagtaactctaatttttttcacattcagtccacatcctgaatctacatatcagtgtagttttgctaaattaccctctttggggattgagttgcagcctcatgacataatgactggtgatatcaggtccttcttagaaacgtgctgttcatttctggctaatgttccctagacaatcagcacagatactgaaaccctgatacatccatggcagtgacaaaagatgcagatggaaagtagaatgacagtgggtgtgtgctggaaagcaccccagcctggaaggctggataccaaggttcccgtcccagttcagttactcactaattatatgatcctggtcagatcatgacccactgttccccagttccctccttcatgtattccctccagttctgattctgtctcattttaggtaatatctgcttgcgtgatgagtcaaactgggatctggatcataaaagtatttaaagccttcactttctacgctatgcgattatagaatctgttgaaattccagggcctggcttgctaattgggtttacattttgcttttataaaaccccacatgataaataggaaaggttcattaaccaggagctttataacagcaggaatcatgtttggttttctcatcattatatccccaacaactggcacagcccctggtacacgatgaactccagaatatcgatttacttattgactgacacagacaatgttattgctagatgtatgtaacaaattattctctttctctccctgcccaag

SEQ ID NO: 5274 - DNA, 123 bp, mus musculus
gatcggtcgcttggttatcggacagaatggaatcctctccacccctgctgtatcctgcatcattagaaaaatcaaagccattggtgggatcattctgacagccagtcacaacccagggggccc

SEQ ID NO: 5275 - DNA, 123 bp, mus musculus; identical to SEQ ID NO: 5274

SEQ ID NO: 5276 - DNA, 123 bp, mus musculus; identical to SEQ ID NO: 5274

SEQ ID NO: 5277 - DNA, 573 bp, mus musculus
aagtgatggaaaagcttctctctatgtcttcctcaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtg

SEQ ID NO: 5278 - DNA, 573 bp, mus musculus; identical to SEQ ID NO: 5277

SEQ ID NO: 5279 - DNA, 573 bp, mus musculus; identical to SEQ ID NO: 5277

SEQ ID NO: 5280 - DNA, 2184 bp, mus musculus
ttgaaaattaactgattttcctcaagtttgtcagagtttctaaagtggctttggaaagggttccattgcacacgaagaggaagcttaagttagacaatgtttgtccttatcaataatccatacaaaaattgtttatttcattttcttggactttatatgcgatacctttcagggaggctgcctacctcataatagccctctgttgtctgatagctgctttcacgacccatcatgaggggccttcagcagccatgtttgaatttataaccctgtccttctggtgagagttgattggaccagggagaggacacctggcccaggttacgccagagtctctttcccaggaatttgcaattggaactcagaggtagcctgttagtgtttgtcagttgctgttagtgccaagagatcaatctgggggccatagagtgttgatcttctactgtgtgcatagaaaagccaagaaagctggttttcaaagagagatttaagcagattcataaagagaattagagtctgggggtggagggagattcctgatctggttcccggcagctttccagttcttggttctcgttcctcccgaaacctggccagacatcttgccagagtttcacaagaaacccttgcatcctgtgttaaattccccatccacctcgtctgcttttcctcaccctcttacactggcttgagttagttcctgttgcatgtaatcaaagagtcttaacaaagacagattgatacctctctggtgtgtatttgattatagagatggccaagtaaacacatagatggatgttcatacttgccctttggtaccctagaaggtttgagttgggaacaaacctcagagatctcctagccttatcctcacattagacagatatggaaactgaagactatagacaggtaaaataagtgatttacccagggtcacacagctaggactcgatccctagccttctggtcctcaggccagccaatgttctttctaggctggctccctagtgccatccatccatccatccacccatccatccagtaaatataaactgagcaagattctgctacatgacaggtactggggtacatgttttttgtcctcaacaaactcacagtgtggaaggaccaaagttctttatgtttatttttacttcattccctggggtttcccatctggagggcactttactaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatctgtcacaagatacttctccaataaatgtctgcttttctagagaatttacttcactccttagaatctcaagtgagagctgtgtatcagttagctcctgctaggtaacaaaccacaacaaacatagtagcttccagcaacaatcatgtattattattctctctcctggttctgagagttgactgggatcagctagatgattcttgtgcagagtctctcatgtggttgcagtcagatggtggctgggtctagggtcatcttaaagactttgtcattcacatgtctggtgtctcgactgagaagacaaaaacagctggagtctggaacagctggggctgtttcacacacaagtgttgtttgcacaagagatgtccaagagcttctctttattctctccaagcactctccatgtggtggcctcagggtaactggtgactgaaggctcccagagggattgcctcaagtttttttaaacctgactctgaagtctctcacacagtgtcacttctgcaacattctgttctcagaggtcctgccacatgcaagaaagacacgatcacagaggtcctgccaggtgcaaggaaagggcacacagactccaccttctcatagaaggagcatcaaacaatttgcagatagttttctacatctctgcttgatatgtcttcctgcatgagaaatatgaaaaaatgaacacttttcagggagctttcatttcagctggaagccatgattttcagacaactgatagtttctggcttcactgacagctacatccattgcaactagtttgct

SEQ ID NO: 5281 - DNA, 2184 bp, mus musculus; identical to SEQ ID NO: 5280

SEQ ID NO: 5282 - DNA, 849 bp, mus musculus
atctttgcaaaaggtctgagtccatcttactcggactgggtgagcgcattctgtatacactatgtaggtgaccacagagtcaggtgtaactcttaccttaacctctactctaggtgacccgcaacctcaaaaatcatgtacctgtctacctgcctgccagcttcccttcatttttccaatgagtatttattgagaacctgggataaatgcagtttgtttcagggctagcaagataaatgctctctgaatacgtttgaaaaaaaaaaaaacagctgatatgaatgaggggcataacttgttttggtacaggtgcttcataatggaggacaggggttatctggtggcgcacccgactctcatcgaccccaaaggacatgcacctgtggagcagcagcacatcacccacaaggtatttgtcacaaagctgagctgctcagttctccaacctcctgcagctcactacatggcatatgtcttctgttctctttggccttggtaggagcccctggtagcaaatgatatcctcaaccaccccaactttgtaaagaaaaacctgtgcaacagcttcagtgacagaacggtccagaggttttataaattcaacaccagccttgcggtaagttgatctgattccttaacactctcatttttccatcccattatggaacatgaattggaatcatggctagtgtctgaatattattcctacctgtttcatcgccttagaactatagaatgataggaggagacaggagcttagttccagttcccagtttgacaattgggagatataaagctcagagtagaaaagtaaaagttttaaggtctctcagttggtattttgttttg

SEQ ID NO: 5283 - DNA, 678 bp, mus musculus
cttattaaaatcgtatataaactataagttaaaagaccttcaacgggttctcttatgggtagaaagcattgttttaaaaatatatttatagttaaatagcactgaacaagaaaattgtgaaacaaaagtgacttagatgtggatcctatgtgtaaggagtttgtattctagaaagaatgataagctaaaaaaattagaatggaaggtagaaagagaaaagtaccacatgagagatgcaaatgaaatacaatatgcatttggatgaggaagaaagtattattaactagagtgaacagggagcacttcagttaagtgtcagagtttaaagtgatatttagatgtagcctagttttccactaggaagagtgacatgggtgtggttaaggaggcatcccaggcagcagaaatagcataagcaaacccggtgtgagatctctgtccagacatatttgtacccagttggctaggaacatggcagatagaaataaagataaatattttaagaaataaaaaaagagactaatggattgttctgtagggagccaaccaatgaattaggggcagcatttaagatggagtgcctcattcaaatgacaagcatgtattgagtgtctaatttatgctctgcagaagccagattgcactagttgtgtgtattaattacattgtatgagttct

SEQ ID NO: 5284 - DNA, 569 bp, mus musculus
tatttaatttacacatgaggaagtctcactttaatcaatgagattaaattacttgcccaaggtcacacagagattcaccacttctctgattatcatgtcaatgaaaccttgtcttctaactagatataagcttttcaagggctgagactctgtcttgtgtctatttaaagcaactccacaggtatataacagaatcctgggcatggggcccccttgtaggcaaggcttccaacaggtaacctgtactctattagcccaatgttctacctgctgtgttccgtcttcaccccccatttacacccatccatgcacctcagatatctggcacgttacattgctaagtacttttccaaactacctgtcctgggtagtcttccacctagcctggtcataattgtctgacattataacttgctccttcttccttcagtaggagactcctttactttaacataacagatcttggtcaggtgaatcgaggaaagcagttcaattaggataactcaagtaagcctgaagtcatttggtcatcatttattgaatgtttttattgttccaagcactacgat

SEQ ID NO: 5285 - DNA, 170 bp, mus musculus
catactatgggaattcaagtgattggctgaatgatagtattttcaagatttaaaggaacttataaaccatttagttacaagctcttctaattaaaggtgaaaaaactaaatcaaggagaagaaaggaaacgaggaaaatattatacagatagatattagcagaaccagat

SEQ ID NO: 5286 - DNA, 1042 bp, mus musculus
aggcaaacaagtccatccttagtgagcagtgggggtttaaagaactcttcacaactgatgctgctgtttcaagtcaaccatttggttactcctgctccatttctacctctataatggaacatttattttgtacttgttaccaagtcccctgcttaattctgttttctcatttgtttatgtcaaaaaagtataatgtagaaacccatctgatgcaataatattgttttttttccttgccttaagggagcaaaccccaccctccatgcaggttcctgtgcatccaactcttggtgaccgcagcatgctaatgtgtagcatgcaatctggagtcataatgaagctgatttgctattaagcatgacaacactttgtacacccatttcttcatcagcaaaattagagtaactagtatttgcctcactttgtttgaaaggagatgatactgtttttgtgcttagtataaagcttgatatataataagaactcaggagataacaatatcccatttctgtcctttatctattaatcacactatattttactgttcagtattgtttgcgctaatcatttcatttctccacactaacctgacccagtgggtattctacattttagctgctatagacaattcaccaacttcaaatagaaagtttatagatagtataaatgagaagttagaaatgtgtttcataaacacactcatccacataggcttatgtatatgaactcatgtatatttaagttgaatataaatgggtcctcaatttatcagaatcttgtagtcagagaattatttcttctatattgtccagtggactgaaatctgcatgcttcttaaaatacaatacacaagaagttaaaaattagtcttaatgaaagtgcatatactgcaagccaaaaaggtaaaatgtgccacatgttaaataacaaaaaaactcctaagaaataatttactctttaagaaacaatataattcctattacatattcacttctaactacaaaattcaaataactggttattttaattcatttacataaaa

SEQ ID NO: 5287 - DNA, 273 bp, mus musculus
gcagtggtttttttcttcaaaaaattcagttgtccttgataataattcaatctgagatgagaaccctagctctaaatggttacataaactgatataaaaaatgagatgtgaaatgattggtgcattaaaattggtgggttttataatattttccatttatttcacatttgaacattatggaaaatatagagaaaataggttgatatgcgagtttaaaaagcaaaagacaactaaattaccatttttaaggtattttactgttgactttctaaa

SEQ ID NO: 5288 - DNA, 1678 bp, mus musculus
tatctgtcatcaaaaagtgattctttcaaatttctacttatctatatacaatcaaataaacttgaggaactgaggcataacagatctcagaagagaaatacattttgagatttctatagcccatgatacacatctccccacatgcacacacctaggcacataaacatatacacacaaacctacttccatatgatttggtgagggtatgggaaaaaaataccattagaactgtaggtaatttttatgttcttttttaaaatttggccagaaatgaagagaaagtgtatacaacatcaaatttaacagtatagtaaaaatatatatcttctaacaaaacttcatgtataaaaataaaatgtagagttttccagttaacattttacctttaattgctttatttccaaactttgattcttttctttcttgattcagatacccattgtatctctaatttgtgcgttttgatttatgaaacctttctgactcttctccttataaaagtaaccactatttttgtagcctactgtttttaacaccactgcttttaagtgtagtggcctgacacttttttgtctttttttgaaatggagtctcactctgttgcccaggccggagtgcagtggcaaaatcttggctcactgcaacctctgcctcccaagttcaagtgattctcctacttcagccttacaagtagctgggattagaggtgggcaccatcacgcctgctaagttttgtatttttagtagagacaggtctcaccatgttggccaagctggtctcaaactcccgacctcaaatgatccacccacctcagcctcccagagtgctgtgattacaagcgtgaaccaacacgtccggccacctgacactttttaaaaatgcagaaatgttagtccaactaaaaccgttccaatcgtcctttactgatatggcttcttttgaataaacatagaaagtggccctcctggtcttaaaacttgagaaaattacaattgtcttatctgaattccttttttcaggaaaccaaccatcagccctctcagataatatcaaggaactgaaatttgctgtatcactgcatctgaacaacggggcaccatacccctcacacattttgattggctaactgaccacctgcttcctgttggtgaacttatcttcctcactccttcctaactgttctttgcccacacatggtcacatttcttacctgctatataaaactatagttttagtccatcagagagatggatttgagactgacagcccatctccttggctgcagtgcccgaataatacctttttccttggcaataatctttgtctcagtgactggctttctatactgtgagtagcaggacatagacaaaaatcttggagttttagtaacacgacttcaggtctattgataaagaatatgtattttattggacttcttgaatgattcttagacatattaaagtctgagaaccactgttttaatctacaaacatttaattttctatttctttacctttacatgtttgcttaaatatttttctctcctatgtaaagaataagtccctttacctgtagaaggaatactgaaattgttgatcaccactgcttattgctttaactgtacatagtaagatttaagaaatccttactgaatgtatacaatgtactagttacctt

SEQ ID NO: 5289 - DNA, 768 bp, mus musculus
atcgactcattttctccttggaaaacccctatccttcttcctagctgaggtccccacttccagtgggcagggctgacagagctggctttcagaagatgggggagacgcagttattcagtaaagcacccagaaacagtacttacattggaatccagtacatggaatgcagggcttagatgaagcagcctggatttaaaggaggatctgaatgtggaggaagtttaagcactagacttagataacctattcttgttttgttcatgcttggtcaggtgttttgcagaatgacttgatctctggcctcaggttcctcatgtataagtgaagggttggacgcatcagtggtgactgagctttctagggtctctattctgggtcagccacatttagaggtgggaagagcatcacctcattaacgtcattctgcttttcctcacgtggtaaagacccactgagtatgacagagttcaaactccttagtgtgacattcaggggccctcatcacctggccccagtgtctttcccgagcctgtgtgaccactttctccactaccttaaactctagcaaaaccaaactcttgcgctatccctctagtggaaacatactttcacccttgactacttggaaaacttctattcatcctgtaacacttagcttaaacacttcctctttgacatcctcaggtgtgctaatgactctggcctcagggggccactcggctgggatatgcctgttttgtgcttaccccctgtataacacttgctgaa

SEQ ID NO: 5290 - DNA, 1092 bp, mus musculus
taatagcttttgtttctcgagagctcattatgtgcctggtactgtgttctgcattttccactcattgtatcacttaatatttatgcttctgatcttaggggaatgactgtttatattgcatatatgccatttttttgcagtatgaaaaatttgttgagccgagtgtcatacattataaactgacatgtacttactgttgtttaatctaattggtggttgttaaatctaaaggatgttctgactacttcaataaaggcagcagcaatcacttccataaataaatcattagacgtagaacacatgtgtaaacaggtagagtcttctaatttgctaagtgttgatggactcaaaacagttactagaacaagccatagatggaatacatttattgatggaataagtcaaacaacttgaaacacggcattgtggtgtcttaaatggtaattcaaataaaatgaagtgattgatacatttttacttgtttggaaagtggagaatattttagaattgcaaaacattgcacttttatatacatttatcctttcattatcctaatgtagggtagataggacagttgattgcatccaacttcatttatttggcttattatcttttgttttatgattttaactctgtctagaatcatctcctaccacttagagtctatgtattcttctgaccaaatgacttcaagttttctgaccaaattaatggcctttcaaactgttaagccctctgcctggaatgcccttcacatcttctcttggcgaggccgccgcggtcctcaggactctgttggaatatcaccaccccagacaaacattccctgaactgttcctcctatacttacccttcctctggcctcccacagcaccctgtgtatacccacattagcatcatttgacacctggtattatagtgttctatttactggccagctgcaccaagttgtgactctttggaagcatggtgtgtcttttatggttttatttcggttttttcagcacctagccaagtctacacagagtatggactcaatgagcgattgtggcttgaagatgtaaattctttagtatgtattgcatgatatac

SEQ ID NO: 5291 - DNA, 1092 bp, mus musculus; identical to SEQ ID NO: 5290

SEQ ID NO: 5292 - DNA, 931 bp, mus musculus
gctccagcgccatggcgccctccaggaagttcttcgttggggggaactggaagatgaacgggcgaaagcagagtctgcgggagctcgtccgcactctgaacgcggccaaggtgccggccgacaccgaggtggtttgtactccgcctactgcctatatcgacttcgcccggcagaagctagatcccaagattgctgtggctgcgcagaactgctacaaagtgactaatggggcttttactggggagatcagccctggcatgatcaaagactgcagagccacgtgggtggtcctggggcactcagagagaaggcatgtctttggggagtcagatgagctgattgggcagaaagtggcccatgctctggcagagggactcggagtaatcgcctgcactggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggaccaggaagtacacgacaagctccgaggatggcttaagtccaacgtctctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggtt

SEQ ID NO: 5293 - DNA, 626 bp, mus musculus
gtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactaggtcttgtgaaaaaaaaaaaaaaaaaagagagagct

SEQ ID NO: 5294 - DNA, 1410 bp, mus musculus
attcagataaggaattgtgaacagtcttatggattaatacgttctcagaacatcagtgttttagcaaataagatattatttacagtgagcacattgttagcctcactagatgtcagtgtagttctaagtaaatattttatatagttcctcagtagtgttgaatgagaagatgttttgctttagaacttaaagattgagaagatggaatagttgcaataagtgtttgtggtacattaattccaacatcctcctctgatgaaaacacataattggtaaatttatacacatcaacacagggccaaaaaatagtccaaggatgtaaataattatggattcataggatacattgtgcttccttagtcaccaatgtattttccgtacattgaaaagtcttactgtacatcacaacatgctggtcagccttttagggcttttcccaattgcaaagggagcatggttactcctcctgccatgagagggcagcactgagattgtctccagcccaggaagcagtgggcactgtttagtatgggttagcacctaggtttttatgtggaagcattcaagtcaggctgtggtgatatatgttctcagagtctaccatagtatcattttagtgcttttattacaagtcatcaaacactgtatctgagaaacatgaggataaattatggtacattcaaaaactgctgataaatagcaaagaagagaacagggtactttgggaatataaggccttttgcgtgagaaatgttttgtgctagctatgagtgaattttctacaagcagagaagttccatttggtcctctgaactggttaacattttcttgattctttgcttagtgtagcaaataaaattctgtttattctttttgagagttcccaaaatatctttattgatttggattttgctttttcactttattttatagttgattttaagtttttcttgagtgtgttcatcagatagccatataaaatggaacaatgcatttgtaataacaaatattatacatgatatttttttggccagcccagttgcacagtcaactgagaaagtggaagttatcactttcctcttaattccttttacatatttttcctctggatgagaaaatgttactttctcatatccagaaaagtgttataaaatgatacattgagatcatctgattccctctttattgtgattgtttctttaaaagaaaaaaaagcagaaaggggccatgaacttacaaagaaagttttaaagaatacaccaaaaattgttaaaacaataaatgagttcatcaaggctgcagggcacaagatcaatacacaaaaattaattatatttttatatacttgaaataaatgatctgaaaatgaaggaaacaattctgtttacaatagcatctaaaagaataaaa

SEQ ID NO: 5295 - DNA, 633 bp, mus musculus
ttttttatttttccttttaattacatttattttaatgctgaatttactcccgtgccataagtttttgtttcttcagtttcttctgggatatctttttcttctgggcaacctcctcttctggtttaggaacaatctgttccttttccgtaaggatcatctcaatgtggcagggagagctcatgtatgggttaatccgaccatgagctctgtaggtccggcggcgcatcttaggtgctttgttcacttggatatgctcaatgaccagagaatctacatctaaacccttaagttcagcattactctctgtgtttttaagcatgtgcagcaaaaattcagcactctttttgggccaccgaccttgtgtccagccccactgcttggcctgcgcacacctgccaactccaccattgtaacgtcggaatggtacacactgtttctgtaaagtgacatctttcagatacttcgtggctttttgtatatgcatacccttgatggcctgagcagtttcacgagtgttcttaaagtgaacacgaagattggaacctcttgatttgcatgatttcgtggggttctccgggtcaagtgagtagcgaaccattttcacagattacctcaggctgcttagggaaagag

SEQ ID NO: 5296 - DNA, 807 bp, mus musculus
tgacatctgtacttgcttggttttagccatgacagctgtattccaactgttgttcaatcacccagggctatctcatctacagaaaaatgtgccagcttctctcttaccacccagaactattttaataagccaaaccaaggcctagcattcatcagcgttaaaatatctgtagcagaatcatctcaggcttgctgttactcatcatgaccccacgcaccctatgttctttcctttgttcacagaacataaatattccatttagtttgtctctaatgccattttctcagggcagttattggaaataatggaagaatgcagtggatctggggaattatgttttctgtgtcttagcaagtaagtgacaggtcctaggcatgtggaattagaattttttctctgcttctacatgcttctgcaccatttaacagaaatacaagtgtaggttatattacctgtgggaggcagttttccagaaggtgtaagaaaaagatgccttataccagtacctcctggagggagcactctaggaactacctctgtagatgctgtgattctgcctggtgccttgcagcatctgagctcacttctcacagaggaaggaaagcagcactcaggtttctatccagtaactcctttcaagatggcttcatttggtaacctaactccccagatagcatggtgaaataaattgacagggtgtagatggtttgagataaatattcttatttgatttagactctttgtaaatcaaagccattctattagcataactcaagaaatctatttttttctgtattgatctccact

SEQ ID NO: 5297 - DNA, 1028 bp, mus musculus
tgcccataataataattagcatgaggatatcaacatggactataggaggggaaaacatttgctactgtgctggttgagcacttaatcataagctttcaaggattccagtagaatttacatatgcaccttgcggtgtgagcctgagtattttcatacgtttccatttcatttggtgtcatctcttcctagtaatcatcactcagatgcttctcatcaagccttagattgcaggttagagacacgatttagcctgattcatttctttggattttgcaacttttgacaaatcagaagcaaattttgttttctgtctcatctttaaaatagttatccaaaattctaacgtttatttcttaaatggtgtcgtttgaaacttgtaatttattatttctagtataagagcaaattataacatcaaactcctttagaaaaccaatctacttactaaccagagatgactttctagtctttctattgcagttagtgatcaacttttaatatctcaattaggtttccaaatatgcagtaggtgtccatacagaaattccattactttttgtttcaaaatgtcgtttagtatagttttcagcattttattaactaactgtatgaaatcatgctaaaaaggtgaaattcaattatttctgtgaatatttttaagtaatcacaaaggctttagacattcaagtagtgtcaaaaaactagagcagtatcatggcaataaaattattgagaaacattaaatgtaaagttcaaattaacatcatgatgatacacctaagtagtgttttgccagaaggtaaagttagggtactcttaatgagttttaaatgctgcatcctcacaccactgtagtattcaccaaagaagaatccagaattaggtgagttcttggatcgattgtaagggaatttaattattgcagctattcctaattcattaatttttcattcaataagcatttggaaacatctatgatatattaagtagttttgaaatacactgagggatataaatatgcatgagct

SEQ ID NO: 5298 - DNA, 692 bp, mus musculus
cttacacacctcaattggagggaacccaagagtatgaagttagtagcatgtggtctagctaccagtgtttgtagctgtattagttttctattaccatgtaacaaattaccacacattaagcaggttagatcagcatataattgttacctcacaggcttcaccggtcaagagtctggtacaatttagttggatcttctgctcagggtcctataaagccaaaatcaagacattggccagctacattctcatctggaggctccacaaaggaaaggtctgattcaaagctcattgtgtgttggcagagtttttcttgtggctgtgagactgagttcactgtttccctgttagctgtcactgggcactgctctcaactcctaaaaatcacactcaaccccttgctactgggctgcctccacaagtgattcacaacatggttccttgcttctgcaaagccagcaggagaatctcccccatcaggaaggcccagtttctttcaagggttcacctgattaggtctcagtcttacccagaataatctctcttttaattaactaaaagtcaactcatatggggcctcaattacatctgcaaaatcacttcacttttgtcatatatcataatgtagtcactggagtgaaatccattatagtcacagttctactcatacagaaagggaaaggattatataggac

SEQ ID NO: 5299 - DNA, 933 bp, mus musculus
ctggatttttaaggactaatacataaacaatataatcatgattttcctattgtgatggtgttaatgcctgttagtgttcatcagtataaaggaaagctaaaaagtttgttgtgtgcaaaaataagtaaagttaaatatgaatatcagaagcacttacaatttcttactggcttatttttttcagctatatcagcttaaataatgcttaactctctgaagaacatggattaaaatgagcaaatttatagtatgaaatcagtatatagaatgtagtttaaaatgaaaatgaagttaaagctcacatttgtttttaattcaggctcttgacatgtaaaggcattttaagccacctacctatttccaagatggtatagaccacctgctgttaacatgctttaaggaaaatggagagatgtaaaagagttttggtgatttctctgctttgagtataaatgaaactgaaaatcttctgtcctgtactcttaatagtgaactattagagtgtttaaatctttgtgtgaaagtgaagactgtcataaaggattatcattagcctctttttatttttttgctatgtgagtacttgttagcactggataatctgaatatagtttagttacaatacttatttctgtatgtctctaaatttggtattttgtaaatgtgctttgacagtaaagaggtaattctgattgaaatgtaaaaaaaccattttacttgaacattataaatgatagatcagagtgtatgggtaagaattacagaaaatggagtagcctttacaaggtatatagcatcaacccagctaaggtaatcagaacagttttagaattagaattccttccacatgagacaagaactggtaaaatttgctgatcatgttagatagcaggaggctggaaattatttgaaaacttggatagtatattctat

SEQ ID NO: 5300 - DNA, 221 bp, mus musculus
aaattttgattttggaacttggtgccagaagacatcattgaaggtggaaacatatggctatgactggagtctggttcagggccctgaagttttaaaatcctaatgcttcctgcagaaatggagctctgagaagggaaatgaaagaattatcctttcttgataccccagagtactgcactatcaagtgcattatggtggttttatacattctcaagagggtc

SEQ ID NO: 5301 - DNA, 2654 bp, mus musculus
ttggcacttgtggaaaaatcctcaataagtttttatggagacatgactcatcttggcaattaatgacaaagaagaagaggtctggaacaccttgggtttgtacagaaaataaagcatttttagagtaatagaaataagcgcaaggtgaataaacaagagttagtaggaaaaaataagtcaagcattaaaatgaatgtctgatgataaaccaaatcaaggaatatttagtcttggtgtaaatgtaattttaaaaattttactttctcaagttagaaatgaagaatagtatactaaatattggagaaaggaggagagtgtagcataacagaataagcaaaaggagcttttgattcaccaaggttatagggaaagaaggtcatgaataaaataaaacctggattaaaactggtcaaatattaggcaagtaaatttagtgaaaacagcaataacatttactctaatgctgtcattttccctaaagagctacacaaattgttccaaagaccatgtttaaatgagtcatggtcatgataatcaatattttcattaattttgtcaaaatagatctgttatctttttcccaagatccccaagtgtttctgtttttctaccttagtgaaaacaattcaaatttggacccatggaacccaagatgcagttgaatatcagccaagagctcaagagaggctcctgggactcatgggcatgcagctcagtggccagacacattgtgaattgaccatggtagaaggcaatgtccaaatgctacgtcactggaaatgttcattcttgcaggcagttttggaccactggtaaataaaatcatgaattatttgatgaagagggaatgttgggaaaagatatctaaaggtgaccatttttagacaatgggctgaggaacaggtcgtaaatgaaatgaagggagaagttagaaagctgtattgcaatatttcaagaaaacattcaacttaatgaacagcattaaatataattaaatggtaatactgtaagagttttaaatattaaagtactgattatccttaatgccaccacattgagttaaactgctattagtattttgggtatatgtacatttttccttcaagaaacaggtcctggggatccttcagtgaactaaacttacatgaccaagtataattctaggacaataaccaaacaaggaaatctcagtaagtgctttggaggaacttgatcagaaacagagcctccatggattgttccttggaagcccgagaaggtctccatgaagccaagacataaatatgaggaagccggccatacacaggggtaagagtccaggcagcaagatagcagttagtgcagaggttttaaggattattaaaacctagcaattaaaaaaagcttatgtgtcaggagtttgtatagatacatatttttctaatccattattgataagatagacaattctgagtaccaatattatcaaatggaatgaggaaagctgtggggcctaggacaagtaaattaaaaacacagaagttgggtatagtggctgacacctgtaatcccaacactttgggaggctgagacaggagaattgcttgagcccaggaggttgaagcttcagtgagccgtattcatgctactgcactccagcctgggtgacagagcaagactgtctcaaaacaaaaccaaaaaacacatttacagatataaaatgcatcttcgtgtgatgattcaatcaaaatagtgtatgtaaaatgcagtgactggcacttagctttcaataaatctaagctattgtaacccccaaaattcctctttatgatacaaaccctacaaaccacttttcaagttaagatagcattgcaatacgttagtaattttgctcttaatttctgcatttccttactattgatcaaaggacaaatgtccctgaatatgcacatatatttaggtatacattaacagtttgaagctttaacctgcacccttgattcctgagcctccttactctattctattttctttctggtagtatttgtaactttctaacgtgcagtatacatttactgtgttactgtgtctgtcattgtctttgtcatagtcatggtctagctggattgtaagcttcataagggatgagatgcatgtttcattcactgatgtatcacgagtacctacaacagggcctgacatttagtattgtacagtatgtatttgttgaatgtaaaataaacaatagatgataaaacttaaaaaactcaacgttaaaaagcaagtaatcattagaaaatggacaaaaaacatgaacagatatttctctgcagagaatatacagatggcaaataagcatatgaaaagatcttcaacaaaattaaatcctcaatgaggacaacacacctatcacaatgaccaaaattaaaacatagtgataacataacactattcaattcttgctggaaagaatgcagagggactggatcattcattcattagtgatggaaatttaaaatgttaacacaaccctggaaagcattttggcagtatctaaaatactaaatatgaaactacagtatgacccaacaattgcactactggatatttaccccatagaaatgaaaacttatattcacacaaatgcctatatacaaatgtttatagaagcttac

SEQ ID NO: 5302 - DNA, 371 bp, mus musculus
caaacagatttgtaattctgtattaaaagtgtctaatttgtagggttacaaaaatcagaactgaggttgtattgtaggtaatcaacaaaacccactgcctctccttcctgacacctagctagactacaattctcagctcttcttgtacttatttgtggccatttaaataggatggtctccataatgtttccctcatagctacacaaaatggagattacttacaaactgaccttatgtcacattttttaaatgaaggatctaccagctggaaacagcctaaatcctgaattactgcttgaagtacctgccaatatcttctctagaatttcacatgggtaggaaataaaattttattatgttaagtcactatt

SEQ ID NO: 5303 - DNA, 387 bp, mus musculus
ctagagctccatccatggcattgcatctatcagtaatgtgttcctttatatcactcagcaacatccaatctatggaggaaccatagcttgtttatccattcaccaattgaaagacatgtgaatagtctccagttttggtgattttgaataaaaccactataattgttttcatatgttttgtgtaaatttaaatgttcatttttcttgggtaaatacctgacattggtcttgatgtatcgcatgtcagttgtatgtttaactttagaagaaactgctaagctattttccaaactggctatactatctgcattctctccagcaatttatgagagctcctgttgcctcagaactttagataagtaatagtacacctttctcatgtaattt

SEQ ID NO: 5304 - DNA, 1022 bp, mus musculus
agtgaggtttacctcctcgcccgccctccccggggagcgcaaccctgggctcgttcgttaccgagccagagagctaggaagcctgtcctccccttcgggtgctatttcctacctcctcccgacttcaccccctcccctcctttttttcttgttgcgggtttgaagcatggttttcatgtgattgttttttccctttttcatggacagtacctgcaccctaagcagttcagagttggcttctgttttccgttagcgctttgctgcacggacaaatgcatacaaatgcatttaagagcccacagaacaaggcgtggaaaagtctcccccacggcaaaaacgtaagtagcccacccgccgggtagggtaggggttagaccaacccctctctccaccccctggttctgctgagcctgatggagatctgaagtccggctccttggcactttttggctttaggagcggccgagtacccgcggtatcttccccttgtcttctcagcttgcaaaataccgtgtttgaaaggatgcctcgtgccagcagatctcagacagtttatgctaaagcgatcttttggctcgagaggaaaagctcgctggcgcgagtcccgaggtccagggcagcggctccctaagctccagagctgggctccgacgatctctctggctccagctcccgccgccctcgcgccctcctccccttctcctcccgcagggccctgtcgaggtcctgcttccccgaggtgcttctcagggcgtccagcctggcgattgctgtgacgctagaggtcccccagggtcagtgtgcgcagcctggaccactggactcaggcgtgaggaagggtcgccagcggggggaagggggtggctgcagaacctcgggcgtcggggggttgttttacccacgggctcagaggcaatcccctctggttagaaggccaacaaacgttgcccatccgagccgaggctgcgccctgatcattgccctgtcactggggaagtggcactcgcggcggggactgggga

SEQ ID NO: 5305 - DNA, 1029 bp, mus musculus
tattgtgcctatttctgtcaaaatgtaatgtttggtacatgatctatggcagttgtcactgaaggaaaaattttaggatgttggtcttcattcatgatttgccaattcttcgtatatatataatctaattctttcatcatagatgttccactcgtattactgtttacatggttttgaacgaatgcaagggggccagctgtatagcacgaccattcagacgtgactcaaagacagggctgtatgaagcaaaatgtacatttatcccaaagagatcccagactgccaaggaatccattgtgtttatgcaaaatcttgattctgtaagtaccttttttccagtttctcaaaggaatccttggggaaaaattaattagagaagctggattttctgctgtgaaattatgcgtaccaatagaaaggcagaaaattactaaggcaattaattagaggtcattttctctggcatgtatcagggtgtctctggaaattaccctgtcttttcttattaacctatttcttttattcaaatgtagcactgtagccttctcattagagtcacacaataaattcttagaacacatctcttccctcactgacttctgtggacttctgtatagagttacaatcttacttttaattccttttctaagtgttagccatattacttttctaaagaaatttataatgtagctttgaaaaggattgacattttagattttccattaccttcacactaaagcataccaagctattgcaaagtgatattgtgaaaacacatagggctctttctccactgaaaagacttaagaaaaaaaaaaattcacaattaccaatgtgtctaaccaattaaataataacacaccacaaaaaagttgaaaactaatgtttgacctgaaatatctgctttaaatatataaagcttagtgcataagaataggtaccttggagtcagatagacctgatattgaaacccagtctgtcattttaaagctgtgtccactgtgggaaaactgctaaatctgagattga

SEQ ID NO: 5306 - DNA, 802 bp, mus musculus
ccaaccctcatctggtctcatggaggtaagggaggactcactgaaagcagtgatatctaagctgaggccaagtagctttccaggaaaaccagagctggaggagtggggagtgtgaaagttgaagagttccaggtaaaaggaacatctcatgcaaatacctggaaataagagataaaatggtacatttgtggtattacagggactctgggatgcctggaatggattgtgcacagtctagctaaatggcattgaacaatcactaaaacactgcctgttctaggtcctcatggggcagagataggtgagaaagatggtctccacccacaaggaacctatgatttccctaggaatattgtacacaaatatctacgaagttaaacaacaacatacatttacctaagatgatataccagatcactgactgtaaagtggacaggagctacgagaattcaaagaagacaaccatcactgatgattccagagaggagcaagcactgggctggcctgagtaaagcgcagggtgtgtatggatgtggggtccagtgcagagcagagctggtttggggaccagtgaggacagcagctaaaagctcagcagggttaagttggggaatagtagaaaataagcttggaatggtagctggtggagggcttgggcatcaagagactgtggactttatgctgaaggcaatcaaaactagcttttgaagatcaggcaggatgaggtattcagtgggtcagggtagggatgacatgacagcagcatgcagagtgacctgggccaactgtagtcaggaggcca

SEQ ID NO: 5307 - DNA, 1149 bp, mus musculus
taatgaaattacttggctcaggaaaagtaacagacagaaaagcactttcagaagtaattttaaataaaaatttttatttggtttaataaatacattattcaaagtatgtgattatttaaatgacaacaattgtcttttccctgtgcaaggctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtatgtagtgtatagccattgttttttgtgtgtatttttgtctataactggttctgatttaataattgaaagaaaaacctgtgcatagatttttaaaattatgataagatacacatagaataaaatttgttgtattaaccattttaattttattcaatttggaagcatttgctatattcacaatattgtgtgaccatcaccactacctagtttcaaagcattttcatcaccccaaaaggaaacgcatacctgttaagcagtcactccccattcccccttcctcccagctgctagcaactactaattgtctgtctctacagatttgtctattctagatttgtcatatgatagaaattatataatttgtgaccttttttgcctggcttcttttacttagcatattgttgtcaaggttcattcatgttgtagtatgtatgagtacttcactcacttttaatgtctgaatagtattccacttgtgggaatattctaaaattcaaaactttttgtgcacccaacatgatgctcaaaggaaattctcattggagcattttggatttgggatttcagatttccagattagggatgcttaaccagtaagtataatataatataaacattccaaaatctgagatacttctggtcccaaggatttcagataaggaatactcaacctatactatatttgattgacctatttgtcagagcatatgagttctttttaccttttgactgttgtgagtagactgctatgaacatttacgtgcaggtttttgcttgaac

SEQ ID NO: 5308 - DNA, 498 bp, mus musculus
tgagcagtgtttcctgacagtaatgctctgtgatgatgtcagttcaatctgattgtcttattttcaggtacctttataatttaattatacctatctgttgattattttatggggtttctttaatgaggagatgttcagtttactctcattctagtgtgttgattttttttttttttttttttttggagaactggtaaatgtagttagattgttctatggcaacagcatgtatagcaaggagaagctacccttctggtatgcagaactgagaaaataggcttgaaaatttgggactgctcattattaccccttcatttgatttactgtagtttcagtgaaaattaaaataatgaaaaagaatagagttgagaatattggccatatggttgagatggattgaggggatcatgatataataatattttaccttgactcttctctgcaaaaatatattcctgcttatgctttctggtgcccttttagcctttcatcttcaaa

SEQ ID NO: 5309 - DNA, 1034 bp, mus musculus
tttttgagcatgatcgcatgtccatttattcattcaacagatatttattgaacatctgctatatgccagatgcctttctaaggactggagatagagtaatggaaaaaatattcctgtctttgtggactttatagtctggaaaaggagctagacaatggaaagaaaatggtaaaagaaattgctccattagatagcaatatgtgctaaggaaaacaagcaaagcaaggcagggggactgaacttttaaatgtgaccagagagggcttaattgagaaagtgacttgaagtaaaggcttgaaggaaaaagattccaagctggggaaagggtgcttgaggctaaggaaaaaatgaatgtgggaatcctgggtaagaacacatttggcttgtgaaggaactgaaggaggctgctgtgactggagtggagtgaccaaatcgatgagggttttcgtcaatctctgctcaagctgctataacaaaatacctaagactgagtgatttataagtaatagaaatttatttctcacaagtttagagactgggaagtcagagatcaaggtgccagtagacagattcagtgtccagtaagggctcactctttactacacaggatggtgccttgttgctacatcgtctcatggcagaagggcagagaagacaaactttagaactaaaagggctttatagatcatccagttcaactcctacattacatttatgagattcattttttcatgcatatatttctatattcattcactcaaccaatatttactgaagatctattatgcaccaaacactcctttaggaacttggggcacaggaataaactaaacagatgaaaataaactaaacagattttcttctgtttagtttatgaagcctattgatttactttggtggtgcgatctccatcccctgcaatttaccactcaaatcacccttcttcattctatacattgtaacatgaagacaaatcacacgcagaccaagttcttgagctaccctgtctcagcaaatgtttggtatttggtagg

SEQ ID NO: 5310 - DNA, 683 bp, mus musculus
tatctgccacattataaaaatagatattattttattcatttatagaatactcactgtgtttaaggcactattctggacatcgagctgcaatagtgaacataatcaagtttctgctctcattaagctttgcttctagtgaagacacaaataacaaataactaaacaaatgagtaatctaatatttctatatgtattagttagagctaagtaccccctgctcctccaagcttccaagcctccaagcctccctcctccaaaatgactaaaatcatgtatttttctttccatagtcttaaggtgcctggtagtgagtagctcaatccctgtgcacattagaaagaattaggattccttccaggtatctgctgcaccatctcctatggcattgttggctgattaagctaggtcaccattacatacaggtgacagctgccaggaggatcttaagctaccagcggcttccccgcagcacattgtattggagggaacttagaaatgaaaggatgccaatgaacgtgtggctaggtgaccatgtggtcagcttcaattccattactttggaaggagaagagagaggattttaatggctatctagtagtctctgcataattttgtacagttgtttaacaacataggagatgattatggagattattatggtaaattgtcataaaaatttctct

SEQ ID NO: 5311 - DNA, 218 bp, mus musculus
ctttgttctagtattagcatatagacagatttggttgcaaaaagtggagagaaaaaggctatatggatatctcatcatgttttgtcctgccactgagaaaaaacttggagatagaacacaaactaaattattctaaattataatcccagatcagaagctcattgtcccttcagtagtcatggtagtcctgagaaggagctcttataaacatggaacat

SEQ ID NO: 5312 - DNA, 1030 bp, mus musculus
taggcaagaaccacactggtggtcttaaactgtgggtgccaattacatcgttaacacataatcccatggcggagccactgagggagaagtaggcagtacattcctctcccatcccaagaactgcaccctggccacccctagctcttggtatgtagacacgtcactctagggatggaacactaaggaatagactgtgcctcacaaaggccctggaaacaggttcagccttttgggaatggaattcccacaattaaatgggaggaaggaaggtgcgggcttgaggtgggcatatatatcggtccctacataattccttatcctaaggtacagccaaagaagagcagtgtcctctatggtcagtgccttttaaactctggagccaaggatcaagctagcctgggcctgaggcagtgccactccagcgtttctcttcagaggcatcactctcaatggcacctctgtgtctcctcactgttttcaacactccatttaagtaaacagaacatggactgaacacattttttttctccctggttatttgcattttaagccctttatctctagctatagattgaaaggctttgtctctagttaaaggaatttcaagcaattgcaactagatggataagattagatttggtcctgaggggcttctctttgtccctaaaactcctgatattgtcagttttactatatccagacagtgaataggctttgttctgatgctattctatatgccttgcagaaacgtgtatgcctactgtggccaccagtgtcaaatactgcacaatgctcacctacaattttttcaaatagtgtttctctttctattttattctttggtgcttataagacatctgttgttatattttgtatcttccacctacttattcatggctttttcctctaccttgtggatgaatttcttggtatcatcactaattactgctttgacatcttcagagtaagaattatctttttagttatttttattttgatgattatatatgttttctattgttatgtatta

SEQ ID NO: 5313 - DNA, 967 bp, mus musculus
tgcagcatctgtactcttgagctgtttttaaggcagtaaagcaatctagattaaatcagttgtcctttttttaggttatatgactatttatagaatgaatatagtgactcatgatccgtaagatcatcttgatttcttgtattataaattgatcattctctattatttatttacttagagaataaaaaaaaatgagaaagattttacagttgtctctcactttgttccattttctttttgtgggcttaaaaattatagtaggtagataaattgcctttctttggcttctgaaatgattttaatagcttaagctaaattaaaaaatatatctctgaatctttgttctagcaatttgatgtgttagatattaaatatattcatagaaaaagagcttatgttataaatttattattattgtgtacctaattttaaatgcctattatgactgcatttatttggcatttttaaaatctggtttgatttagctcctgataaagcatattgaattcagaaaatataataccatttaggattttttgctgcaaaatctattacgctgtaggaggtttcacatttccagaatggaagcagtaagttttgtggggtcagggtgtaaccagtgaatgaaagatgaaagtcagaactcaaaatgaagtgccttttctgtttaacactgggcactgatagaaaatgataatgtttgattaatgaacggcagccttgcagcgggtgaaaacatctgcaagaagtgatttattatttcaaaggtattggaagcttgcagtatcttgccgatttaggtatgtgtgcctgaataaaataaatgagatgcaacatgtgaaaaatgaaaacacattacttgtaaaggatgtgtcacaagcagggtatttttgttcaagtacactttgtcatggggatttttaatgctgttctgaatacaaatcatttagctggttcataaaatcgc

SEQ ID NO: 5314 - DNA, 180 bp, mus musculus
taagacatttgattaatactattaaagatagaagggattgtcatataaagtagcactgaatttgtggtcaatttctgagttgtttttcattcactggtcttgcctttatactacttttactttctgtgcttttactgaacgttttaaatctaaacagggaaatgaataaaattagaatac

SEQ ID NO: 5315 - DNA, 180 bp, mus musculus; identical to SEQ ID NO: 5314

SEQ ID NO: 5316 - DNA, 119 bp, mus musculus
tttcctccaactttgtttaagaagaaatcacattcctccagtagtaagaatatttattctttatctgttcattgggaaattgataaattccactattccttccctctgggtctgtaaca

SEQ ID NO: 5317 - DNA, 1297 bp, mus musculus
catcacattccactggctagaaaaagatggtttgttctgttctcttaaaaaatgcataattgtgcatttcactgcagcaaaagttaagacattttctctttctcagcaggccaaaggtaggcaatgctctggctataactttctgttgtcccaagtgtctcattggaagcgtggattgtggctgggaattttgctcctgacatgcttctgggagtcaagggaggtgtctaatgccaaccagtctcttcattttcaaaaataggggcaatgcaaacatctcatttatttggttttcaaaaatgtcctcattcatcatgtcccttgtttccattttgataacccatgatagtatgctgctttcaatttggcataagtggtacaaggttaatgtcagtcagctttgttggatgcctatatccttttgaggcttgtttttgtatttactttccacatgaagatcatgagtttgagactggctgaaaatgttcaatctctgtaaatgtctcagggcacacttagtctggtgtcatgagaaagcctggaagcactgggtctagggtctacatcccagcttcattgatcattagctctggcatcatggaacagtgacaatctcttggagcctcagtttctttaactgtaaatccggtgggttagataaaacaatagattataacaatattaatattattaataataactgaaatttttgagtgttttgacaggaactttacatggcttctctcacttaatcatcaaagcagcattatgaggcaggaactattattaccccacttcgcagaggagtcaactgagttcatttatttgtttagcataatgtaagtggtgaagacaatactgaggccagggcacctgactttatctattcgcaaagtgtgaactgcagaccagcagcataaacaatacctgggagcttgttcaaaaggcaaattcttgggtgcactctagactgactcaaaaccttttgggtgatgttcaggactctgtgttttaacaagctctgtgggtgatttaacactgaaagtggaagctctgttctaggacctgtgttctcaatcctagattgtggttttctatgttcaatgaatttttcagtgtcaagaacgtagtccgactgactcttgattctgtggtggtctccttcctccatcactgctttgagtctgcctatccctcctgcagctgtgtgctggacccagataatggcctctgcgtagagaagcagcacagggcatgtgaagattgtattcctgctgggacttccagtgttctttcc

SEQ ID NO: 5318 - DNA, 807 bp, mus musculus
atagggaactcaattaggaattaaattcctagatataacatagaaacaaaattagttgtgaacaattatttgaaattgaagatcttagggtacttgtgtttttctaataaaaatgctttcaagcaacagatgttatttgtattctcactagtaattcagtaagtggaacatcaataacaaaagctaactaactctaatactttaaagcacctaaaatttagatttttacaaatatcattcatcacatgtaactcagtttctcagaaacacttatgtttctttctgtgtggctattgaggatgtctatcaaaatggtttagcatttttccattcaaccctcttcatcatgattatgtctactgtttatgcagtttggcaagctagtgtctgaggtcatatttagaaagttctagatgccttaagaataataaatggctatttaccttggcccatggctacctactactctcaaggttcatttcccttttatttacttgaacgtggtattgacatgtttgcttttgctccttctaaatttgctttcattctattgtgtttggagtgaaggaaatctttagagatatctaggaaataaaagcaagtggaggccttgagggatatttaggaagtatactttaaaagtatgaatgaaaaggagctttcaaggattacttatggggtattttattcataatttcacctgaatcacctagcacatctcatatctattagatgcttagtcagtctttttgaatacatgaatgagtaaattattaaagtattttaattatgtatttatataatgtc

SEQ ID NO: 5319 - DNA, 514 bp, mus musculus
ataattatatttttggaaaatggtttagtaggaaaaaaaaagtcttgagaatctctaatgtttaatagtcaaaatcaagatccaatataacaggttaaattattccaaggacagtagagcacatgcttacacattaacaagtaaaatgagctgctctcaagcttttaaagcagggatagaagttagggaggcaaaaaagaaaggtaattaaaaatcgcagcagttaatcatttggagcaaattactcatggaacattctgggaactattacgaatttagtattcatattcaactagactgaaaaaggatggaggaaaacaatgaataatagtattattcttaagatatacaagcttcttcacagctgtagagacttcattgggcttaattttaattatgcagaaagaccaaaaattccaaggaattaaataaatcagtaatgcatgacatgttattagctttgaattaataaaaaagtatcattttgcatttgtttaaacaggaaagtagttaa

SEQ ID NO: 5320 - DNA, 294 bp, mus musculus
ttgctagcccaatattctcagattctgtgaagcaaacaactgttcttactgcataatctttaacacttctacattttgagatttatcaactgctctttttgttaatttttctgaataaattcataatgttaccaaatatctaaggcttagattagatctatagccccaaaaacactatgagaaaattttaattctctgcctggagttttataataaagataccatcaaattatcataccaataagtcttttgttacataaaaaatgttttgatatctctgtaaaaagccttctc

SEQ ID NO: 5321 - DNA, 261 bp, mus musculus
ttctaaagattgatagatattgagctgcttacccaacaagatttactaagagtgtttttaagctgctttatctgcgaaaaactgtcaagttgaatgatttccttgctgtcagtgaatctcttcttctttacattgatcattaagcttttattctttactgtctctgtaaagtacttcatggtcaactgcacatcttttgtcaacccatagcaaaagcattggttatggttttgggtctctgtctccaagacatatattgac

SEQ ID NO: 5322 - DNA, 344 bp, mus musculus
gaagcttatttagttcttaaactattccaggatagcttttgagccttgggaaataagataaaaatctttatttccagtcttttctgtaatgtcatatgtctcattttaaattatatttaatggatgattatggtcaaactattatgtgcatggttagatatactactactccaaacacatatcaatagcaataaagcatggatctgaagtaaaagcacaaaatggtaacctggaagaaaattacaggcctaatggccttcaaggctggaagcaggcagtgttgcccaatagtttgataactatgtggtaattaatatttaaattatccataagaaatggaaggc

SEQ ID NO: 5323 - DNA, 711 bp, mus musculus
atcactggtattccccaaatccacagggttttatgggagttccactattcattaattctccaacatagtaaaagccgttatctgaaaattaacaaccctcaattctaagtattttagtcttcctcataaatatatatttcataaagttttataatagtacccaaattgtttcatgtataactgatattaattttacccccataatattcaagtctaaggaattttattttgagtcaccatgttaaatcaaatatcctccaagcttcgaaatactgacaataatttcaattcagtcaatattgagactctctcattaaacattgaaaactcctgagtttatacaacgcctaaaaaacagttcatcatgattttctccttagccttgctcctttagcttctcgctgctgcaattgagcagtgatgttgactaccttttaggcactggtttcctctgagtttaaccaaattcagatattcatgccattccagttctctgcactgaccttcatctaaaagcacacagcaatcttgtaatccactcccattttggggcaatgtatgccgtctggacacaagtttccatagcaaactgaaatgccaaagctccttttgtaaatctcaggtaacttcaaactcttgggctagtcacatcggctcccactaaaaaaggactttcactgcctacctctctgaaataatctcgcctttaaa

SEQ ID NO: 5324 - DNA, 466 bp, mus musculus
ttttgatcccttgtaattttttttattattaactataaagcatcatgggtatagagtgtctctctgggttttgacctgaattgcatccctcagtaacgagcccaagaatacttcttcatgagctctcatttcatacctgtaccagagatttccaagagttttggtcctctgtctctggcttcacatttgcattcagattttagctattacaaaatataaatattaaaatcattactttttaataattttatttatagacttattagctgaggtgattaacacaaaatcttcacatgaattgaagtttgtttggtccacaatggaaaataaattaagaaagtacaagagtcatatttttacttattatttttataaggtcaggtatacaatgttacattcaacaaaagaattaattgttttataaatacttccattgactgtttaggccatttgaaaacaaacctta

SEQ ID NO: 5325 - DNA, 453 bp, mus musculus
agtgaagccaaaggaaagaaaaattcattttgacaggaggatctctgaggacttcataaaaatgatggcacttgaactaaacattgaagtatgaatagaaatttagtatgatgaaaaggacatgaaaggcattcaaggtacaaggagacagcaacagctaagggattgaagtttttaaaatgcatttgtgtgcaggtgttatttaggcaagcaatgatcaaatttcaaatgcatataagcatgtccctgctgctttatttgtgtcagaacagcggattgttaagcacaatcttaatgttttgttcttagactgctttgttgacaaaccttatgatttatttaaaatgtgccacgatttttcctttctagctgcagtgttacagttgttcatcataggaatttcaagaaaatgtccagatagctgcaatttccaaaccacaggttactaatata

SEQ ID NO: 5326 - DNA, 855 bp, mus musculus
gtgatttggtgtgcagagaagagttaacataaaaagcttgaatgtcatccttttaaatagggccacaaggtcctattgcttacaaggctggcccttagctggcacctggaaacatggatttcaagagagtggcatcatccctaggacttataaagatgtctcactgtgcctgaaccgtttgtgcaaacaagagttatacttaatacctgctttccttctggcagtctagaattttagtacatgctaagcagagtgcctatgagactatcccttaataaaaacgctgggaactgagtctgtaacaatctttctcgggaggcaataacatttcacataagttgtcataattccttgttgagggaaataagcacatcctgtgtaaaggcatgggaaggagactctgatagcttgtgcttggtttcctcaggactttgactttcctccatgtgcctttttcctttgtgattttgcttggtctcttttttgctgtaaccaaccatatctctgaatatgattcaatgctgagtcttgagagttttcctataggatcatcaaacctggaagtggtcttggggacctgacacatggagtattgcacaagctttactagaataatttcaggattttgaaattgtaaactaagtcaacacttttcttgcaacccagaacattcgaatatggacctggaacccagagattttagctagagtcccctgaaaagaggaggcttcctcctggtgggtgacactgtgaattagcaggcacctggataaattagaggacctctgggctcacaagccatcacttctgacatcctttggttttccaagcattcccagtgattcatttgtctgt

SEQ ID NO: 5327 - DNA, 314 bp, mus musculus
gatgagaaacacaggaatgggaccaagaggaaaaataaagacaatgtatttgtcgtgcgcccatcatatgctaggtgctagaaatacaaagatgaaaaagcatatttcttatactccaggaccttacagagacacaaacaacatatctatgtgatggtgatgataatattgaaaacaatagttgtcaattaattgcacataatcaccgtgtacaagatagaaaattgtatttgtggctattgtaaggacacagggtaagggcactcagttctctgaggggatggaaatgagtcagtggattagggagggggcaa

SEQ ID NO: 5328 - DNA, 756 bp, mus musculus
atacaagcaagtataacttgaagggcatataaagggcatatacaaacaggatagaatatgagcatttaatgatttatataggcaccagaaatctgaaagcccctataaccttttctattcagagactttatccttctcttattcctacagttatagtctttgacagataatgttgaccttgtaaattaaagtgtaatttgattgctttggagcatttttggtgtgtttgcttccttaactgtgtgtacagtagagctacatttaaacacagggaatttggcccttttgcttttaaaagtaaataccaggctcactatcattgaaggagaaaccatattcaaaattgttaggctataattgttctgaatcatacattcaaaagtgtatgtgtcttatcaacataaagtattttaaaagattggaacactagaaaactaaataggatggctattgaggacaacaggcatagttttaccattttggtaccttctactgagttaatcttggtataaacatatttactttaaaagtaatgtcaaataaaaacctaaatgaaaaatgaaatagttttctatcaaggaatcatcttactgtatctctgtatcatttatggtgtatgtgttacatacattacaaatgttatttgatgtcatgatttctgaatccaaactggtatttgtcagctaagatttactgcttgagtacagtaataaaaatgaaaatagttttctgaaattttatgtttaaactaatttg

SEQ ID NO: 5329 - DNA, 306 bp, mus musculus
tcccaccaagataactcctaatgactttttcaaaaataacgtaatctctatatagggttagataatatatgtctgcagatgtgttttgttaaacaaagggaacatctttgtttcaaatctcttcttttacttgccctcatagtgttctgtcatatggcagaccatagttttattgattcagagttttgctcttataaataatgctgcgttgtttgggtacatacctttgcagacttacacagacatttccataatgtaaattcctagcagtggtcaagggatttgtgcatttaaatattgatggat

SEQ ID NO: 5330 - DNA, 318 bp, mus musculus
ctgagagctgcaggggaggcctgctgtctgactggcagagagagtcccaccactccctaccctgtaccctggaagaccaggctgcccagcctgtccacctagtagaccgtttgcctgcccaattctccttctctgattcctgatgtgcagcttgatgcctgcatgggctgcaccagctgagattgtctctaggtcctcccttctgccagctggtgtccagggaagtgggtcctctggcctgcttcctgccagccagaatttcgaggaccttgtttctcccactgcagctttcgaccctgtcctggatcacagactagg

SEQ ID NO: 5331 - DNA, 1550 bp, mus musculus
ggcttctgctgctgctgctgtccctagacctgaagactggccacaaaaccagaggcatttcccaatgtgtgagccggggccttcccaggctgcgctggcagaggctgcaggggaaccaggagcctaaattcccaagcaggcaaattacccactgagcaccctgcaccctagtgcctagggaccagtccaggagacagggcagaggaggacacatctgccaggtggctcccagggtcccacccccgagtcattctcatactcagtgccactgttaatgccttccgctttagcttaattaagccatctgcccacattaaatggtaaattatctcaatcactccctggatcccagaggggagaaagagatgaaaggaaaatgtcatcccttgagtggagctggaggactctgccccacctgtgatgacttctccctcagtgagagacagcctccagtgtttacaaatccttctgtgtccttgaaaatctaactccacctgtcatctctctgcttctttctcttcctatagggaggagcgaggctcttacatgtctgaccatgggtaggaaaaaagatgagagcttttctgtttttcctctaccttaggggtgcttgagtgtctgtaatgttgctctcttccaataagcctgttatttttgcacccctgtcagctctcagttctgctgaggaagcactgtgctcccactgaagtgacctgtgaacaccactctgctctgcaggcatgtggccagaggctggaggatggagggatctcattacaggcatctgtgggtaagtggggaggtgtctcccagggtagaagcaccttcttcgaagggttgctgtggaccaggggatggcccttgcttggctttgcagttccagacattggatttataagcatgctcgtagttgttcaggttcaagaaccattgacttacagtcactaaatccctaagagactgatgaacctgagtccagtaaaaaactgggagacatgacttaagagagattgactcacagtcactaaacttctaagagactgagtgtcttggttcattttgtgttgctatagcagaatacccaaggctgagtaatttataaagaaaagaggtatatttagctcatggttctgcaggctgggaggttcaagaagcatggtgctggcatctgcttggcttctgtgtgggctttcttgctgcattaagacatggtggaagatcaaaggggaagtggacatgtgcaaagaggtaaatttcaaggagtgtcctggttctattaaagcccactctcaagggagcattcctgtgagaactagttcagtctcacagagagcaagcgctgactaccaccaaccatttatgagagatctgtccccacctgtcaccgggccccacttcccaacaccgccacattggggatcagtttcaacatgcattttggtggggtcaaactcaaaccatagcactaaggagcccacggtaaatgtaaaatggtgagtattcctaccaagtattccctttttggtaccaagcttacccagaaaactaat

SEQ ID NO: 5332 - DNA, 402 bp, mus musculus
cagtaaatgtttgttgaacaaatgaaatgattgtaccattgtggtgtgttactttaaaagattactataatacttctaagtggatgttgtgaattactaaattttaaagcctcttcttatgtactctgcagcacatactgccttctggttttaatgttaacagatgcttagatgctttttgcacatgttttcctaaaatatatttttttcttcatgaatccaattttggttactataggcagttctgataagttgagagagaagcttgagaagcaagagctaaaattaagggagcattttgatataagataccattcagaatcaggcacaagtgttgtatttagtctgcatatggtctgtaggtgataaaattattctgaggcttaactctgtgcagtttag

SEQ ID NO: 5333 - DNA, 783 bp, mus musculus
tcccccaagtatatacgctatccttattaagaagaccttcccacggtggagcaaaaatggcagagtaaagaatgccaaaataataaactggcagaaactggcaggatcaactttattaaaactctggaaactaatgaaaagtttacagtaacctagtgaatgcttaatcaaggggaaaaacacctaaatctctctaagaaagctttgtagtgctttatttatcctggccccatccctcactccctagctcagtggcagtcttgaagacaacagagtacattccaggtataggtttctagtaccagaggaagtggaatggaccttattttcaaagaactgtggtcgtttgttttgacctgtctgttggctttctgaaggactagctcaaagggcttgctttatttcagcttactgaaagaagagagttttcaatttcaaaactctcccagaattgacataactacactctgggtcatttgttaaaaacatttaaaggcaaatgcattagctgctgctgcctggggcaagggataacaggaaggacaaacaatagacaaaccagaaagcttgtgagcaaagtctcgggaattagacactttgaggaataaaggctctaaaaagctcccacatgtttctgggaatcaaggccccacacacagccagagctgggcatatgctcagaaaagacttgagaaagtcctaagctgtcaagtctgcctaaccttcatgttctgtacaagtaggaggagaaggctaaggcagagttgtaaactgtttggctga

SEQ ID NO: 5334 - DNA, 783 bp, mus musculus; identical to SEQ ID NO: 5333

SEQ ID NO: 5335 - DNA, 736 bp, mus musculus
tttatcgtggacaaagagcaaatagtttgtggattggcacaagtctgcagatcacttctgtagtgttgctgtaactgtgtaacagttcatgtatgtgtcaggatgggaatcggttttatttatttaggggattccttttagtcttgctggtatgatatgattgaaactgaggactggacttttgtctagaggcccctctgactagaagcaacaattaaaacaccttttcagctcactgacttcctcctgttcttcagctcatcacttgctgggtagagcatttgtagcatgctatttgttttccaggcctgctgcttttctggccaatgctctcagggatgggctgcctgtgatttgttataaaggaaattctatcacaagagagggaaagggaaaaggaagtacatgggtcattatactgggaggaaggtggtctgatgctatgtagtccgatgtggacttgtgggtgatcaaatactccatttgagctgtttctttcttttcttttcttttcttttttttttttagacagagttttgctcttgttgcccaggctgaagtggaatggcgtgatctcagctcactgcaacctctgcctcccaggtttaagcgattctcctgcctcagcctcccaaatagctgggattacaggtgcccgccaccatgcatttgggctgtttcattcaccacctctactgctttgttcagccagtcaagaaatgtttcttgaaatctc

SEQ ID NO: 5336 - DNA, 443 bp, mus musculus
acataaagactaagagtagctcagctatgtccttatatttaagtgctaacattttacaaaattggctttacaggcattttcttatctcattagcttaagaatgcttaaaaaaatgctgcttctgttacttctgattgttcctaccctcctgacacacacatcaaacaacaaaaccaagtggacaaccgccactaccagatatataacaaagaaaccccttaacattgctggagtccctctgatagttttttgtctcctgctctttttggagatctatagcttcaatgtcaacttccggaagatgatagtattcttaaggccactttttctacccctaatatctcatgttgggatttcccctttcactcttaccagactcagtgaaaacaaagggatctgctatagttctgccttctacccctcagcttcctattattggagcc

SEQ ID NO: 5337 - DNA, 641 bp, mus musculus
cctaaattatttatttcctctctgaaatctttccaaagttgttttagccttaagatgaagagatgcccccaagtggattgttatcagacagactctaaaaagtagttgttgtgaaacctggggtatatattaaaagttcagacttctagccctcatcaccagtgattctgattcatggttctggggtgtggggcccaggaatgtgcatcttaacagcaccctccttcccctctcccccacatacaatatcctctacccaatttacaggtaattttggtgtgaattccctgtagaacacacttgaggcacagtgccacctcacagttgacttgggaaagcaaaacagaagacattggttcctgctttctaatggggcattacattcagacctgtttgcttaagattatagcaaaattaccttgacagagttttgagtgtttccaagccttcagtcaaatagttacactgtcttggtttactgctgcagatggctaagcgaagtttctagaaggctatcaattttcccatctctttagtctttaggtctgggttggtagaagaagggttgcagaagggcactttatctaccacgccgtgtctctagaaatctagcaattttgaatcctgtattactattcaca

SEQ ID NO: 5338 - DNA, 1292 bp, mus musculus
ttcctgtggagggtagcagaagggaaacttcaattacagtataactggtctgatctgttctacatattaaagttcatgctattttctttgtgataaataaagactgttctgctgcatctgaaactctgaaaaccattgctctagcgctaaccgcctgtctctataacaggtatccactcacagttataatgaaagcccaaagatgtgcttgagttagcttatgtcaatgaaaatgttgctagagacttggtctagatttgctgagcggcatgtgaaaactacagtgtactctgatcctcctctccctctctcttttcaccaccattgttgtcaatatatattccttccacattttacccacagaaatctttgtgtactggggtcacattctccataaccaagttgtcaaacaggaagacttctggaaaagaagatttctcctaacttggggaagagcacttagagggaaagagatgagagatggtcagagccaggatgtatttaatcttggtctgcagtggacatttatcatctgccaagactccttctttctggcactgacatcctttcacttaggaacatccccccaatgatgaggctctgtaagggcttctctcattttcccttggactgtaagatgacctaatattccaagatattaaccaagtgcttttttttttctttgaaatggagttttgctcttgttgcccaggctggagtgcaatggtgcaatctcagctcactgcaacctctgcctcccaggttcaagcgattctcctgcctcagcctcccgagtagctgggattacacgcatgtgccatcacgcctggctaattttgtctttttagtagagacagggtttctccatgttggtcaggctggtctcgaactccccacctcaggtgatccaccctccttgccctcccaaagtgctgggattgcaggcatgagccaccgtacttggcctaaccaggtgctttcaaaggtgttttgaaccaagaagcaagtcctgccctgttggatgcaaaactggaaacatgtgagatgggaactgctggcatccatgcctccagcctgagaggaaagccagccagagagcatagagctgcctgcagcacgcaggaaaaaagggtgaggagagcgtgtcccgagagcctccagcttctggttctagtggccactgatgtccaaccctgtttctgcccttcttgttttggttacaggagcccacaaatcctctctaccattggcgcttattggaattgaatttccatcatttttttaaaaccgag

SEQ ID NO: 5339 - DNA, 1157 bp, mus musculus
tctttagggtaccttaaatgaggcacttagatgacatggggaagaatacaatcatttgaccttatggttatctccctacaaagttgatttattttgaataaagtccaaaatccttgcgaagtctcaatgagatcaggcccctgcccacaactacatttctagcctccttctctatcacttcctagccaccccaattctcccttcatttatgccacttcagtcacactagctttctttctgtttctagaagaggctgtttatcttccagcctttcaatgaccatttactctgccagaaatgcgcatctcctagacattcccatggctggctccttctcataattcatctcaaatattacctttcagaaaagactttttcttaaccaccgtgtacaaactcgttgttgccccaaccataaacaacttctatctcatcattctgttttattccacttgcatctagcaccatgtcacattttctttttattaatgtttctttgttaattgactgtctccctctactagaatgtaagcttaatcagagcaagaaccatgtctgtgtcttattcactgatgtgtccctctatcctagcacagtgcttcattcgtaatagtgcttaacaaatacctgtgtgatgagcaaataaacagaatcgatgtatagttgacccttgaacaacacaggtttgaactgcatgggttcacttatacaaagatttccttccacctctgccacccctaagatagcaagaccagcccctcctcttgctccttctcttcagcctacttaaccgaagatggtgagggtgaagacctttattatgattgagttccacttaatgaatagtaaatatatttctcttccttatgatcttttctctagtttacttaattgtaagaacacagaatataatacctataacatacaaaatacgtgttaatagactattatgctatcagtaaggcttccagtcaacagtagactattagtagttaagttttggaatcataaagccatacacaaattttcgactgcacaggtggctggttcccctaactctcgcattgttcaagggtcaattgtcttatgctactgttatcagcagaataagcttgaggcaagataagaggttcaggatttatgggttattaactcaa

SEQ ID NO: 5340 - DNA, 827 bp, mus musculus
ccaaaattggaaactgtttaataaatttgttgaattttataaagaaatttggagtaaaaaaccccacacatacataaaagggcaatgacccagtggggctcaacagagaattgttttttaaaaaagcaaaaggatcacgcctgtaatcccagcactttgggaggccgaggcaggtggatcacgaggtcaggagatcgagaccatcctagctaacacggtgaaaccccgtctctactaaaactacaaaaaaattagccgagcgtggtggtgcccgcctctagtcccagctactcgagaggctgaggcaggagaatggcgtgaacccaggaggcggagcttgcagtgagcagagatcgcgccactgcactccagcctgggtgacagagcgagactccgtctcacacacacacacacacacacacacacacacacacacaaaacgcaaaaggagagccaattgaagcaatgtctgtaactagtctgaaatagataactccttcagcatttcatatagtttatgaacgttttaaataaatccaagttggtatatctaaagcatggataatagaaacacccaggattcagatgatactggtataaaagatagcaatgaattatcttctacaagcattgacaaggaagagaaaggaatgctagcaaatactatcacggaggatttttttaaattgagaagaaaatggcattaataaagccaagacactgatgaagaagagacagtgaatgacattttaatctaatttgatgttagtgatgaccaatgccgtttccagatggtaggagttaatctgattaagagaggaagtgaa

SEQ ID NO: 5341 - DNA, 1105 bp, mus musculus
ctcagcagccattcctcaccagccattcaaggcagttttttattttcaaactttggtttgcagatcacctggaacagaattattctgggggaggaagcgttgttgataaattttcacattcttgttttttttttttcttttcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgataaattttcacattcttaagctgtatcccaggtcaactgactcagcttctaagggatgggacttgggaaactgtgctgttaaagcaagaacccagattaatcttatatgccctaggttttgagaagcagtggtttagcaaccacaccaccttttttcagggccactgccacatatgtcttctgaatttctgggattttgactgcttgagtggaatgggtcattgtcagtatacatccctgaagattcctgtttggaatttgatccattggccacaaattctttccccatcccacccaacaatgcaggatattttttccaggctggcctggaggaaaaaccaatcattgttctcattctgactaattggagacagtctggccgcaatcatctctctttgtgcctttctcttctacagtacttgggcagggctgcagggcagctggtgtggagggtggctggggtggggcccagagaaaaataattaaaactgcaatgccttctgtcattaagtcctgagtggaatgctgagttgaataatggaaagggtctctgctgtctttgggaatatttttgttattgtcccaagtaaaagacttgagtgtcaaatgagattcttttatgtctgtacttctccataattttttagaatttcctacggtct

SEQ ID NO: 5342 - DNA, 905 bp, mus musculus
ctggaagaaattgggtagtgagggtcttcctgttaggccttacttcagtatttatttgtgtagctggagatcccagaccagcctttctgtcagcgatgcttcagtgaggagcatggggctgaatctcagcttggaattaaaacataccacctttctgtgtgaatgtggatgtaaatattaccagcagacaggtcactcaagagataggtgcccatatttccaagtctaaacaatctctgtaggtcaaacagggaggccccgtgtgcttgttggcaacaccacctttagcagaagtctgaattcccagtgaatgctgcctgtgttctgctctatcgaggaactatggcctccagaagcgttgccctacaagctccatcctagttaatgacttcaggcagaaatgtgcagggaaaagttggtttcagttgggtccactgtatgaggtgatatgtaagttttatgggctctcctcccgggattccttgcttttgactgagaatgtgttttcagttgttgctccaatccatcggtggtgatagatttgcccagctccctgcatatgttctcgccctgttccccaagtgattcaaagcatatttacaagacagctggcttgggtttacagggagcaagtctgaggcatggatcagagcagagtgaagtgacccatacagggaacaaacttatgaccttggcctcctaagcactatctccttacagattcagctaatacagctcccgaaagcctgcccttcatctaagtccacatgcgacattgaaacactcaaaggcagcctggcagcagcaagaagaaaaacattcaaaccaagttagatttcctggcatcatgttgtttgttcttaacctgaagatacatttggggacccctagtctggtgacactga

SEQ ID NO: 5343 - DNA, 1261 bp, mus musculus
gtttggaattcttttcttttttctcccagtctgtctgaattcctcttgccaggccaagtctcacttcttttgggtagcctttttcaactacaccaggccaccctcagcctctcccctaatctcttgcattgtttgaaattctgcagttcaatgttttcttaatgaaagtagacttgagtgggttcccacacgtgacagggactttatgtccagaacacaacctggcatatggtagactttcagaaactgagttaatgatgaattggtaatgactaaaatgcagaaatggaggcacgaaatattatttgcatgttgatagtttgcttatattgtagaagagggatagaaagagaggataattattttcttagttaattttcacccttttcatgtaacttccaaaagaggaaagtaccttctggaaatatgccagagcagaccactgtaagctgagttttctgagcttaactaacactggcactgaatgattatagtgtttaataatttcgggtagtggggtggggcattgtttagtacctttccctttgctgtcatgccaaatctctcagatgtcatgcacatctgagaaaatcagaggggtttcactggctgcacttattgggggagaagaaggctggggagaggaaggaagataattcattctgttttcatcagagcagcaagatttgtgtggggtatagatttggcattcattacatcatgtattgataagggatggttaaaagatcagtagcttctcgtctttgggtggaagagagtttcacctatcactagattgaacacatttccttaggttgactaaaccttctttttctctgacctcaagggtgcagagaactttgaaagccctggtataaacacagtgtgctatgggttgttagaagcacattagtcatgttaaaggagaataggagagttcttgggatcactgaatctattcagcaagtcatgttctgtgcatccataggccagcaacagtgttccagcaggtgtgtgagagggtcacatgcgatacttcagatttctccttcctgtggaggctaaatttgctatgggtagttaaaaggaaagggcctactttttattcagagagttacttcagatatacatggtcttctgagaagtttatcaggatcttaccataattataaaacaggaataaactttctgggttttatttgctaagaaatgttttgctttggctcatcatctcagagctatttcatgtgcttagcacatc

SEQ ID NO: 5344 - DNA, 16041 bp, mus musculus
cttcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaagtaagtcatggaggctgcgggcggtttgggggtaggggggtgagtgcggagactgaccacacctagggagaaaaaactcacttgagagaaagctgagtccattggaagggcttccaggaggatgcctggtctagggcctgcatggtcaacacacacagcatagtggtttcaaggtttttggaaggcagctatgctcaccactatatcaccaatgccatcagggtgttacacagtttttgaaattgagagtccctgcataatctcaaaatgtttcacgagcccaccccatgcgcagttgcttgcacctctgtgacctggttcaggaatcggaaggtcagtgagttcatctgcatttcctgctcccacccagccccctctgcctctattaatgctgtttgtggcaggtttttgtcagctctactttactgtgcttgtacagaggcacaacctttgctagcagactaatgactagaatccttgccctccccacttccctgccaccttctggaactaagacactagtttctctttcagtgctctagggcaagaggagaagggtcccatttaaagctgtttctgcagaaacacaggggcagaggtcatcagcacgccagtgctgtactgtacccgttctgtcacttagatggtatggcaaggccatccccaggcctctttgttcttaagacttttctcttcccttggggacttcattgtccttaagacctttcccctcccctgcactgcacttccccctgtagggtagaggttaattggtcacctgactgaagtcaatattcaacagcagaaatgttaaacgataacccatcccacattcttgccttggacccagaggcagccaggccccaatctctgcacctctacttgcgcccccatacagcctgtttgctgtgggaggatgagaagccaggtggttttgcaggcagacagactctgagagtccgtttatcttatacaggatctcttgactttttcttcttgtaaccttattaaccttcattccagagatgaaaaagacagacccagtaggggaataatcagggtgaacacgtatatgaaattctttcaaaaacctaaaaagcatttaagaaaagaaaaatagttttgtgggttgccacctctatttttttgtttataaaatgggaagggtctggattgccctgtgacttagggtgtgaggaggctttctcagttcagaacttgttgagagataggaagagtagtcagacaggtggagattactaataaaagctaggttggggctgcgtgtgggggctcacacctgtaatcccagcactttggaaggccaaggtgggaggatcacttgggcccaggagtttgagaccagcctgggcaacaaagtgagacccccatctctacaaaaatacaaaaaaaaaaaaagaaggaaagaaaagccaggtatgttggcaccagcctgtagtctcagctactgagaaggttgagctggaaggattgcttgaaccctgggaagtcaaggctgcagtgagctgtgatcatgccagtacactccagcctgggtgacagagcgaggccttgtcaaaaaaaaaaaaaaaaagccaggttgggtaacttgatgaagatatgtaggcattggactgagccctgaattcgagagactctgaccttggtaagatcaatggtaggagcagcagggaatttgtgctttctggaggcaggtagatcctgaaataggagaaagaaaagggctgaaccacacacaaatctgatcatgtgagacacttctctgccttgggaggagtgtttggatagagagaagccagatatgtttctctaatggaggtccctctgcagggaaacataaagccaggggaagggggtttctttccagcccttggcttagggcgagagtacatcagagaactctggacagtggcgtggtcagttcatggagcaggagtgagagaacacagcctgcactcaaggctttctcttggggaaggagtgggaatactgggtctgtgcccattgatgtcccccttttctttgatctttagcacccccaatgggaacagcctcagtgccgcagaactcacttgtggaatgatcatgtgcctggccaggtaagtccctgacttctcagcaaagctagtctctccgatatgccaattattaccacttgccaagcaaatggacccagaaaaacttagaaacatttcgtctcagcgacttgcagactgctaagaaggcgacatgcagactgcaaagaacctttaaggccatcaggtcctctattcaacattcattacacaggttccctagtgcacaaaggtgcacttctctttactcatgttctattctccatgctgcagacaatctgccttctctagcctccaactcttgcaaatgttctccataccctgctgcctggagataacaaggaaggatgttccaggcagcagggtatggacagtgtctaggtaccctctgcttacttttcaagattaagcttcagtattaatttatccaagaagctctctggcttttccagctaggctatgtccctcactgattcccctggccctcagggcttatctctgtcactgcccttacaaatctgtattgtaatagaatggagtaagaacctgcttcagggtccttgtgtgttctgtgggttcataacacaatggaactcaaatgggcaagactcttgctcttctagcaggagttccaggcctcttgagtggatggggcagcctagaaatcaaatggttgtggcacagaatgtgcttgagtctcagtgtgttggttagtaatttggcaaaactgattgcatggagcacttctgttgaacaggcaattcaagcatttatgtggtcaaggggaagaacaaggctcccaataaacagggtaggaagttgttctaggtccctttgaagctccatggattccctaaaccagcggacctaggcatcaaggactccttgtttctctactcaggcctgaaaccttccgggaccaagaaattacttttcccatggcgagacctgctttccctcctgctggaggaggatctgggggaatttacctctgctctaactcctccctgcagtttccatctgagctctctggtattcactgatattcactggtaggtgaaaggaggcagtggggggaaaggagaaacagggatagcttacacagcagtagggtctcagcctagaaggggcccccaggctggcagccgggttctcccagaacatctaggctgagtgtctctccccctggagaagtacagaagcctggcaccctggtttcacttcagctattaccttcagggatttttttttttttttttgagtaagggaaaagatctcaatgtggctttctgattaattacctcactttttttctggaggtggaaggaaaggattgggagccagcaatactttccctccttttccaggaccagctttgtttaaaggaatcggtgaaatgctgtggtttaaaagaagctccccattgtcaactgctcaccatgacctcactcatcaaaggtgcatcaaaactaggaaacacgcacaccctattgggaaggaatgcgttcgtttcatcagactgttcctagcagggaggacggtaggagagtgtgggtgcctatatgtagactctacaggattgggcaatgtgggtggagagcaggcgtggctgggcctcacagtagggactttgagcagatggcgggggctcctgaggtgcagaagaacagcacacagaaaggaaggaaggagagaatcaacaaatgtaggtttcaccatttttgcctgctttaccatctcctcctctagtaagtcaggccagcaaccatttaattattgtgaggaccctcgcccacattagagtcctctccagtctggcctgatgaggattccaaagcattgaaacctggagaggctccatgatcagctgggagcagcagccagagaaaagggttagggatttcttgtgttctgtggtgccgcacgcatacatcttagatagcactgtggagtctggtgggaagaaaataggatgtgagggagaggagagaggggccaggtggggctctgtctcactaggtcaaaggcattttatcaggcaagctttcccaagaagtgaacagttcctcaaggcaagtccctgtccttattacctgcctgatgggtcagagcagtgaggtgaatgcagcttgtcccccatgtggcttggtactgaagttcttctgagtttacccataagatcgtgcgcctctgtgatggaggacagattccaccttcagccttaccctcagatggagatcaatgtcctagtgatgtgtagagatgagagaatgtttttgtgttagaagttagtgaagtgaaagcacggaagtagcagcttgagatttctctttttgcacgctcgctcactctgaggtttttggcatcaggttaaaggcctacatttaagtactcaggaggctggccgtgctggggttgactttgctggctttgaatctgttcaagtgcctccagttgggtgatctggggagaactgtttaacctccagtgcctccctccgtgcagctgtgaatgttagaggagttaatgtgtgtctaaacatttcttttaggatgtctaaaataaagtgctccttaaacattgtttctcaaatcttccttttttgcctccagagatgtgttgatgacccatgcccacaggacatatatcgccctttgacctctaatgttgccctaattgccacttcctctgtctcctccagaaaacacagatgtagactcagacttccatctggactaataggaggagacaggctgtgaagagtgtgtgtgtgtgtgtgtgtgtgtgtgtgtgtgtgtgtgtgtgtgttggtggtggtgggacaggaaggtggtgcggatgtttaaaaatgttgggaccacgcattcaggacagaatggaagtgtctgggctttggcatccacccacccactctagggtccagactagtctaagaccctcggggttaagaaactctcaaggaagcataggtaattaggtgtcctcttcataatagtagaagacgtcataggttatggtgctggatgagataggtagatcaaaataattccttgagcttctggagtactcgatgtcatcagagttgcccagtaccccactcagttatccctacagaccctggaggattggcgatcgcttaaagtaaaaaactcactctggttgatgcctcagtggctgaggtggaatccatacctcctcccagatgcctggctggtcacagaaatcccaggctttctaagtcagatcttgccaagggtttctctcttctgttttccctttatcccccatcagtgttcctaaacctgaacccccagacccagttcttggggaagtggctgtcatgggcagtgactgtgcaaacctgatgttgcatctccttcctgggctggcgggagtccgaatggaccctctgaacctgtgtctatccttgcaggcagattccccaggcgacggcttcgatgaaggacggcaaatgggagcggaagaaggtgagcagcggccttgactcgccccacctgggctcagggcccggggtccactcatgttgctgacttcagcttctttccttttgcctgtttggttgcagttcatgggaacagagctgaatggaaagaccctgggaattcttggcctgggcaggattgggagagaggtagctacccggatgcagtcctttgggatgaaggtaagatgttgctggaaccctgtgatgtgggactttctgcagcaattttgggaaaggcagcatgtctgggcagaagccagaagctttgttctaggagggtctgaccctctcttggagcccccatctaaataagtgttaaagtcaaggagggagagaacactggcctgctgatctggactcaaaagctggaaatacttggtgggggtcctttagctctctggtgagtgaatagccctgagtcccagtgaaccaggtgttgatggctcttttgagactttggttcctgtcttcttagtttaaaagaatttaaacaagagacacggtgcagcattgaggagtttattgcaaaggaaaaagaatattttgaaagttaagtgcagagtagacagtacacctcgggagagagagaattcagggtgggctgctcataagagtgaggcagtgttggccgggcgcggtggctcacgcctgtaatccagcactttgggaggccgaggcaggcagatcatgaggtcaggagatcaagaccatcctggataacatggtgaaaccgcatcgctactaaaaaaaaaaaaaaaaaaattagccgggcgtggtggcgggcgcctgtagtcccagctacttgggaggctgaggcaggagaatggcgtgaacccgggaggcggagcttgcagtgagccgagatcatgccactgcactccagcctgggcgacagagcgagactccgtcttaaaaaacagaaacaaaaacaaaaacgaatgaggcagtgttgattattgctggagaaactccctttataggagttttacatgattattcataaggaggtgggaagagctgttactagtaagcatgttttgggtggtcctctgggtgcacatgagtagtagctgtacattcttgttcatttggcacatgtcttattagcatcttaaatctccacccaggagtgtgttttttactattataatgagccagggggtcagtttgaggacaggaaaaatcaaagtgcacaggctgtctagatgggaagttccctactgaagatagctttgcttgaatgagctcagttagaatatgaataccgaggcttattgtgttgactataggatcaccaaggttgctgcacttccttgattacctatcctgcctcacagggagggtgcttgtgtcctgcccattctttctttccttcctgcttttgttttgtctgctttcctgtgataatttagaaaacaggaacaagtttatggcctcacagtagagccttacatccattgtccatctgtccttccagtttccctccatatttcagaaaagatttaaaagtgcttgtatgtacactatgatatgattgtagagcctatggtggctggaagacctcacaccggtctcagaaatcacacctaactcctgtcttcccccaggtctctgccttttcctactctgggagctcagtaggcttctggctactcccttagcctgattgcaaccctctggttgccatcagtagcagtgccacccacttgggctaatccaggagaccttgcaaatgagagaggcaattcagctaagagaggggatctgcagggcttcccagataggccaaagagatgaacccactaaggctactatgggacatctctctgttcactttctgttttagggaattacagggattatggggtcaaactgcagccaggaagtctttaaacattaggagatcagttttgacaaccagatcatgtcaaatctagaaaagtttacatagagctgctatggaactctccctttttctacatccctcctaccttcttagagttagaagggatcttaatagattaacccttaattttacattgacatctagaatttgtaagcttatgcctaaggactcatagcaaatggacagtagcctagagcctggtgagcatcccattgtacacattgaatattatcctctccctcctgcctccactccccatcttatttatttaagtcagccagatatctttcctaagcctctgcactgagaagggccaggtgtattcttgatccctggactcctgagagaggcagatgtagcccagcaggatcattgatcatgtaaacaaaccacagccttgccctctgtgcagggatggtgggatgccataagccacaaagagcactccctcctccatcctcttttgtaagggatcaagggtcaaggtttagtccatggagaattttgatataaaaggcagaggtcaggagttaagtaaaactaagagcactcatagccaaataggtgagcatttcattgatgaagcagtaactgggagacaggctccagaccagtggccgttccaaggctcctgcccccttccccagggggtcctcttccccatgactccccttccccaggcttccttctccgtggcaccactacacatcaatattcctggcaatattcttcatcatggagacttcggcagcgacttcaaccagatgaaaagccccacctcattcctgaatgattgaggtgctaggtaagcttgtctgtccatctggcactgcccaactctctaccctgggatgcttccaagaggtgcatgggtacctgggaccttgagcatcagtgtcaggaaatggctgacacctctcgtgcatgtgtttgattgaaagagatgtctacggcctgctcatttcagtgttaatctgtgcctcagagcaggtcacccactgaatgttttattcccattcccagcatggtgtggagggtgccagtgccttcactttgcatttcttctgtccagatgtctctggagggtcattcttaactgtcttgcttccagaacatgctctttgtaaacccctgaaacatggcttggatcattccgtctcccacctcagcccctccggagctgcctggacctcatcattccggagagtctaagtggcctcttctcgtgctcagctgcttacctcaaccacgtcattatcatacttttgagtctggatgaattttgtcttagggcggagagctcatcagttctaccggtcttggagaacaagattttctaaagggaaaggaagattcttgaacatattgtgaaagagatgtataagcacccagacaggaaatgaggataagtgtttattaaacacaagttatttcatactagcctcatcctctttttggaaaccattattaaactggtagagtatggaaatccctagatgtcagatacccggactatttaaagttatgttttaatcatgtaataaaggaatgcattctcatataaattaaaacttggacaaggctatacttgattaccatctgaaccctagtctcctcacggtaaacatcagtttagcatgtcatccgagacttttctatgcatttgcacagaatgcatacagttccatgcctgtggatggattctttggctgcaaacaatagaatattgtttgtgatgttaagaaaaaaacatgtttatctcagaacaactaaatctagcatatttttaaacagttgtgtggaattttattgtgcagataaattgctttttatttggccattctctcaatgatgggtatttagattgtgtatagatatggactttggtaagacatctttcatgattccctcggggttcggatggagccccttgagcttggtgctattgaagggattagtgcttggtgctgttgtggaatgggccacctcagtttggagggagatagtatgcaatagtgctccaccttgcccaccattctcatcaacagcctgaaccatgtgtcatttgtggatggcaggaagcaaggagaggtagttaatacttaagggtgcagaatcaggtccaaaaagacatatgaaggctagaatggttgggcaccctcacaggaaatttagctagaatacatttctgcaccctacttgtgggtccaaaaagcagctagacaagttttagatgtagaagcatttgtcaaaagcttttctgggggagcagggctttggtttacaaaagagcagtgtggttgtcagtggcatagctgatagaaaaggtaacctgacatttggcagcattaaaagaagtatggcttccggagcaagggaggtgacattcctcacactgtggcctgacctgcagcctacctgtggtctgagtcatacaggtcttaacgctctatactgttgtgtctgcgagagactttttctcaatagtgttgctgaatgacaggtcgtgacctcagagactcagctcattcatgctggtgtgttccttagaatgtgttaagaggcacaaaccaatcaagaagcgagccttgtgctttatgatcaaggttttccttgagggaacagacaagcatctcttaacagtttctttgtagccagcgttgtgatgaatccaactttagcccagagggttggatgttgaacctgaggcaccagttatcaccgattttttcaggtccagctaatgtttgctgaggtctactgtgtcggttcctgtgcttgaaatgactctgcagggtcagaattattatcccaggtttacagataaggaaactgaggcccaggaaggttctatgatatgctgaagataatgcaactatgaactggtgaatttcggctcagccttccaggctggcattctttgcccagtaccacttaactttattcatgatccattttaggtaaacagtccctgtgccatgccggtatgcttagctattccaaagacagatactctccaggatgggcagctcctatctcagtgtgttacctggaatgcttactgcccagagcagtgattctcaaactcaagagcctcgggttctggcaaggtgccttagggacacaggtgggagcaaggaggggcccagggagacagcaggtggtggcacattgagcctttacctctgcagctttgaattgacctatttttatatttgggtctctgtttaagatttcattgccgtggtagggagagttccaatgctaaactaaaaattcagctgtggggcagagagagcacgtgacggtgagggttcttcttcagagcctctttaactgggaggcctccttgctctcctctttgctctgctgagccagcaaggccctgcagccagcataccagcctctcagggctgtcttctgtgacctcaggcaggtaggagccaccagctgccctggagtcctgcttagaaagtgaggcttcctctgttgcctcaacatcaggagtctgccctggggctgggattgaggtgagggaaccccttcatgtttctccccaaggcttctctccgggagtagtctttgaatggtgggtacccagaggtgctccaatgtctgtatattaggacatctgaccctttccaggacacaccaggaccctgacaggcacgtgtgtcctgggcctgttgtcaccctttccatcccctcagtgttgtctcctagtgtcggaaccccaacccccagctgagttcagctcttctctgccctggttatctcaaatggaaaatgagaacagaggtttgctcagccagattccttccctgcagtcatctgcagataaatgagatactctctgtgaaagaaggaagctgagtcagtgcttcgctcacccctgaggaagatgctcacctgctcctctccccaaccccctccctccagccccagtcacctgtctgtggagggggccaggttcagcctgcagggtccttcctcctgccagcccccaggttgttcttggctcctgagcatggagtagacgtcagtcaggctggaccttgtgatctctattggtgttcccttcctctccccactccatatgagaaaaaaaaatacatctggattagagatgaacagggccattgttctggccggcctcagggccagcagacgaagaagacttgtgacaacgatggcagggatcccatctcctcgcctggacactttctcctccccaccagaaatgagtaggttacagccgaggggagcagcagtgtctgaaaaagaccaccagcgttctgagctggaggttcttatagggcgtgggagaggcagcatctttccccaaaacctgcctgatggttggtgtggggccacttggctttccttattccacaaggctaatgatgaaaaaagggatccagaggcttcaccttaatcataaccattttagcttctgccctagaattactgaatttgaagtcctctttcctattacgttcttttttattttgttttatttttttttttttttctgagacatcttgttctgtcacccaggctggagtgcagtggcacaatcttggctcactgcagcctcaacctcctaggcccaagtgatcctcctgcctcagccttctgggtggcacaggtgcatgccaccaaacttggctagttttttaaattttttgtaggggggggggtctgactatgtttctccagctagtctctgactcctggggtcaaatgatcctcctgcctcagcctcccaaagtgctgggattataggtgtgagcaatggcacccatctttcccattatattctaaagtatctatactgtatccctaatttcaaaagtaatttatgaataatgtagtagaaaacttgaaagcacaggaaagcaaaaaggagaaaaataattccactacccagagacaaccgctgttaaagtactatgctgtgtattctttgtttttgtctaatcctgggctcactctttacattctgtctcggggttaagggggatttctcttcaaataattcccagtgattgaatgtgagagtgagagatggctgcaatcatctgcccagctcctttatttagggttgaggacccaggtccaggggaactgacctgtacctttccacacagtgggcagtgactgggggaggacacaggtcaggcttcctgatttagagggcatgcagtcttgctcccactctgggtcctgccttgtacccctgttgtcctcctccttcgcttctgctcactctgttttagtacctgatgcacctgtttcctggactggaccctccagctgcagctgccatttctccttctccctttcctggctgtccgctccctacatgactgccctccctccctcaggactccctgctttctaaggacttccaagctccaccttgtccagacctatatgagctattgttgcatctgtgtgtgatcacagcatggaggcagacgcaccttcttttgagctctggctgtgcccctcctcattgtggaagccctgcttccctcagctctcaagcagacaagaacagtcccagcatcattgtgtggtcatgagaattaattaagctgatcatggtacttagtatatggtaaatagtacttagtatgtggaacatggtacttagtgtatggtaaattaactggagaattaattaagctgagcatggtagttagtatatggtaaatgctcaaaaaatgtttgccattcttaataataacaatactaataattaagaatgacacttcctccctctctcttgcttccaaccagactatagggtatgaccccatcatttccccagaggtctcggcctcctttggtgttcagcagctgcccctggaggagatctggcctctctgtgatttcatcactgtgcacactcctctcctgccctccacgacaggtaggtgtgtccttacattgtggattggtcacagaagccacagaccagttaacaaatgggccctccatctgggccttccccagacagtggtaaccagctgtggggagaggtccacctgggtcctgcagaggctggtgttttgttagacacccctacgttggataggggagggtgagccagctagaagtgcttggggtctaggtaagctgggcacagggacaaccagtgacccccatggatgctttctgcagcccctgcagggctttctgattcccagacccacttgaaacagtaatatctcaagaatttctaagatgtttctaaactgagtctggcccagatccataacagggactcctgccccagagcatctgaggaggaagagatgagagcaaagaggctgccgtccagcaggagagaggctctgggaaagagctggctcaaggaaagggaagacctctggaagccagggatgagcgtggggatcctggtgctgccccagcaggaagatgcttcgctttcttccaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagtaagtgcctggcagcctcagcgtcaggaggacgggagagatagggagcagagaggcccatggcagggaaagcctggcgttttacagaaagcctctagcttattgtctctttcatccatggtaaaaggagaaaactgtgttgccaaaaacacacctttgtggtttgaggagtccttgcggagcctggtatggaggcagctatgtggttttctgcaaaactcgggctttaaaggggacccagttcctggttccgggcttctcagactgctaacatattgacaaagataaagccacaaatcagttctgaagttgagggtctggagcaggaagagagggggctttagtgtatagttgagggaccctgatggaaatgcagtcccattgccaagaaaatgtccttttcagtgtccatgggcattctttttcccttcttctcttgctgggtggacagaagcccgaggatactggcagtattccctcagggtcctcggggtgggctgctttcccagctggagcagaggctcagcctcacaccagatccagtagggaagagtgcatttgcactcgaatccttttggctcctctcctgaaagatcctgtccccaacattggagcttcccctggtgaggaaggggaaaggacatggactttggattaggtagttgtggttcgcaggttactagctgtgtgtccttggaaggtcactggccctctctgagcccctgtagcactcactgtgtactcccagcccagggcacacagtgccttttggtttgtaaccttggtcatctttctcagctcttagatcataagctccctgaaggcagggcaagccttgtccatctttgtatcaccatcctccctaacacagcaccttctcctgctctcttcagcatccttgaaccacttgctggtggtacttacatggttacatgtggccgggactcacaggattacatggttacatgtggccaggactcacagggttaaatggtcaaaattcaatgggaccaacagagccctgaggagaatggccggaagatgcctaaataacatacccaagggcaatcttctcagtgagcagaagggtggaaaagacactggagggtggggtggaggtgccacagatgggcaacctgtcctgatgagagccaagatgcagttacctgcgtggagtgtcttggaagagcaggacactgtgctaaaagtccagcaaggcacatcgacagcaagtgctgcatggatgcaggggggtgagtttcggggaaaagcccagtaacaacaacaacagtagctcctattggtcaagggcctcccatgttaaaggtgcataatccccacagtaatgttatgagggagataggatcaacccatttcacagataaagaaactgaggcttagatcaaggttcacccccaaggcacctaggtggttaagtggtgaaggtgagatttgaatctggttcacactttgtgctgtgtccactctgctgagatggaacattcatgtggaagcccattattgagtccagtgaccaccctgacaaaatagaagtggaaggcaccagaactcctgactgccttccctccaactttcctgttgcctggggtggcccaagagggtgtggccagtccatggcagccaacttagaggtatctctttctgggcaggagccgccacgggaccgggccttggtggaccatgagaatgtcatcagctgtccccacctgggtgccagcaccaaggaggctcagagccgct

SEQ ID NO: 5345 - DNA, 1075 bp, mus musculus
acactggattcaaaccaaatctccaaatcctggctcattccattccgccatgtggctgctatctcagtgtatatggggtgggtatcctgaattgctggatcctctttgtgtccacactgataactggacagcttaagatttgtttttctggccaagtgtggtggctcacatctgtaatcccagcactttgggaggccgaggcgagggggatcacctgaggtcaggagttcaagaccaccctgaccaacgtggtgaaaccccatctctactaaaaatacaaaaattacccaggcatggtggcattcgcctgtagtcccagctactcgggaggctgaggcacgagaatcacttgaacctgggaggcagaggttgcagtgagccaagattacaccactcgactccagcctgggcaatagagcgagactccgactcaaaaagaaaaaaaaaaagatttgcttttcttgtgaagttaattggctatcctagaggtcagttattttccatttagtgcttttaactaataatgtaatatatgcccagagtaataaacttgtcattatcctctactgtatgtttagtcatttactgtatacctgtgcttcattcttcaatatgaaatctgactattctttctcagtgaagtttttgattattcttttgtttattatagtgactgctgcaacctggccctaaagttcagtttaaagctctgcctgtggactgaaacccactggtaccaaggattgcagttcatattataactggctccgaacccttgctttttttctgaatcagaaaaatggcaccagctacttctctgcttattgaagggatgaggagacttattcaggacttctccctgaaccctccaaagaggcatttaatctaaaaggatcttgtgagatctccattcttaaacatcattaaaatagatcagaaaattatcagtgtatagtgattatgttataatgcagctggaggcagagtttgagtaaatggactcctgagagccttttgagctgtaaaattctagaattcaagcccttgcttaaaaggatttaaagaatgtttatgt

SEQ ID NO: 5346 - DNA, 448 bp, mus musculus
gtgagaagacagattttaagagaaggagcagggctggtatctgaataggtatttggatgttaggggaaaaccctttttggcctctgtggtagagcgatcggaaggtaaaagtgctgtttacaagaataatccattggagatctggggattggggacgacttataggatagagtcctcttgttgagaatttcccgaatgaatctcatgtaggttctgtcacagtaagatggaggaaaactttgatggggtaagtatcacaagtggctgtcctatagggggaaatcctagcctgcagtaatgtcagtgtctcagtattcagccagcgagccactgagctgctccaggggtttaaaatagaatgcatagaatacaatgtatacagctggtgatgctttccaggatcaaaatagagcccttgtctgatcccattgacattgtaaggtttcga

SEQ ID NO: 5347 - DNA, 141 bp, mus musculus
ttacacatctgatctcatacctgatgttttttgcttttagccttgatacctctatatgtatttctatccatagaaatagacagttcaatttccttaatgagaaattagcataggaacaaatttctttccatcaagattaaa

SEQ ID NO: 5348 - DNA, 665 bp, mus musculus
catgagttaaatatttaatccttataacaatattttatgcatagagaaactgagacacaggcaaatttagtaacttacccggggtcacatagctactgggtggcaaagtcagggttagcacccaggacaaatgcctccacagctggtactgtgctctgctttactgtagctaatagtaaaaatggtagcaaaaatcaatagcagtagaacagtgcaacagatattaagcggaagaggaagactcacaacaatgacaacatttgtgctgaaatttttagaacacatggaatttcttcaggcaggtagagagaagatatagaaaatgtaaacagcaaagattgatagtttctctgtatgcctttcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggtgagattgctccacacaattatacagctctgttggctcctccttccccagcatgatgttttgtactggaaacaattccag

SEQ ID NO: 5349 - DNA, 4142 bp, mus musculus
aaatccactctctggtgctcggagggaactgcatttcctatggtgccctgcgactccgcagacgcggagccttttgggaaatgaagtcttttctcaaagaccttgccgctcaactggatccaggcccttgcatcttggcggatctgaggcgtttggagggacaacaacctagatgtggagccgaaatttgagggtgtgacctatcttatgcggagcggacctttgaggatctctgagtggaaggtgtactacaaattcttgcaatcctcacgctcttcgtctgcggcgacagttcacctggggtgggcctgatttgttcctgactctagcaaacaaaccccgggaccggggagagctgggatgttggagcgccctgaggccaggctacttgggggcaaactgaggaaagagtgttgaggattatttctagagttcaaaggtcagaggtcaatgtagcgaggagttgtgggggagtccaaagtcggaggggtgcttaggggagaattagggagggactgaatactcaagggacagatttgtggataagtagcttggagggaggagaaaccgggagggggcagatggcgtagtgctggggaggcggggacacaggggaagagagagggggaaaggaatcccctgaatattcattcccagacttcaggcctgtcagtcgcagtctcggtcgtacctcccctagttgcaaccttagctgttggcagggtgaagagatggcttccccgtctagacagcccccgccaggggggtcaggactgcttcaagggagccgggctcgttcatatggaagcctggtgcaatcggcctgctccccagtgagggaaagacgcctggagcatcagttggagcccggagacaccctggctggactagcactcaaatatggggtgacggtgagttttccaggattggggtgaagacaacagtcaggagggatttagtcctgagaagaatgtagtggcccttctaggtaacctcccctgaaatgttcctaatgtgttgcactctgttctgcctttatctttgttttcccatcacagtgttgcacaagtcctgccctactattccaacggagaggaacagctcctattttattatgccagacactgtgctgagggcttcacatacgttagctcatttcaccctcacatctgtatcaagtatacatttatcgttcccttttggcagatgaagaaactgagacttggattggttaaccagtttggctaaggtcaaataatgagcgtcagatttgggattcaaacaggtctgtctgactctattaaccacacagaaaattttatgttgagagtgattaaacgtttacagcaactaatggagagctgatttttagttctcagttcctaaagtgcccacctctccttgctcttggttcctcctcaatgctctgccttctttccagtaaggtggcctcctttgtgcaaaacaggtactctacaccaagtatttcaggtcatgcatgggggaaattggatagatgtaaaaatgtacagcattgaagttgatggggttactccccctatccctgcccctgttttcttgttccatctcactcaaacaaatgttgaatttagccaacatttttatgcttgctgtatttaaagcactgtgataacttttctgggagatagaaacttaaactatatggttgctgtcctcatgtaatttatggcctaatgagaaatgaacagggacacaaataatgattacaagtgacagaatgtggtgagtttgtaaaggtattaacaacgaataggggtcaggcatggtggctcacccctgtaatcccagcactttgggaggcagaggcaagtggatcacctaaggttacgagtacgagaccagtctggccaacatggtgaaaccctgtctctactaaaaatacaaaaattagccgggcgtggtggtgctcacctgtaatcccagctactcaggaggctgaggcgggagaatcgcttgaacccaggagggggaggttgcgatgagctgagatcgcaccactgcactccagcactccagcctgggcaacagagtgagacacacacacacacacacacacacacacacacacaaagataggaaatcagaaaagattaaatttcagttggaaaggggctgtggtgggccaggcgtggtggctcatgcctgtaatcccagcactttgggaggctgaggtgggtggattgcttgagctcgggagtacaggaccattctgggcaatgtggtgaaaccccatctctacaacaaatacaaaaattagccgggcatggtggcatgtgcctgtaatcccacctactggggaggctgaggcagaggatcacttgagctggggaagcggaggtttcagtgagccgagatcgcgccactacactccaggctgggcgacagagtgagaccttgtctccaaaaaaagaaagaaagaaagaaagaaaatacgaatacactatatctgtagtttctatatttcattatctaattatgataataattacataattataagtaatagtttttaaataaagcattaatgagcccctgctatgtgtcaaggtctgtaggatgctaatgacttcctggggatacagagacagcaagtcacaatccttgcccttaaaggacttatagggtttaggcaaagcagatatttaaagaggtgaataatattatagtagggttatgtattattatagcaatatttacagtatgcattgggagccctgaagaaggtagcacaaagggagtgatagttgatgaatacaagttttccaagcagagaatgggatagtaggggggtgggagcatttcaggcagaagtaacagcatgaataaagtgtgaaaaagatcatggaatgttcaaagaaaaataaaaagttcaggatagcaaaatgtagaggtggcagagggagattaatctagacatttcctttgggagctggattgagaaagcccttgaatgctaatttggtttttatcttttagccagtgcggagccataggtgggtagtgggttaatcagatttatttttttagaaagatagatgccaagaggaggatgagtagaaatagagcgaggaaggccagttaaactgttgcaataaccccagatgagaaatactgagggtctattttaaatctttggcagtaggaaggtgagaccagatgtgagagagatttttgaagcagttttgttgaccacttggtatggtgatgaaaggcaagtattagttaaggatgacattgatgtttctaccttgggaggccaggcagatagatggtgatgccagtcactatgtccagtgatgaataaataggtcaaaataaatatttattaatgacattgttaatagtatagtgtgaaaagcattctcagaagcagtgaaaagacccaggattgtcattctagctctgtcattaacttgatagataattttaggaaagtagcttaacctctctgagcctcagttccttcatttttatttattcattaatttatttattcatttatttttaattttttaatttttagaaatggcgtctcactatattactcaggctggactctaattcccgggctcaagctatcctccctcctcagcctcctgagtagctggaattataggcatcagacattgcgcctggcttgcacaataattttttaaaatgtaagggggccctaagaccaaaaagtgtgaaaaccactcatctatagaatagaaataatgtcagccctttgtactttagcttggttgttatggaatcaaagaagactctgtacagtcactttaaaaagctcaagatgtaagattgatcattattactgtccttaattttggtgacttttttttttaagatggaacagattaaacgtgcaaaccgcctttatactaatgactccatcttcctgaagaaaaccctctacatccccatcctgacagagcccagagacctgttcaatggtttggactctgaggaagagaaagatggagaggaaaaagtacacccaagtaacagtgaagtttggccacactcaactgagaggaagaaacaagagacaggagcaggacgtgccaatggtgaagtcctccccacacctggccaggaaa

SEQ ID NO: 5350 - DNA, 4142 bp, mus musculus
tttcctggccaggtgtggggaggacttcaccattggcacgtcctgctcctgtctcttgtttcttcctctcagttgagtgtggccaaacttcactgttacttgggtgtactttttcctctccatctttctcttcctcagagtccaaaccattgaacaggtctctgggctctgtcaggatggggatgtagagggttttcttcaggaagatggagtcattagtataaaggcggtttgcacgtttaatctgttccatcttaaaaaaaaaagtcaccaaaattaaggacagtaataatgatcaatcttacatcttgagctttttaaagtgactgtacagagtcttctttgattccataacaaccaagctaaagtacaaagggctgacattatttctattctatagatgagtggttttcacactttttggtcttagggcccccttacattttaaaaaattattgtgcaagccaggcgcaatgtctgatgcctataattccagctactcaggaggctgaggagggaggatagcttgagcccgggaattagagtccagcctgagtaatatagtgagacgccatttctaaaaattaaaaaattaaaaataaatgaataaataaattaatgaataaataaaaatgaaggaactgaggctcagagaggttaagctactttcctaaaattatctatcaagttaatgacagagctagaatgacaatcctgggtcttttcactgcttctgagaatgcttttcacactatactattaacaatgtcattaataaatatttattttgacctatttattcatcactggacatagtgactggcatcaccatctatctgcctggcctcccaaggtagaaacatcaatgtcatccttaactaatacttgcctttcatcaccataccaagtggtcaacaaaactgcttcaaaaatctctctcacatctggtctcaccttcctactgccaaagatttaaaatagaccctcagtatttctcatctggggttattgcaacagtttaactggccttcctcgctctatttctactcatcctcctcttggcatctatctttctaaaaaaataaatctgattaacccactacccacctatggctccgcactggctaaaagataaaaaccaaattagcattcaagggctttctcaatccagctcccaaaggaaatgtctagattaatctccctctgccacctctacattttgctatcctgaactttttatttttctttgaacattccatgatctttttcacactttattcatgctgttacttctgcctgaaatgctcccacccccctactatcccattctctgcttggaaaacttgtattcatcaactatcactccctttgtgctaccttcttcagggctcccaatgcatactgtaaatattgctataataatacataaccctactataatattattcacctctttaaatatctgctttgcctaaaccctataagtcctttaagggcaaggattgtgacttgctgtctctgtatccccaggaagtcattagcatcctacagaccttgacacatagcaggggctcattaatgctttatttaaaaactattacttataattatgtaattattatcataattagataatgaaatatagaaactacagatatagtgtattcgtattttctttctttctttctttctttttttggagacaaggtctcactctgtcgcccagcctggagtgtagtggcgcgatctcggctcactgaaacctccgcttccccagctcaagtgatcctctgcctcagcctccccagtaggtgggattacaggcacatgccaccatgcccggctaatttttgtatttgttgtagagatggggtttcaccacattgcccagaatggtcctgtactcccgagctcaagcaatccacccacctcagcctcccaaagtgctgggattacaggcatgagccaccacgcctggcccaccacagcccctttccaactgaaatttaatcttttctgatttcctatctttgtgtgtgtgtgtgtgtgtgtgtgtgtgtgtgtgtctcactctgttgcccaggctggagtgctggagtgcagtggtgcgatctcagctcatcgcaacctccccctcctgggttcaagcgattctcccgcctcagcctcctgagtagctgggattacaggtgagcaccaccacgcccggctaatttttgtatttttagtagagacagggtttcaccatgttggccagactggtctcgtactcgtaaccttaggtgatccacttgcctctgcctcccaaagtgctgggattacaggggtgagccaccatgcctgacccctattcgttgttaatacctttacaaactcaccacattctgtcacttgtaatcattatttgtgtccctgttcatttctcattaggccataaattacatgaggacagcaaccatatagtttaagtttctatctcccagaaaagttatcacagtgctttaaatacagcaagcataaaaatgttggctaaattcaacatttgtttgagtgagatggaacaagaaaacaggggcagggatagggggagtaaccccatcaacttcaatgctgtacatttttacatctatccaatttcccccatgcatgacctgaaatacttggtgtagagtacctgttttgcacaaaggaggccaccttactggaaagaaggcagagcattgaggaggaaccaagagcaaggagaggtgggcactttaggaactgagaactaaaaatcagctctccattagttgctgtaaacgtttaatcactctcaacataaaattttctgtgtggttaatagagtcagacagacctgtttgaatcccaaatctgacgctcattatttgaccttagccaaactggttaaccaatccaagtctcagtttcttcatctgccaaaagggaacgataaatgtatacttgatacagatgtgagggtgaaatgagctaacgtatgtgaagccctcagcacagtgtctggcataataaaataggagctgttcctctccgttggaatagtagggcaggacttgtgcaacactgtgatgggaaaacaaagataaaggcagaacagagtgcaacacattaggaacatttcaggggaggttacctagaagggccactacattcttctcaggactaaatccctcctgactgttgtcttcaccccaatcctggaaaactcaccgtcaccccatatttgagtgctagtccagccagggtgtctccgggctccaactgatgctccaggcgtctttccctcactggggagcaggccgattgcaccaggcttccatatgaacgagcccggctcccttgaagcagtcctgacccccctggcgggggctgtctagacggggaagccatctcttcaccctgccaacagctaaggttgcaactaggggaggtacgaccgagactgcgactgacaggcctgaagtctgggaatgaatattcaggggattcctttccccctctctcttcccctgtgtccccgcctccccagcactacgccatctgccccctcccggtttctcctccctccaagctacttatccacaaatctgtcccttgagtattcagtccctccctaattctcccctaagcacccctccgactttggactcccccacaactcctcgctacattgacctctgacctttgaactctagaaataatcctcaacactctttcctcagtttgcccccaagtagcctggcctcagggcgctccaacatcccagctctccccggtcccggggtttgtttgctagagtcaggaacaaatcaggcccaccccaggtgaactgtcgccgcagacgaagagcgtgaggattgcaagaatttgtagtacaccttccactcagagatcctcaaaggtccgctccgcataagataggtcacaccctcaaatttcggctccacatctaggttgttgtccctccaaacgcctcagatccgccaagatgcaagggcctggatccagttgagcggcaaggtctttgagaaaagacttcatttcccaaaaggctccgcgtctgcggagtcgcagggcaccataggaaatgcagttccctccgagcaccagagagtggattt

SEQ ID NO: 5351 - DNA, 4142 bp, mus musculus; identical to SEQ ID NO: 5349

SEQ ID NO: 5352 - DNA, 1075 bp, mus musculus
gtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagataaaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttcgagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctc

SEQ ID NO: 5353 - DNA, 2704 bp, mus musculus
taaaagaaatgtatattgctcattgatgcagagacctcctctgtgttggatgctgggcgcacaaacacggataagcctcagcccctgccctcaaggtgttcacagtcacaagggggaagacatgagcaatcagaccatcaatacagggtgatctgttcagcaactgaggggtttatggcagctctgggggaggcctggcctccaggagatgctcctccctgaggctggcccttccatcccgcagccacaccagattccccaacttctcccctctgtactgtgtaagattccctgagcctgcaaaggtatcaattagctagtcagctttctaactaatgcaacagtgcaagtgctaatgagagaggatctgaggagctccttcctccttgccgatgtgccagtgggacaggaaaatacacccccacccaccccaccatgccaaggtcatggagaggacctaggtgagcctcccacacctggctcaccatccctgcccaggggacatccagccatgcccacatggatctttgaagaaaaatgcttcctctctgttcgtggtgactctactggtgggaatttcctttaacagaagaggaagaaagcaggggtggttggggggatggcgagagggactctgacatacgccctcctgtctgcatatagctttgctgcttgtggctgccaacactttcctgtttgtctgtctgcctgctgctcctcatcctagtgaggaccaaggcgtcctccccgacggtagccctccctgtcccaggcctggaagagcatccactgtgcctcactttatttcccgtccccattaccctgcctctggctgcctctcctctctactgcgggctcagcacacaacgctcttgtgttggggtggggtgaagggaagaactgctggtggaggagagtgcatctagctgccaaggcctggggagcacactcaggcaacccttccccttcccccacttttatctcaggagtcagctgcctgcccaccaagtcctcatcactctctctgtcttactcctccaacaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatggtgaggagtccagggataaagagtgtgggctgggagtgaagagggggccggcagctaccctgggcttggctgcctgtgcatgaataacttagttgctgttatctgtaatcagcagttctctttatatgtatatcgtgacaatataacagacaggaaatgtcgtggcctcacttttttttttttttttgagatggagtcttgctccgttgcccaggctggagtacagtggcacgatcttggctcactgcaacctccgcctcccaggttcaagcaattctcctgcctcagcctcccaagtagctggcactagcatgcaccaccatgccaggctaattttaatagagacgagattttaccatgttggccaggctggtctcaaactcctgacctcaggtgatccgcctgcctcagcctcccaaagagttgggattacaggcgtgagccaccgcacccggcctgtgacttcactcttcactggtattgtgaatagtgattgaataatattaattgcaaaaatggctgatatggaaatcattgacatatgagataaacactgactcaaattatatcaataatttgatatctacccactagtagaaatcactgatgcttctgtgtctttttttttttgagatggagtctcactctgttgtccaggctggagtgcaatggcgtgatcttggctcactgtaacctctgcctcctgggttcaagcaattctgcctcagtctcctgagtagctgggattacaggcgcccgccactaggcatggctgatttttctgtttttagtagagacggggtttcaccatgttggtcagcctggtctcgaactcccgacctcaggtgatccatccgcctcaggctttctaagtgctgggattacaggtgtgagccactgtgcctggctgcttctgtcttagtcgccctattaatgggaacaatgtgaggaaggaaggaagaaagggagagaaggcactagcaatattagcaatcacctccatggttcatgtatcctgatgtgtagtctgctgaccacctgcacatatgagatgctggttaaaaatgcagattctctaaggcgtgacccaggaaccaacttgttaaacaatttccccaggaaatgtgcggtttgacaactgctgccatatataccattcatcgtgttaggtgttttgtatatgccacctggttgtatctgccagtagcctatgaaattgaccaagatctctcagtcaggaaatagccaagtctagatttaaacttgggtctgtctgattccttaggctgtgttcaactatggagctatgtctgataccagtattattcaagtaatagccatggtcacaaactgatgttattactgcccatcagcatgtcactaaccaccatgtctgctggttatttcacatcagagcagagaagggaggcaggtcacagctagaactgaggaccttatttcttttcatctcgccctcccaactccccactttcagatac

SEQ ID NO: 5354 - DNA, 2704 bp, mus musculus; identical to SEQ ID NO: 5353

SEQ ID NO: 5355 - DNA, 2704 bp, mus musculus; identical to SEQ ID NO: 5353

SEQ ID NO: 5356 - DNA, 1280 bp, mus musculus
ctccttacagagcacttatttcaccattaacataacatcacctcttcaggtagctctgctttactctcttcttgtgagccccatactgactcatttattttgacattaacagaataagggcttttaacatggaaatttatatctttcacagggccttggtttagaattagagatgtccagggaataaactttgaatcacagaagggctaattaaggctaataagcagcaggaagcaagctggcctccctactttctgctcctctgaggtgtgactctgtaagctacttgctttactgtcacttttgatttcccatttaaaagaggaacatgaatgtggattaagcaaggctacttaaatatttaataaaaggtggaaatgaaaactaatcaccctagcaaaataaaaaaagcataaatctaatcaacagaactaccaaaaaagagccaaaatatgttgttcaaggccacacagctagtaagtgacagagtgggaattagaactaggtctacctgaccccaaaacccaaaactcatgctcttagcctctgcactataatgctgccttttttttttttttttttttttttgagacggagtctcactctgtcacccaggctggagtgcaatcttggctcactacaaccttcacctcccaggttcaagtgattctcctgcctcagcctcctgagtagctgggattacaggcacccaccactatgcccagctaattttgtatttttagtagagacagggtttcaccatgttaatcaggctggtcttgaactcctgacctcaggtgatctgcccgcctcggcctcccaaagtgctgggattacaggtgtgagccatcacgcaaggccaatgctgctttttaaatatggttccaggaaagttcagaaaagcatgggtagaagttctacggcagagcacaccagggacacaaggacaactagggacggttttgctgccagcaggatgtgggcagccagtccgggttcagccagggcaccctggataggcaggcttgctgagtttgctccctgtggacttcagtctttgggctgccataacctgttctctgtcctcttggatccctcattgcagatacctaaaggaaagaaaaccattgtgattctgtcatgaccccaagggaggccacagtgcaggtgtcctgtctgccttgcagcatccacaagggtccagactgacagggtcagtgctggagttttaactcctaagtccttagaacctccttcctgtgagtgattggaaattttct

SEQ ID NO: 5357 - DNA, 503 bp, mus musculus
aggatttttagtgcaggggaagaagttgtcaccacgcctctaagaggaaggggaagtctcagaagtattttcagtttatgacagaagggcaaaaacattgactgcctcaaggtctcaagcaccagtcttcaccgcggaaagcatgttgtggctgttccaatcgctcctgtttgtcttctgctttggcccaggtaaatgtcaatccagatcggtgtagtcactgagtgactccctggttttgtgcagcttgctcaacctaaatcgtctgtatacagttgtctggctctctgccaagggattggggcgggaaaggggacgctggcagtgttacctgatatactactacctcctctcaactttggatgcgataagcctgagatggttgtcggtgaacaatttcaattgtgtctgcatgtaagaaagttatttgctggggcagaggaaataagcttttgaagacaagactgtttgtggtttatgaccagcatcttgtgttataaaga

SEQ ID NO: 5358 - DNA, 176 bp, mus musculus
tcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggta

SEQ ID NO: 5359 - DNA, 1047 bp, mus musculus
tgcaaaagcaagtcccaggtgcctccttcacatgatgctggcctcaaagaccccatgaagagcaaaaagcagccactctctcaaaataacagaactgcctgcttcataaaagagcaaccacaagcccaagagaaagattctgtgaatccatctaaggacgtagaccccagcaagggcatctctgttccatgccaaaatcaagaggtttccaccaacaccatagaacaaggtcctagttccagcccagctagtgatagtggaatggcatgtgctgatgagaccagatcaaaagatgttgctctaaagccagatgggaacactggaaaacaaattcccccaaaacacatggaatgtgcaggaagcttcgaaggcgagttcacaaagccaaccttcttagagttgctttcaaaggccagaaatgcccattatctccggcacagggtcccccctgagtctgagaggttgcttagcattggagagatatttgggcatggggaatcctcatcatccagggcaggaaaggagtgtgaaaacagggtgccttctaagtttcttcctctctaaccgtttaacatagcctgacaataacatatgccattattgctaaggaaatgtgttcctcaaatgactatattaagcaatacagagaaaaacaaacaaacataattgaattacaattttattttaaactccctattattttccgggaatataatatttcttgaatgaacaatgctaatatatgaaaaaggagaggaagaatgaatcttctgaaaatattttaagtgatatgtttatgatgtcatcaaaaatatgaatatatattgatgactggacttgggaaaacagtaacagtcttgctttcagggacttcctgtttcctctaggagattctcatggtgccacctgctggcaaaacggcatagctattctctctgttttagtttgatatatagtagtggtaggaataggaatgtgattgtaaataggtactgtaacatggtctataaagaaaatctgctctttaaccacacccacgtgctctct

SEQ ID NO: 5360 - DNA, 268 bp, mus musculus
aatagatttttaaaatatagaaaatagaaaataccagaaggtataaggaagaaaattaaaactatcaaaaacctcaccattcacaaggcatcaaaattatctttgcatatttatttatagttctcttcatgttaaatgtgtatgtgtatacatacataagtagggttatcaagggtattatcttattataaaaagtatatattcattatagaacatttagaagacataataatttttttaaatgattgttactttatcattatttgga

SEQ ID NO: 5361 - DNA, 1799 bp, mus musculus
agcagatacagtcttttggcctcctcaagtattatataggagatgttctacctcctaccctgagatgccagtgtgtctacatttctcgttcaatttttccaaggtgagagagactctggctgcagagacagggctgagtgtccgtgtcgtccaggtgtggttccaaaaccagagagcgaaggtaacctgcttcttacttttatctgtccccatgttgctggtttcctgaaataatcacagtaggacattgtacttgctgccaggttttctcgccttagctcattggatagagtagttctcttgattcaaaaattctgttatcaataattattttggccacagcagccctgcagaaggggagagagaaggcattcattttagtgaaattgcttgtattttcctagcagccatgactgtggttttggccagccatctgtatgaataaatgtctttctgtgtcttttggtaaaagcatgttctttaattcatatttatttaatgcaaataccaaagttattttaaaagtagcatgcatataactggtccaagacaattttatgacagggtagaatgagtgccttttcttacttctcccagggcccagccctcactaatataggcccaagccatcatactgtcctctggatccaatgaagctctatattccctcatcatggttttagttttagaccttttgctcattcatctacctacctctaaaaatacatgtgccctgtggactgtttctcaagagccctgatctttagtggatgatatgaggaaaaaacaaactctatgtttcctctgctcttacactacaacaatcagcgcagaatgcttctgtgacaaaatatgtggagatattctccatacaccaagcaagcaatcaattgtgcagtggataccaactgggtgtcctctaattctgacactctctacctggaaatagtgtcagatttcacaggttgagggttcagccccacaagactgccctcctcttcaaatgccaattgcaagctccaggtggttttacctatgcttcggatcaactggctataaattgggattccagtgaccccaccccttggatttgattaatttgcagagcatctcacagaattcagggaaatacttacttatatttactgctttattacaaaggatattacaatagatgtgaataatgtgatgcatatggcgagaaatgggggaagggtgtgaagcttccatgccctccctgtgcaccccagcctccaggaaattccatgtattcagctgtctggaagctctctatccccatccttttgggattttatggaggtttcataatgtaggcatgattaattaaatcactgggcattgatggtcaacttaactttcagcccatcccttttccacagaggtttgggggtggggctgaatgttccaaccatctaatcatacctgggtctttctgattatcattctccaccctgaagctacctaggggctgacagctgtcagtcagtcattaacattcacataggtatcactctggagagtccaaaaattttaggaaccgtatgccaaaaaacagggtcaacgaccaaatatatgctttacagtatcacaggttatctcactatttgatcatgattggttaaggtagcatttctctaactgacatcctcagaacagggctgttgatgtgtaccaaagaaagactccatagtgcaataagttgcagaggccctatagcctatggattcataaagcacagggacacatttaaagctctgaaaaatcttgcaataaagaaa

SEQ ID NO: 5362 - DNA, 1799 bp, mus musculus; identical to SEQ ID NO: 5361

SEQ ID NO: 5363 - DNA, 1020 bp, mus musculus
gggagaataatatttgtcctgcttatctccaaaggctgctggaagactccggtgagccattttataaagtacaaagtgatctacaaatacaaggtcttattattattaaaaacacatctcatcttccactggaacgtttagataaaggagtgtggggtgtaataaagaactaagctagagcgagagaaacactgaaaaactaattacgaaatgtcacacaagtaccacaaagagagtgattacttgattaattaatgataggaaccctacatttaagtctttcagttatacttgcatcagtcctctttgcctatcagaatgcggtttgtttctgccaacgaataactatcaaaccactgaggcctaactgatgtgtgattaatgtgggctccattaattgtgtggctgagttttatgcatgaagctgtatccttgatttttcacctttaatttcctcctgtttaactgctggtcataaaattgtttcaaatgtatctgctgagtctgagagcaagttttgcaacttgaaaagtgcctgagtcagtttgggcatcttgtttggtaaaaccgacttgggggaactcttaacgctgtaagatgaattgctacttggcttccactcccagccctgctggctcccttcctgccactgctcactggcactgcatctcatctattatcattaagcacatgcatagcattgataatggcaaaaggcttaataactttctttctgatagcccatcatatgtggctctattcaaccttattttagacagctagagatgatgacatctgtctttctggtctttttcacattcatttaccatctctgttaatatcacctgattttcttttggggcagcaccccttcccatctctgcttttattttctgtgtttcaagtagggctggtctcatttccctggctccggagctaggcctggacaattagaattccagtgattggttcggggataggcatgtgacccaagctcggtcaactctcggtcaactagag

SEQ ID NO: 5364 - DNA, 1379 bp, mus musculus
gtctctaccacagccacctctgaacattccaccgggaccaccatgatccatgaggccacctcttcctccccacatgccaccagggccacctctgccatgatcaccacccgggggtgggaagggtggcgggaggaagccttcaggctttggagccttacacttgttgctctctgttctccaggcgaagttctggtttccacaacccggattgggacactgcctgtctccagcttggtgctggacgtttcctcctccagaggtgttccctcgggaaccctggggtcctcttggagggaggcctcctctatctcctccacggcctcccatgtgacccatgggtcccccaggacttcctgggcctcctggacctccgcagagtggtggtggcatccctctgccctcatggggtggcataccaccctgcatactgttcactggaggcctcttccgagcaagagagactttaagtttgctcccttgaaaatctttcccatcaaaccattccacggcagctttggcagtaggtgagtcttcacaggacactgtggcatcacctttgggctttcttgtttccttgtccaggtaggtgtggatcatgggttgctcagttctcttgttcatcttaacaaccccacactgcttaaagaagtctaccagatcatctagagtcacattgtcatttaatccttgtacataaattgcactgttgtcagagtcttcatctggatctacaggtgggcctagatcaagatctggtccttcatccatgggtccaccaggcttattgaagccaacttgctctccagcgctgcccattccaccgcatcctcctccccgcccacctctgctcatgcctccacgatcaaatccccctcttcccctgccccagttatcagggccactcatgctccggttctctcctagtccggaaaatcctccagactcctgcccataaacacccatgctactggggtggtcctgtcagaatgaactctgctgcccgtagctgctgctctgttagctatactgacttggagcttggctgtaggatcaagtttggggtgggtaactagtgggaggcagctgcccatagctgctttgttgaccatagctactctgctgtccatagctgctcggtttcccataggtgttctgctgagagtaactgctctgatcataactagttggctgtgtagaggaatagctggtaggagggtaggatggaggtgcggtgactggctgcatggagtagctcccaggtacctggggataactgcagttactctgtccatatcctaggctgggctggttgtaaccccctgtgctagattgaggttgactagtctcagtgggcttgtttccattctgcagtcttgtag

SEQ ID NO: 5365 - DNA, 1387 bp, mus musculus
tactgaggattacgtctagtggttgctgggcagcccctgaaatgtctgaacagagcagtgacaggatcgtatttacaatttagagcgtctcttagggatggcgtgtaaccacctggtggcagcagggatcaggcaaggctggctctgcagcaaaattagaggaggtaggtctccagctcctctcaaaatagcagttataacaaagcatcttggatggcaggacatatacatatgcccaagcacaaagctcttgctttcaagatgaagaaattcataggatgatagattgaggggaaaggtcttccatgagatattctggtccgttctcttcgattcaggaggatcaggtgttttcactcctgctttccgaaggaagcctacagctcaaagaagttaaatggcttgctcaagtggcggcagatgtagaggaagagtctagacagtctgcctccgtcccaccccaacagcacacacattcaccaccccccataccacacacactacacatgcaacacacaccacacatcacacaccacacacattacacccaccacacaccacacatcacacactgcacaccacacatactacacacgccacacacaccacacacagtacacaccacacacaccacatgcagcacacacactacacacaccacacacaccacacaccacacacacaccacacacattacacactcaccacacacactacaaacgctgccacatacacaccacaccacacgcaccacactacacatgccacacacaccacacacacgccatacacacaccacacacaccacatacatcacacactacacacacactacacacaccacacacccaccacacaccagacacatcacacactcaccgtaccacacacactacacacaccacacacatcacacactcaccacacacactacacacaccacatacacacataccacacatatgccacacacaccacataccatacacacactactctcacagagcacagcacacacacgctgcacatcactgacacaccacacaccacacacactgacacaccacacacactgacacaccacacacaccacataacacacagacacacacacacacatacaccccacacacctctctcatggcagaaatccagagatcagagtttttgatttccaaaggcttctttcatatgagtctaagctaagagatttggtttctgaagatcataaaagtaataatatcttctgattagaaagcattttcatgtaatacataatgtgcattatgtttcctgagcacttactacatatcaggcattctgttgtgggcttatatttattattagtacctcattttatgcttgcaagtaccctgtgaggcaggta

SEQ ID NO: 5366 - DNA, 297 bp, mus musculus
tgaatccatttcctgttttagtccatattgcttctttgatatggaataagacagtaatgatgactccaggatttttttcttttgcatttctttttccaagactagagtaaatgctggaaacacattaaagttagaaatagagacttgaatttattctttaataaaaaatgttccttgaacatttaagtaaaaatgtatctatgatacaagcattttctaatttaagataatagcaagcagaagaaaacaagttaaatgtaaattttttttctgtttcctgctctgtatgtaaagtca

SEQ ID NO: 5367 - DNA, 297 bp, mus musculus; identical to SEQ ID NO: 5366

SEQ ID NO: 5368 - DNA, 2586 bp, mus musculus
atactttttttctttctatgcgttaatgtgtaggggttggtgtgtgctggattggctgatatggccagacctgcagaaaaacttagcacagctcaatctgctgttttgatggctacaggtaaattaaataaatatcttctgtgtttcttgtagaacataaatgatttttgttttcttttatatcagtttatttagtggcttagtgtttgaaatacacccacacacaaaggaattaacagtattatgtctaggaagttattaagttatggatggaggagtcacagaaagaataagtatctgaatgggcttttgcttttcaggtttttgccatgaacatatttttataagtgggaagaaaattacagttaatagtcactttaaagattcctctttcatgtaagaattgagtattttctgtgacactaagttacagaaacattgaaaattcagagtatagcatttctttgtccctcatcctacattattgttgtaattactttactcaatattaagtattcactgaagttattgaagcagtatgtattctttttaaagtaacattttgtttcaacagggtttatttggtcaagatactcacttgtaattattccaaaaaattggagtctgtttgctgttaatttctttgtgggggcagcaggagcctctcagctttttcgtatttggaggtaagcctaccagagatatttttaaaactgttgcaaaagctacttagatggcactaattttttttttttttgagacggggtctcgctctgttgcccaggctggagatggcactaatttttttaaaagattcatatataatgctaagacaagaagtatctaaagtagaaatttaacatttctagaaaagtctaggggtttacaaataagttaaccagttaactagttaactgactaaaatcagttaagcagtatgttacctagtttttagatttaactgtgcatcatttagatggttaaccatctcacataatctcttttattaagacaacatatacagtttatgatttattaatttcttatgtaaaccttttatcactttcaattgtatataataaattggaacttaagtgtattgttatgtagtattggaaatgatacgtagagtgaggtctttgctttcattggaaagtgttccatgagcactggaaatttttaaactatttactcagtagttaatattgtcagtgatttatgataatgacattatgatcaaatatttgaaatcaggatcttttgagaaacctaggaggtatggttggcttcatggaataagttccttcttatgcttttatactactctccattccattataagctaggaggaatagtaaatgaagcccaaggtatggtagaagggaaggaaagactatggctctgtggttacttctttggattgagaattgaggaaatggtccttagcgtttgtgaacttaagtgtttacaggctgttaacccaatagcctgcctgcatcacagaagtatattttaccttagtggttagaagtatattttactttagtgattactttagtatattttactttacctgttgatcttattcttaggaaaggtgctttgcgagtataaattttaaaattctaggtgaccacattttactaaattttatacatatgttcacaagtttgtcacgttcttgtagaattccagaatgagaatatttttattaaaataatacttttgcacaggaaactatatgtcagctaagctgttaaaagtttttggcaggccgggcatggtggctcactcctgtaatcccagcactttgggaggccgaggcaggcagaccacaaggtcaggagatcgagaccatcctggctaacacggtgaaacaccatctctactaaaaatacaaaaaattagccagaagtggtggcgggcgcctgtagtcccagctactcggggggctgaggcaggagaatggcgtgaacccgggaggcagagcttgcagcgagccgagatcacaccactacactccagcctgggcgacagagtgagactccatctcaaaaaaaaaaaaaaaaagtttttggcagttgtgctcttattatctgaaacaaaatccagatgcaaatgaactctttgaatcctttcctttctgcctgtttctacctgtaagccctccgggaagattctgtttacaactgtatagctacttgaccaccaagaaagaagaaatggagtatgcttcccattctctccttaccataaatttgtctattattattgatgattatttttctttctgttttctttatagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatactt

SEQ ID NO: 5369 - DNA, 2586 bp, mus musculus; identical to SEQ ID NO: 5368

SEQ ID NO: 5370 - DNA, 233 bp, mus musculus
tcaactgctgtttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcct

SEQ ID NO: 5371 - DNA, 1234 bp, mus musculus
aatgagaaaattctcagaaaacatttggagttcagagatagaactcactgcaaaattgatgacattctttacattattgtagctaacactgttaaaaattttaatacagtgatatagctatgggtttattcaactatagagttattaagtcatgaaaatgccacgattattataatccatagatgcgatctctgaagatcagaggagttaagatgttttcccagcattacatagtgcataagtcatggagccaaaactcaaacccaaatcttttgacttcaaaccagtgctctttttgccacagcacagattcacaggcttttaaaaggaaatgcaatgcataaagctgagatttttttatcttataaatattaatacctattaataatgtttcatttgcagtgaaattgtacgctttaacaagccaagtcatcaatggtgagatgcagttctatgccagagctaaacttttctaccaagaagtaccagccacagaagagggtatgatgggaaatttcattgaactgtccagcccagacatccaggcctctcagaaatttcttaggaaatttgttggggtgagttattcaactgcagcttgatgagaaggcaaagtccttgcaaacattgagctcgcatgcctctgtgttgttatttaagtcacgactaagccatatgacccagccaagagttctgccgcctgcaagccggttttaagatgttcagaaaggatgaaccatttttgatatgataaatataataacactgtcttaccctcccacttggcatttcactgtcctatcaccaactaatcttacatgcttcagaggaaggtgaattagcagtgttgatataaaatttgggaataaagaagacatctcttttagagtctcataaacgtttcatacccaaatgattgatgacagatcatgccttttgggatcttgggttgacttattgattccctgtaataaaaatgagatgttggcctggctaacacagtcaaaccctgtctctactaaaaatacaaaaaattagctgggcgtggtggcgggcgcctgtagtcccagctacttgggaggctgaggcaggagaatggcgtgaacctgggaggcagagcttgcagtgagccgagatcacgccactgcactccagcctgggtgacaggtgagactccgtctaaaaaaaaaaaaaaagttagaaggaaatacatgattatgttcagtttaaaaac

SEQ ID NO: 5372 - DNA, 395 bp, mus musculus
gaattagggcctctaactcatcagagcttcataggaagtagaaaaagaaagttcttgttcaggtgagaagtagctcctagaggcgcatggtttgcaaagtggacagtgcctacgtgcagggaaaaagaagttggtgcttctgggtggctaccgcccacacttggactgtttgcctggaaagggtggcaaggactggatttgaggcctcatttactttgcctgctacattgactctctgaggagacaagagacaagaggcataactactgcattgactctctgaggagacaagaggaatcgggagaaaactcatgtctgataaaaagctttaagaggttgttgcggggattatgattttaaacccccaacataatcttacaaaagcttcaccaaaa

SEQ ID NO: 5373 - DNA, 315 bp, mus musculus
tttgatggatactatttgaattggtgtaatatgctgaagtgtatgtaatggaaaaacattattattttctaaattgaataaaatggatttaataaatactgaaagcagaattaactaagcaaaaataagtatgttttgcttagaaaatggatggcagttgcttaagaaaaaaggtttttttactaatttaagaatatacagattgtctggggaaaagaaacttttttttgtattttacttgtacagtctcacatataaccactgttgttctcatgacactctcctatattgatgtgatctttatatgatttgtac

SEQ ID NO: 5374 - DNA, 592 bp, mus musculus
taacagtttgaattactgaaaaataatcttttattttagacctaatgatcttacaaatgacctgaaatgtaaggtttgttttgccttcgtcacagatgtaaattttgttttaaaaatatatttgaggccaggcgcgttggctcacgcctgtaatcccagcattttgggaagccgaggtgggtggaacacgaggttaggagttcaagaccagcctggccaagatggtgaaactccgtctctactaaaaatacaaaaaaattagccgggcgtggtggctggcgcctgtaatcccagccacttgggaggctgagacagagaattgcttgaaccggagaggcggaggttgcagtgagccgagatcacgccactgcactccagcctgggcgacagagcgagactcgtctcaaaaaaaaaaaaaatatatatatatatatatatatatatatatatatatatatatatatatatatgataataattttagcaaactggaagattcaagaaagtctggcaccttttatctaatgtgtgtttctagttttatttttccctacagtcttgacttttgttaagaattgtagagttctcatta

SEQ ID NO: 5375 - DNA, 116 bp, mus musculus
aattttaattttgtgatcaggaaagttctcccatcccacgccagtggtcgggaagagagacagagcagatctatggagggtctcataggccacaataaagggtttgtattttaaca

SEQ ID NO: 5376 - DNA, 2005 bp, mus musculus
ggaactttctgggataatggaagtgttccatatacaagggcactaataacataggggtgtacatttgtttaacattttttgaatagtatatttatgatcagtgaatttcactggaaggaaagtttaacacaattttaaaaattttattgagtacctactatggccctggaactcatctgggtactgttttggtactcaaaaaaaggccattaatgaaaaactcacagctaacattacaatcaatgggaaaaactgaaagctttttttttttaagttccagtgcaagacaaggctgcccactctagtcatttctattcaacataatattggaagtactcaaccaagcaattgggcaaggaaaagaaataaaaggcacacaaatcagaaagaaagaagtaatacatgcagaatacatgaccctgtatgtagaaaatcccaaaaactccaggaaaaactcttagaactaataaatgaataagtaactttgcagaatacaaaattaacatataaaaatctgtttaatttctgtacacaaataatgacctcttcaaaaaagaaattaagaaaacaatcctatcatttaaaaaaagtgaagtatttaggaataaatttaatcaaggaggtgaaagacctatccaaagaaaactgtaaaacattaatgaaagaaattggctgggcacagtggctcatgtctgtaaccccagcactttgggatgccaaagtgggtggacaacttgagatcaggagtttgagaccagcctggccaacatggtaaaaccccatctctacaaaaaatacaacaattagccagtgtggaggcacatgcctgtagtcccagctattcaggaagctgagacatgagaatcgcttgaacccaggaggcgcaggttgcagtgagccaagattgtgccactgcacttcagctgggtgacagagtgagactctgtctatggaaagagagaaagaaaagaaagaaagaaaagaaaaaagaaagaaagaaggaagacacaaataaatgaaaagatatccttcattcatggattggaagaattaatattccttttttttttgacagtctcaatctgttgcccaggctggagtgcagtggcatgatctcagctcactgcaacctccacctcctgggttcaagcaattctcctgcctcagcctcccaaatagctgggattataggcatgcaccaccatgtctgtctaatttttgtaatttttgtagaaatggggtttcaccatgatggccaggctggtcttgaactcctgacctcaagtgatctgcccacctgggcctcccaaagtgctgggattataggcatgagccactgcaccaggcctggaagaattaatattctaaatgttcatactacccaaagcaatctacagattaaatgtaatctttatcaaaattccaatggcattcttcatagaaatagaaaaaacagttctaaaatttgtatggaaccacagaagaccctgaatcaccaaaccaattccaagaaagaaaaaacatagttggggcaccacactacttcacttaaaattatattatacagttacagtaattttaaaaagtactggtataaaaacaggcacatagaccaatggaacagaatagcgagcccagcaataaacacaagcatatatggttaactaacttttgacatggcctccaagagaatacagtgaggaaagaatatttcatgtgaaaataaaggggctggaaaaactaaatttccacatgcagaggaatccaattggaatttgtctcacacatacacaaaaataaactcaaattggataaaaggcccagatgtaagacctgaaaccaaaatctcctagaagaaaacatagggaaaaagctccttgacattcactttggcaaggattttttagatatcacaccaaaaactcaggctataaaagcgaaaataaataggactgcatcaaactaaaaagctttggcaaagcaaagaaaataatcaacaagatga

SEQ ID NO: 5377 - DNA, 519 bp, mus musculus
ttccctccggggtcctagcacccactggcagtcccagttgtggtgctagttccctgttgcaccctggcctccagactctgggaagagctccccactgcattgtccctgctactatctcggtggctatactacccgctgggatagtgcagcttctcagttcctccatcatctacagaatccgtttctcatatttaagtctcttggtttgtaagtcttagaggggtttccatttcctgactggaccctattgttacactctagaaaaagatattacatagttctgaaaagagacccaaaacgatgaatacagtaaagtccatgttaattttaattcttgggaatggtgtgggttgatttcagttctattgtaaactttggaagcttcagatcaatgtttgccaaataggaaaaaataaatacattggtacttaggggaaggaaatgttatttttaagagtctaagctacatgtttaaaacaatagactgctttaaaaagaaaatcttaagatatataaaaa

SEQ ID NO: 5378 - DNA, 387 bp, mus musculus
tggttggtattttgaactgttttagcactttttgactcttctgctttgacacttacttacatcattatagtaggttatttgtacatgttctacttctcgtctttattattttatgtaaaactataagctctaagctctttaggacatggattatattttatgtctctcttacctttcttgtgcttggcccagtttcctcagagtacgtagagagataggatggtagcgtagagagagtcagacagatctatttacagatgacagatgactgctctgctgtggacttgctctgtgactttaaggaagatgcctacctctgtttgagttttgtgaaacggggatgatgataatatccatctcaccggattactggaaagattaagtaaa

SEQ ID NO: 5379 - DNA, 387 bp, mus musculus; identical to SEQ ID NO: 5378

SEQ ID NO: 5380 - DNA, 1546 bp, mus musculus
aaacaaaactactattgaatccgcagtccataatcaaatttcattattgttgcaataatgttttttatagccattttccccaaacccagatctaatttaggatcacatattagacagagttaccctatctacttagtctcttttcatttttattttcaggatactcttttatttaattggggtcaaatttacattcaattacttactgcactgaccttaagtgtacaatctgatgaattttgataagccctgtatatctgaatgcttgttaaaattaaatagaagccttgaaaatattattccataacagtttaaacatctttgcaatcaataaaccagataacaatttaaatatttgaaactaataatcttccctatttatttatgataagtgcatttaataaactgagcagtaatgatctgtaaatatatattagcatttatgttaataatatatataaaccaaactgattatcttattgcactaaaagagaaatggaggcacaaggaagccaaaggactttgagttgatagagtgatgcgtagtagatctgaaaagtttactaagctattttctcctattgtctaattctcaagcaagactcttctagattgaagctacgtggatgccagtggcattcagcagtctaactgccagttaaattacttagccagagacccaaccaattcaattcgtctaatacatgagaggaaacacatttggcagagagtcagcttttcaccctgttggtatcaatctttacctggcaaaatcaatactttatcacttgaggtcagagggtggccatctttgtaccatgtcagtgtaggagggggagcagcatttgtctcacagtaaagagaaatgggattgttgatgatcacatctttggcttcaccattcctgccagtatctagcatgtttcctatttcccagagtttctgaaaacttggaggaactatggaggaaaggcattaaatgttggtcacatataaatgcttaaacaaagatcttggctgtgttttcaccagagtgatttgtaaaagcaatagattagacaatgtggaaataatttcaagtactgacgccaccaccaactctagcccttagccaaaaaagtagtacacgaaagtcggagctggttgtcaagtggaagaacaagaagtatgaggctcagaatgctgtgtttatgctttgctctccccgttaaagggctctggcacttagacaataaaggggctcactctcaggaaggagcattgctaaatgatacacagcaggaaagactaattttgagaaaccattaaaaaatactggttcaattgagagcatttcacagtgatttggcttactaagaaggctaaagaaattatgcaatcaggattaaaaattccattaacaaaaataataggacattttcatacttttctggggacaagtatgaactttatgaaaggcaatttgcctgcacatcaaaagcattaaaagagtgcataacataaaatttatcacagaaaaaagtacatttaacctaaaatttccacc

SEQ ID NO: 5381 - DNA, 1546 bp, mus musculus
ggtggaaattttaggttaaatgtacttttttctgtgataaattttatgttatgcactcttttaatgcttttgatgtgcaggcaaattgcctttcataaagttcatacttgtccccagaaaagtatgaaaatgtcctattatttttgttaatggaatttttaatcctgattgcataatttctttagccttcttagtaagccaaatcactgtgaaatgctctcaattgaaccagtattttttaatggtttctcaaaattagtctttcctgctgtgtatcatttagcaatgctccttcctgagagtgagcccctttattgtctaagtgccagagccctttaacggggagagcaaagcataaacacagcattctgagcctcatacttcttgttcttccacttgacaaccagctccgactttcgtgtactacttttttggctaagggctagagttggtggtggcgtcagtacttgaaattatttccacattgtctaatctattgcttttacaaatcactctggtgaaaacacagccaagatctttgtttaagcatttatatgtgaccaacatttaatgcctttcctccatagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggtaaagattgataccaacagggtgaaaagctgactctctgccaaatgtgtttcctctcatgtattagacgaattgaattggttgggtctctggctaagtaatttaactggcagttagactgctgaatgccactggcatccacgtagcttcaatctagaagagtcttgcttgagaattagacaataggagaaaatagcttagtaaacttttcagatctactacgcatcactctatcaactcaaagtcctttggcttccttgtgcctccatttctcttttagtgcaataagataatcagtttggtttatatatattattaacataaatgctaatatatatttacagatcattactgctcagtttattaaatgcacttatcataaataaatagggaagattattagtttcaaatatttaaattgttatctggtttattgattgcaaagatgtttaaactgttatggaataatattttcaaggcttctatttaattttaacaagcattcagatatacagggcttatcaaaattcatcagattgtacacttaaggtcagtgcagtaagtaattgaatgtaaatttgaccccaattaaataaaagagtatcctgaaaataaaaatgaaaagagactaagtagatagggtaactctgtctaatatgtgatcctaaattagatctgggtttggggaaaatggctataaaaaacattattgcaacaataatgaaatttgattatggactgcggattcaatagtagttttgttt

SEQ ID NO: 5382 - DNA, 1029 bp, mus musculus
aaatcatttaaattcaagagctaatttgcaatagtgttgctttttttgtgaactgtgttccagaatgagaacctctggtagttcatttttttcatattgattaatgattctctaggcagtgctaagggtttagcttgtttgataagttgaagccaggcgcagcagctcacgcctgtaatcccagcactttgggaagccgaggcaggtgggtcatttgagggcaggaattcaagaccagcctggccaccatggtgaaaccccatctctactaaaaatacaaaaattagctgagcggcagtgttgcatgcttgtaatcccagctactcaggaggctaaggcaggagaatcacttgagcccaggaggcagtggttgcggtgagccaagattggggccactgcactccagtctgggcaagagagtgagattctgtctcaaaaaaataaaataaaataaaaataagttgaagttcatgtgaggaatgttggtagtttaccttcctaagattaaaggacttgtttcggtaggacttaattcttttaaaaatgcaccagatgatgagagaaatgagagcaaattttattccaccttttctattctaggtagaagagaagcaagtgctatgtagttttaggagaattaattttcttggtcacatccaaagaaataataaatatttcatgattatttgttattaaattcattgaatgcttgttagtttagtttgttaggacaatatttatttttatatagtacatgataaaactgtttctgttttatagcaggcaggatatattgcaggcagttacccctatacatctaatagttcagcaaccccaattaaagcacttcttttttctctgttgatacctctagccagccattatgtcagctttcaagcacataagaaaataaaactgaggattatagaagaaaaaaggattagcaaaaatccatcactaaccctgtataataacttaatttgtatactgcattgtagtgggtgtctggtgttatcaatattgcattgt

SEQ ID NO: 5383 - DNA, 1029 bp, mus musculus; identical to SEQ ID NO: 5382

SEQ ID NO: 5384 - DNA, 991 bp, mus musculus
tatcagaaaatttggttcacatttcaatatttataggatacttggatctcaggattgaataagaccttagagataatcctcagttcctatactcaattaccatttcagttagctcaaactgcaggtttcagctttgggagtaaagcaaaagaaagctggccagcacttgtgagtactgcccattttttcccatacttactaaatagcagtgtgcaagggcatgactcataaaccaccaccacctttgacaggtttgctttaagaatagacttattatgcaacttcagcaatagatcttcaaatagcttggggacagaggctgtgatgtgaagtttaagaagcatacttctgcaaagcttagttgtaatatatttgagactcattgggggtgctaaagtaaactgcagtcaataaaaggatagtctagtttttggaaacagatggcagatgtgatgataagactatacggaagttcctctatgatgaataatgaggcaaagtgtttactgaagagaatttaaaaagaaaagaactgatggttaaatgcagggtgattggtatcctggaatgaggcagggaaaaaaaaaggcagagtgcagaggtagagacccacagaaaataccaattgtgtatacaggatatacaactaccttaaacactttttacaatgagatgaagtataagttgttgaataaaaaattgtttaactcagaaagacacaaacatagaaaaatgtagacaaagaagaatagaggcatatccattaaaggagtatttgtccatctgtccatccacatacagatggacagatactcctccatacacacatgcacacaaccatacaaatgaattcagaaggactcacctacttagtattttagacactttttgaaatgaagtaggcaattaagtattccgtaaagaaagacatactaaggttgacagagacttagaaacccaaatacattgaaacacatgtcacagatacaca

SEQ ID NO: 5385 - DNA, 396 bp, mus musculus
ttccaatacatacagtagcttattatagaagaacttcataaaattgttgaaagaattaaattagataatttatgttgtatagtcccttgcactgaaagatagcaaaaataaaaaatgtaaccgctattattcctattatgttaattttttattatacatttactgctaagttgtcttttttctctgacagaaaaatataatgctaattaacttagaaatgtcttagaacctatatcagaggacactgtgactgagaaagacttccaaatatgctctgacgttgaatagcatgattttttatatccacatttaaataggaacattttatttaatgtctcaaaatattgcttttcttgctgtctcaacttccttttggcttactgtaagtttaacttt

SEQ ID NO: 5386 - DNA, 458 bp, mus musculus
tataaatgtgaaaaggccatggttaatgagatgtatagtactgcatatgttttttaaaaaaaatattcttttgtgtatacatatactgcagacagaggaagaaagtcgtttaaattttcaatagtgtgattaggcaaggcatttcaagaacaattctatttctggtaatttatttttcattgataattagagttataggcaagaaggttgttacaagaaacttattcataatatagatatgtaatttaatattcaacatggaaaaatttatgaactgcataaataagattgaacacgctgacattaaaattatgctttcaggtacattaaatgataaataaatattcacaataatattgtgaggtgaacacagtgtgtaaatatataaacagtgtgattcctacttgatgtttttatagaaaagtagataagggagtatgaagaaatgtgggtggaat

SEQ ID NO: 5387 - DNA, 188 bp, mus musculus
taaatgcaacaagaacaaatggaattcagacatacttggctcttttgtccctatggaacaggaatgttggccttcagagttcatcacagaataattcccatcaggaattgtggtgatatggaggtttattctaccctagcttgattaaaagtattgccagggatattcactatataaaatactgatgc

SEQ ID NO: 5388 - DNA, 2482 bp, mus musculus
ggccattttaggaccacttgggcctttgacttggtcattatagtcctgattctgcacagaggtgggcagaactaatgaaagcacatggcttataggaaaatatgagtgatctatgaaggattttgggactctctgagggagaagaaatccttggtggaggagtaaagttacaaataaaactataaattatgctgggaaaggcagttgaagctctgagtaactataattttgttattaaaaagatccatatattcaagtgtaaaaaaaggcttagtcatttgattttcatttaaatttgtctctcttaatggattaatgattaatcaagaggggaaaaaatataaaagaaacccttgttctctaaaaagagagcagagagcagaagagagcagcaaagagcaatggtccccaacctttttggcaccagggatgtttcatggaaaacaattttttccatgtcagcaggggtgctggtttctggatgaaactgttccacctcatcaggcattagattctcataaggagtgcacagcctagatccctcgcatgtgcagttcacagtaggtttcgcgctcctatgagactctaatgtcacagatgatctgacaggacgccgagctcaggtgataacactgattaccgctcacctcctgctgtggcctggttcctaaggggccacagtcacagtagtggtgcatgacccggggactggggacctggggacccctagcatagaggaaggttagccagtagcttgtacagagcccctacagggggcagggtaacttcattcctaggtctgatatacattttgtgaggaaccaaattttgacagtaccctctgagttgattaggccctagaggatcgacttctacaaccacacttaaaagagataaaccagaaatctaatttatgtgttcaaaacaagatgcccttcttccctgagtcttctgctaaaagcgtatccttttcagtatcacagcaactgagactgtttgaaagcgcgtttgctcaatgggcaaagaaaaagaacaaaagaattagaagagtgttgccttagtctatctgtgtgctgtaacaaaataccacagactaggtaatttatacacaatttaaattgatttctcacaattctgaaggctgagaattccaagatcaaagcattggcaactttggtgtctggtgaaagtctattcctcataaatagcctaccatctaggtgtctttaaatgttggaaagaatggaaaggctaaaagcgccttagctgtttcccccagccattctattaggcattgagacattcatgagggcagagctcttataacttaatcacttctcaaagggacctacctctaataccaccaccgtggggattaagtttcaacacatgggcccagaatgatggctcccacctgcaatctcagcacattaggagaatctcttgagctcaagagtttgagagcagcctagacaacatggagaaaccccatctctatgaaaaatacaaaaatataccacctcacaccagtcagaatggctattaccaaaaagtcaaaaaataacatgttggcaaggttgtggaggaaaagaaacacttatacactgttggtggggatgtaaattatttcaaccattgtggaagacaatgtggctattcctcaaaggcctaaagaaagaaacaccattcaatccagcaatcccattactggggtatatacccaaaagaatataaatcattctattataaagacacatgtaagtgtatgttcactgtagcactattcacaatagcaaagacatggaatcaacctaaatgtccatcaatggtagactggaaaaagaaaatatgatacatatataccatagaatactatgcagccataaaaagtaacaagatcatgtcctttgcaaggacatagatggagctggaggcattatccttagcaaactaacgcaagaacagaaaattaaatacttcatgttctcacttataagtgggagttatgtgatgtgaacacatggacgcatagaggtaacaacacacactgagacctatcagagggtagagggtgtgaggagggagtaggttaggaaaaataactaatgggtactaggcttaatacctgggtgatataataatgacacacagttatctacataacaaacctgcacatgtactctagaacttaaaagtacaaacaaaaaattaaaaaatttgctgggtgtggtagttcatgcctgtagtcccagctgcctgagaggctgagatgtgaggatctcttcagctggagaggaggaggttacagtgagtgagatcacaccactgcattccagcctgagtgacaaagtgagaccctatctcaaaaaaaacaaaacaaaaattcaacacatggattttggaagacattcagaccatagcagcctcaaaatttattttatccagattatgaaaatgtgtgatgaactatgcttgaacaaaa

SEQ ID NO: 5389 - DNA, 1155 bp, mus musculus
tacggtgacgaacctgatacaagacccataaaacacagattcttttaaaatctattttttcttggcaggggagaggttttcctccatcctctggcagttccctcaatgtaacataagaagctctgcagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaatagaaaaaaaaaaaagctctgcagattgctaattaggagaacaggattaataatataggtagtcaattttcattacctgttttgctagctactcttctgtgtagcagccttagcgcctgggagatataaaatagtaaatgtcaaagatacagggaaaacagggtgtagtcccagtttaaaataagcatctcactttagaaagaagtttccctaaatagtccatgatagcagatttacaaaaaagtagactataaacaatatgagagtgttctaaaaggatttcaagaactgaaagtgtaagtgagcaggacatgtggtatataagataggaaatactttcattcattttcttttggatcattttacccatttgatggctatttttttttttacttgggcagaccaaatggcgttatggggtttgggatttgaagagggaagatgatttacagataaccaacaattctctgattacttgtagttctattaaaaatttccaatatcctatcatatagttcagcataagaataaaacccttcttagttcacttaaagc

SEQ ID NO: 5390 - DNA, 1463 bp, mus musculus
aatagtatgttcttttgtgatagttataagattatcttatttgaacattgggggcatgaagctacaaaaataacattattaagaactaccaaaagatggtttttatttcacttagttttcataaaatcattagatcaaaagcggacaaaatattagaaggtccatatttgatatttttaagcaaaaatcttaaaagtcaaagtgaatattatgcaattttttttgaaaaaaaagatatacttttctaaccagatcttaaataatgacaaaactgatataaaaaataggctcttagatttattgattattgccattgcaaagcaatgaaaatattgttaaatctaatgggacagccaggcgcagtggctcatgcctacaaccctagcactttcagaggttgaggcaggttgatcacttgagcccagttgttggagagcagcctgggcaacatgacaaaactctgtctctacaaaaaatacaaaacattagacgggcgtggtggcttgtgcctatattcccagttacttgggaggatgaggtgagaggatcacctgaacctaggaaggttgaggttgcagtgagcaatgattgcaccagtccactccagcaagggtgacagagagatactctcactcaaaaaaagaaaaaaaatctattggggaatgggtgaaaaatgtttagtaattaaatgtactgaacactggaccacatgatttatgtaacttagttttcataaagaatatataatagatattataacccattttatgcatacagaaaaagagaggtttaaaatatttccccagggcacacatctaataagcagagaccctgatatttgaaactgtgtatattttactatggaaccatctaatttccaccacagagcaaatcttaaattaagagacaccccaatatcaattacttacattatatcaaacatgtaagtacttggtatatttttgattattcagttaattcatttatagtttaaattaacactaattcactgaacacacatgacagaatcaattttagatgcagaggacatattcagtgacaatatcttaacgctggagatgtaagacacgacaaagtttatagcaagtccgtgctggagatattggctattagaaagtacaggatctcactgattaaaacatgcctatttgctgactcactggcacaaactaaacaaataaaaacataagagaaaaagccttttatttgtgccagtttgatatttaacaagtattctcagatatttgctattgtttgttacagaaagaagagtctgatccatttttgtaatcataatccaagggaatattgataaagtgcagattcacacaagcaaagtgcctgaggaaagagccaaggagctagctggaggtaagagatcctatgttgtggtcaaataaattattggttctaattcctctcttttcaggatagtatacatt

SEQ ID NO: 5391 - DNA, 641 bp, mus musculus
aaagtaacaattaaaattgttcaggaggcaatggaaaatgtagagagcatacatgcataaatagatcactttagaacttgatattgtttgaaaaaacaaatagaaatgctagaaatacatggtaatggaaataaagtgtttagtgtgcaatcagaaaactgggcacagaagaggaaagaatcagtaagctagaagacaagttaataaaagttattcaaagtggaacacagaaaaaaagatacaaaaacacccagagcagagcatctgagatttgcatatcaaatagtttaacattgaagagtctccaatgaagtagggtctcataatttattaaagaattgatcatttcatctatttttatcattttttatataatactgtcagatcatcagattgatgatttggaactgtagttataatgtaataggcatttaaaatctactaacaatttgcaatgtcctttaagtttgaggttgagtgccacaaaattatcagaccaagaataaaagggcagagatagaaatatatcaaaccataattttttctgataccttgaatatggatttaaagaaacataatcagatctatttcatttaacaaggatttattgaatattttctctcatgcatatttttatgtgt

SEQ ID NO: 5392 - DNA, 567 bp, mus musculus
ctaattgtttgtaatttttccctagattattgttaaattttactaatacttaaaataagagaatgtaatcctttttcagtaacataacgccattccgtacatatgaaatgttccattttctaatagttaatatctcaaagtttgaatttatatgtctagtttttataatatcaaattctaattgtaagtatgcatcttaaaatcaaacgttattcatatctaatgttttctaatattgttatatttttgttgaatagaggtaatgtacttttaatctgtaataatgaggtaaaatacctgttttgaaaacgatttaatattcattatatgcaaatagcgatgaactagagtcagataacttttaatatacatattaaatttatgtatattaatttaaaatttaaaaccttggcaaaaaccacaccatttacatttactattgagacatatatacttctgcgataatttttaaataacatgtcacaactaacacttcttggtttgtttttatcagacctttatagagaacttcagaattacctgaaatatactttaatgtatttcaaa

SEQ ID NO: 5393 - DNA, 185 bp, mus musculus
attaaattttgaaagaggaatgaaataagaaaataaaaagtattaaaattaaaatattaaacctgaggaaaaagttgaaccataacaaaaagtaattgtgttgctatagttgtaatattttaaaaatagtattgacatagtcataataataacataccttcaatggcaggttgaaattccaatga

SEQ ID NO: 5394 - DNA, 335 bp, mus musculus
actatttatttaaatatataacttgaattttccgtgttttgaaattccattcaataatcacccaattaattgttctaaagattaaaaagtagtggaatatcagtttgttttataaagatgattagctatagattgatttcaaaatatacatagctgaaagttatccaaattatttagttcatcatgaactagttagcctctactattagatactaaaaatataggcttaattcacccttcccttaaagcatttctcatggtctccctggtattataactagtttggtaccgatccttttttcccttcttacgttaggcactccttttcagtatat

SEQ ID NO: 5395 - DNA, 224 bp, mus musculus
tatgagttttttttgctagttctgaatcattgtgttaaaattatgatttgttttagtatagtgcttcaggaaataataacaacacttttagtatttcaaataatacttttaaataaaaaatcttaggaaggttgaaatttctgaagttggcatatagtgttcctcatgctaatatgcttcttgaaaggttagaaacatttagaggtgccagtagttgttcaggg

SEQ ID NO: 5396 - DNA, 438 bp, mus musculus
aggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacattt

SEQ ID NO: 5397 - DNA, 438 bp, mus musculus; identical to SEQ ID NO: 5396

SEQ ID NO: 5398 - DNA, 431 bp, mus musculus
aacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacattt

SEQ ID NO: 5399 - DNA, 431 bp, mus musculus; identical to SEQ ID NO: 5398

SEQ ID NO: 5400 - DNA, 401 bp, mus musculus
aggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgact

SEQ ID NO: 5401 - DNA, 401 bp, mus musculus; identical to SEQ ID NO: 5400

SEQ ID NO: 5402 - DNA, 588 bp, mus musculus
ttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtaagtgtgat

SEQ ID NO: 5403 - DNA, 588 bp, mus musculus; identical to SEQ ID NO: 5402

SEQ ID NO: 5404 - DNA, 950 bp, mus musculus
gggttccgacagcagctcagcttaaccctctgccctgctaacgagggaaactgcggcggctccgcgcccagcacgcccggtaggccggagagagcggcgaggccttcggtgagcgaagagttaaccgcggcggagcgacagatcgcggagctgcacgctgccgcctgcgcggtgagactccctcctgcccgccccgccccgccgcggccgccccgggctcggcgcgcctgcgcatcccgggcctctccggacccggaggccgcccggcagaggcaaaggttgctggataccggtgcggtcctgcctcgggcgacattcgcgcacgcacacgaacttccagccccgacattttcgcgggaaacctgtgtctgtcttgagtatgagtgtgatttgttttccgatcagcgtccgagctaaactccggtcgcagtgtgggacccactaccactcttttgtggtgtatgtgtgtgtgtgttgcggaagggggtgttaaggaattgatggagaaggtggagggactgagaagtcacaacaaaaatgtgttgtgtgtttttctgcattgtcagttgaacacttagcaatccagtgattcttagagtgagaaaaaaagacattgacacatttattttaatttttccattgccttcttgtcctttctcttaactcttaacggagcagagggaactacaatctggcatttgtagacactcagctgttttctcctgttttgcggatttgacaattgtctgttagtaccagtatctaaacttctctccctttacgccttctaacacagtctgcgtgagtttaaaggcagcatggttacctttacaaaagaaacagtgagaaaaaaagagaaactgactataataaagatagaaaagcagtatgaaatgaacccatttaataagctatgtgtgtgtgcctccagtacttgatgggactaatat

SEQ ID NO: 5405 - DNA, 785 bp, mus musculus
ttacattattctgtagtatcttcatgaaaattccctctattaactcttgtcataattgatgccttcctttttgacccctccatagcattcattgtgtgtcccatacatttgacctgaatattaggcctttattatatacatagcacaagtctagttatttcctatgtcttccccaaatattaaaccttttttatttttgagaaaagaggtttttttatacctcgattgtatttttaaacatatgaggaaaatagtaattgttcaacaagcattttaaaaattgagttgtgatgtagtaactctttcatagataagacattttgtcaagaattctggggaaagagaagctttcattatgaagagctactgctggcacttaccattcttcataatgtaagtcaagggaaaggcaatgacgtggacccagcaggacttgttcaagtcttactttccttctctgagaccagtaagtgctatgtggggttatcctctcgagaatggaagtcagagtgctaactattttcatcctattctgtagcaagcaacacccagcatcattatgaatttctcatagggagagcattccagggaccagtcctggtgctttgattgggaaggataaaatctttttgccctgaatattttagttatgttactgtagtagttctttccattttgtaagaacagttaccaccatagagtttcaggaggcacacttgaaaggaattaagagactcaaaggagcattgaacaagtcactaatgatgaccgcaaaatcactacta

SEQ ID NO: 5406 - DNA, 883 bp, mus musculus
ggctgccttgaagacctacaatacttttggtagtaaatagttccaggtgtgtaactgaaggactctgagaatgatgcacaagccaagtcatattttaaaactcatttagacatcttgatgagggcaatgagggacatgtcttgtttttctgggattatgatttcattgctttgcatgagtaaagacctatttctttccttttcacttcagttaatttgctctgcaaataggcatcaacagagatatacttaataaagtgtgaaacataaaaatggaaaacttcctatttgtttcaaccaaatatatgggagagaaacagtgcactcactagcgttggccatgcattcgtcaaggtgcagtgtcaaagtcaatgtgtgttacagtgaaggatgttgcattcaaaggatggccttgctatataaagcaggacatatgaaagcccaatataccatctaggctatgaattacctttcccttttctatttgccacctccttcccttttatttttaatgataatgaaattgaattaggtattacatgtcaacctgagccatgtgtcttcagtgtccttgcatttatcatcaaatacagtgcatgccacctcagtacacacttccaggctgggctgctttcctgtctggtccaacgcacaaggacagagcagacatatcagagattgacaataaggcacactgatgtaatgtatataatgtgtcacattgacaagtcaccccaggaaacactaaagggcccagccaacactgtttttattatagcaatgcttttttttagaagaaatctatgttaagacagattgatttgtagataatttgaaggtaaaatagttgctatcacttctgaagagatgccaatacttagtcc

SEQ ID NO: 5407 - DNA, 967 bp, mus musculus
atttcaagctgaaattatttggttgcttctgtacgttggttgttatttagtacacactgacctctttgttattctgttaagtagcccaagatgatgatgtattgaaaatgtatggcttccttttgtgaaagcttaggttttaccaatcacctgttggggcatctcatcatttatctctcagaaatagaagcacagaggctatattttatacctgctcagtcatctaaggctgttgactagcaagaaaacacactctgttgactcaaaatcctgccccacatagagcatccagcttggttgttagggtatttgtttctaaagatcaagcaacaatataatacactctgatgatccagaacagatgtggggataaagcctaagctgaaaatattcctggggaacttaaactaggatcagaggcatttccaccaggcacgtggcaagttgtagtttggaaaatgtgctctgtcttgtatgacttcagtgtcccactgagctccccacctttgacatagttgcaatgagagaaggttggatttgcaagtggtattgacctcgttgccaagggaagtaaaggagatttggttccactctccatccctaaatgtgacggcagggaaagggcccctgaaaaaaaaaaaaaaaatgaagctgaccccagtatgcttgctacaatttggtgcttgtgtatttgtatctcttttcttcactacctctactttgaagatgattgtattcattttgtttgggtgctatattccatgcctaaatcccagagaaggcattaacaaagtgttggtactgacagactgacaaagatgttggcctactcaccagtccctaaatcatatgagcatttaactgttatagttaggtttgtgggttctcttttctctattcatattctatttctctctccctccctctgtccctctttctctcttagtcactacctagttaccttgtt

SEQ ID NO: 5408 - DNA, 1626 bp, mus musculus
aaataagtagaattaaagctgtactaggctagggcacatttatattactgacaactatagattattcagtaatacctctcagtgcaccagtaagcagagagcatggagagctaataaaagtaatgaagtcttcgtagtacgtgaactcactgctattaaatctcttctgagaaataggatgagcctgccaagtttgttgggaggaaggctgaatgtgtaggctgttgaagtgaaaataagtagagccatacggcaatggtggctgagagagataatggcattaatgcccagaaactgagtgctttacctagccttcaactttattaggaagcaacgatgacataaaactggatagggtttatcacgtttgtacttgtcagctaaatctacagataaaaattatagttttataataatccaaagcttgagtgtaccatgtggctatcaatattgaggagccaatagaggtatagctacataacataaacgttatatttttcatgtgatggctgaccatcatttgccatgactgtttaaggagaggaaagcccattgaagcatcctagttactcagaatccctgaaaggccatgatgatgttgaggtctatagaaagtgctactcaagccgggcgcggtggctcacgcctgtaatcccagcactttgggaggccaaggtgagtggatcacaaggtcaggagtttgagaccagcctggccaatacagtgaaaccccgcctctaccaaaaatataaaaaatatctgcgcatggtgacgtgcgcctgtagtcccagctactcagaaagctgaggcagaagaatcgcttgaacccgggaggcagaggttgcagtgagccgagatcacgccactgcactccaccctggacgacaaagcgagacaccatctcaaaaagaaaaaaaaaaaaagtgcaactcaagttgtgggtcagtcaaggattaagcagacaacgcagcatgccggtacagtatcctgaggtagtaacagtgtggcacatctaccacctctagcactaaagggtcaagggaagggaaatgttactggaatccagagagagaaaagactgtgcagaaaagatcacgctacaggaactgtaaccttcagaagagagacaaagtctgctgcagctactctacagggagggagatggaggagtaaggccccaacccctcttccctctgctctccagcaggggccgcccattgactgaacccaaccaaaagccaggggacaggggagtcctgggaagtggtctcgggggcactgagcaggctggatggagtaggaaggataaagatctgaaggggtaaatggaagatagccctactgtctccctagttttgcctaagtaattattttattaataattccctatattatttgcttggttttctctccaggaggaacagttccaacataagagtgggtgaagcacattaaaccccaataatcaacttccttaagcatttccaagtaacataatctcctacttccctacaaaaaaaaaaatcaaaaattctcacttaaatcccaggagatgtttattttcatcctacaaagaatgtctgttgttgagtgatgacgtttctttaaagagaataattaaagctc

SEQ ID NO: 5409 - DNA, 1234 bp, mus musculus
tttgacctagcaaatttataagcgatagtaaaactttccttttacctttacaataatagcttttaagtactcaggctgacaaattcttcatggactcacttttatgtttttcaatttctattaatttctctgtattaaagttgaattagatggatttatgttgcctattcctggcattcatagcaactataaggcatgatcaagaaaacagaaattctaatcctcatgttacagaaatggccccaattctacttgacagaaatgatttcaattagggagtctctgggctaccttttctgtttcaccagaacaaatgttattgatataaggggaaatccttggataccatataacctgctcactctatggagcagagttacttagagtgctccgaatcccatctttgatctctggcgatatttttctctgttatgtcactgaggtcacctggctcatgtgtgacaaactgcctgcataagtcacagtgccagtggcagagatttgtaaccatgcccctggtccattgcctttgaattatttcacaggcccgctgctttacatttacactctgtcggaagatgaacaggggaagggagtaaaatcaagggcagggtctcatcctgaaggacaaggggaaacaggtggaaggttaatggccctggagcgattccacaagcctctcaggcttgatatatgggcctggggcctaaaacgggcattggctttcaaagatatattatttcatttgaggagagacattctggagttcctgcatttgtctgctgatagatgatcctctgtccacaattggttatggcgtgtgagttttccttgggcctgctcccatacataaaaattttgctgagctctccaaccttttgcatgcctttaggaatgggaccggtgcaagcccactggcaggctgttggatttttttgctgctattttagtagttccttttgaaccgtgaggcaagtggggaatgaaagacacttctgttcattcatacatgacttgataagggtggccttgttataaaaaaaaaaaatggtgaaagggatgttaggaatcaaacatatgtgtcattttgggaagacaggctcagtccaaaatttagtcatttgggtttcaaaaagttgcttacataaaagctagatactatcaaatagcttttgactttattactgttttgcactccccaggcttttagcaaatggcttactctatttttctt

SEQ ID NO: 5410 - DNA, 804 bp, mus musculus
attaaacatggtttttaaaaatatacatcccagctgggcgcagtggctcacacctgtaatcccagcactttgggaggctgaagcctcgtggaccacgaggtcaggagttcgagaccagcctggccaacattgtgaaaccccatctctactaaaattacaaaaacttagctcggcatggtggcgggcacctgttaagcttttcgggaggctgaagcaggagaatcgattgaacccggaaggcgggggttgcagtgagccaagattgcaccattgcactccagcctgggcaacaagagcgaaactccgtctataaataaacaaagaaacaaacacatccctcttcctcactagagaaaatttcatccatccttttggcatgccctcactcgctcctaccgacagtaagaatgactgttataagtggtatgctcctaatattgctattttggtctctgttgatcctaaataatgaagtaattttttttactgctacttttggctttcatatgaagtttccattagttcagtatcttttttgtgtctaaaagttgagaagttcccttagtaacagctctgatcatctctgatttgttactcaggaaaagcggaaaaactttcagattcacttgcatttctaatgggaaccacaccaggtagatattgatgagaatttgaaagctcagtctcttttctcataccacgaaacaaccctaatataagatgctgggttcatacaattagtagtaaaactttcttttgacagtaattttccaacattaaaaaaaattatttttcttctgagtc

SEQ ID NO: 5411 - DNA, 804 bp, mus musculus; identical to SEQ ID NO: 5410

SEQ ID NO: 5412 - DNA, 804 bp, mus musculus; identical to SEQ ID NO: 5410

SEQ ID NO: 5413 - DNA, 1356 bp, mus musculus
aggaaaaggcgctccgtcatggggatccagacggtaagaccctcattcagtatcctccactgggggacccctccccatctggttctggccactcagctccggaccaggggctgtcgctgccgaccccgccccgcagggctctgggcccaccgtggatgctggggtcccgatcccgcacatccgggctcgggactccgccaggttacccctctgcccttggcatgcctccgcgctggagctcgggatcgccacccctgggacggtcaccacccaagccccgggctcttacccagcctggcggtcacgctgcctcctctacccacagagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacggtaagttggggaagaaagggccagggtgaaggaggggaccagagtgctcctggcatggagggtacagcacccacggtggttgggatgtccaagggacgtggcagcgccaggcgcgcttggtgaaacacttgtgtcctccaccctccagactgtgagccacaacaccaagaggttccgctttgccctgcccaccgcccaccacactctggggctgcctgtgggtaaggaaagtgtggaatgggctcctttccctggtatcctcagaaggtgactcccctcctgggatctcatgaaacacgctgcttcaaccggtttgctccacacaccattccccttcccccacttggctctgcatcctccaagctgtgaggtgccactgggcccctctagagtgtggcttccatgacccccatccagctttaacactcaacagtcttgcctcttccctgcaggatttgctaattactccctctgagcaagcactactaactttttcccattgcccagacccttttggctcatctgtcaaggtcctggcagtaactggcaggaaacgctggaaataagtgtttcctcaactgggcgcttataagagatccaactgagggctcaatggggcaaatcttccctgccttgtagctccttgggaccacagcaggaagcaagacatcttgttctctcaaatctctttgagtattttgagggatgcagcacatcacagacaacccttatgtagctctctgcacggtccccaggcaaacatatctacctctccacccgaattgatggcagcctggtcatcaggccatacactcctgtcaccagtgatgaggatcaaggctatgtggatcttgtcatcaaggtaaggggctaggaaggga

SEQ ID NO: 5414 - DNA, 701 bp, mus musculus
ctgtcttgctcagctgggcttcagtgacagagactggtgacatcttcctaggaagttggtgaccggagttgaaacaatggccagttccccaggagacttggcttaggaattggtctcctagaattattgagcccttatctaaggaagctccacctttcactctccctcttcaaactcatgctgggagcttgtgcggctccctgcagccccgctctgtatgactctatgtggccactatgccaaggtggagaggaggtctggactgcatttggaatcctggtaatggtggtgattctctttttacttctttgtggtgtccaacatcctctagtgtcactggcacaaaacaggtcaggctattggaaggccacactgcttaacaacaatgtcaggagatccaggctctcagctatattcagattagtgaagtgtacattctcctaacttgctcagcttatctcctgcacctagtgctataaacagttgtgtttcagagctccccaggctggccaaatccatagttccaatccccaaagtcccttgtctaaatggggtctaacttccgccccagtttaacccagggctgtttctgactcagcccctgtcatcctgcctgggccctaggcaacactgcctctctaatgccctagccagacagagcattcctgtttacccaactcacagactctccctactttctg

SEQ ID NO: 5415 - DNA, 1174 bp, mus musculus
gtataaacatttttaagatgttttcatgtttttccaaactcccttctgggaatgctgttatcaggggacgcctcctccaggagggtaggagagctgagccttacactctaggagaatctctgacccagtgaagtttgtccatctcagaggaagcaggacaatgtggtgagtggaaatagtttcatcaggggaggttgaagggactggagatatttagcctgcagaagatagggacaagggccacacgcatggctgtaatcaaatgtgtaatgggctgtcaagtgaaagagagaggtttgtcctgaggctctcgagcagaagtggaccaggggaccaaagttgcggagagccattgttctgtgcgggagccattgtcctgtgtggggccagcacacagccctggatggaacagggtgggtattacataaaggttacatgaccagctgccacctctggcttgggttcatggaggacgtgtgcatgggggagggccaggaccacccccgccacactgtgctcccctacaaaacatgacgtctctgaatcttaacaggggggtctgctccccaccccacccccgccttggggagcctggcccggcctggtacgtctctctgtctatcccctcaggagcacagcctggcttgtgtcatgggccacacaactcttccattatgcatgagggagacccagcggtgagcgagtgagcaagccggccgagggaggggtgagtggttattaataaacaagtgtattgtgtggcgttccattcacggcactctcagaggacgtggtgggcttgagataataaagccctgtttatgccacggagggctggggaggtggccgatgggggtgacaaggagcagggaagccaggaattattttgattccacccagggcagggctgctgtgttttctctgaggccaactttcagggaaaagaaggatcttgctgggattttgctcaggcctaagtctgccagctgggatggcctggggcctaagaaatgcctagcttccctccccacctgtccccatggagggagactgagaagacgctggatgaaccagaccatggctccttcaggagagaggtaggatggtcaactctgccctccctcttggcctctcatcctcaccccattcctcctgctttggccttcaaagactc

SEQ ID NO: 5416 - DNA, 1174 bp, mus musculus; identical to SEQ ID NO: 5415

SEQ ID NO: 5417 - DNA, 478 bp, mus musculus
caggctgccttgtcccatgactttccctgctttgctgtgggactgacagggttgaaggagatgccctgtggcttctttgagggccttacctctgacctgtagtgggagcctgcccccctgcccactcaggaactgtaagcagcttcctctttagggctgcagcttcatacaacccaacttgctggtcctctgattgatggtctattcttgatcagctccccctgccgcatctcttccccagatttgaagcatcagtcaacagctgggattcactttggacctgctggtgtgtgaatagtggcaatagactgtgacaggaagctgatagaccagcgttggaacctttaaggtttttcctctcctattttgtttttccatatctcagctttaaacacagtcgctgaaattaggaagctgtttgtttttgcagagctaggcttggatcagcagcaagatgacccatgagctggttaggaac

SEQ ID NO: 5418 - DNA, 2484 bp, mus musculus
ctttatactttttaaattattgaaaatatataagaaatgtttatatttaccatactagaaattaaaacagttggccaggtgccgtgcatcatgtctgtaaatcccagcactttggaaggctgatgcaggaagatcacctgaggtcaggaattagagaccagcccggccaacatggcaaaaccctgtctctactaaaaatacaaaaattagccaggcgtggtggtgcacacctgtaatctcagctactccggaggctgggccacgagaatcgcttgagcccaggaagtggaggttgcagtgagcgatgatagtgccactacactccagcctagatgacagagcaggactctgagagacaggagagagagagagagagagagagagagagagagagggagagagagagagaggaaggaaggaaggaaggaaggaaggaaggaaggaaggaaggaaggaaggaaggaaggaagaaattaagatagaaattgagaaagaattattaattttaaaataatgagagtaaaatttttcatgctaacctgaattacatgttttaagaaaaacagtctgggtgcggtggttcacacctgtaatcccagactttgggaggccaaggcaggtggatcacttgagctcaggagttcaagaccagcctgggcaacatggcaaaacctcgtctctactaaaaatacaaaaaattagccaggtacattggcatgcacctgtagtcttaggaactcaggaggctaaggcaggagaatctcttacgtcccaggggtggaggttgcagtgagccaagactgcaccactgcattccagcctgggcgatgggagtgaaactctgtctcaaaaaagaaaaagaaaaagaaccatattttcaaaaacaaaattagtgacaggagtatcattgctttacacttttgcaaatatttttaatgtctggctgaaaaaaaagacagctagcttctcaatttgcttctgtattcaatctattggtttaaacataaagaaaaattcagtttcacacaaatatgtcattagaaaaagtaagactttgctgatcccttaaaagggtcttggggattcccaagtttcctcagaatccccatgttgaaacctgtaaattagtatgtactataaattcatgtattaatatgagctacaagcagcttgacaccaccaaagcataccgcaccgggtggaaagagatggagcacacaacctcaccggcctgtgtgacatctcaccctaccttgaagatggcttgagcagagaaagaaagatgatgggagagtatggaacaaaactgagaagttgcagtgatgtaaaaaagatttcctaagctcagccctgctcctcacgtcagacattgtacctggatttctcaatctgtggtcagagctcctgattgttaggtcattttcattgacagagcaggaacttggggcagacagctgtgcacgtgaggtggtttctggtcctgaactaaattgagatcatctcactcatttgtttgacagtcatttgataagttccaactctgtgctgggccttgtgctacaggggcaaagagcattacagtcctaactcttgaggagctcacagtccagccatgaagacagagacatgtaataaataacaccaaaacagtataataaggctatagcagcagtgcataaagcatgatgcaggaaaaagagaaagaaggcagcaattattccacctgaggtggaacagggaaggctttaaaggaaggaaacctggccaggcacggcagctcatgcctataatcccagcactttgggaggccaaggcaggtggaccacttgaggccaggagttcaagaccagcctggccaacatggcgaaaacccgtctctactaaagatacaaaaattagctgagcgtaatcgtgcatgcctgaagtccgagctactcaggaggctgagacacaagaattgcttgaacccaggaggtggaggttgcagtgagctgagattgtgccactgcactccagcctgggtgacggagcaagattctgtctcaaaaaataaaaataaaggaaagaaaccattttagctgaatcttgaaggatgagtaggagctaaccagtagagaagcaagagtgatgatgagggaaaaaagcagaaagtagaagagtgtttaaggtaaaggaattggaatgattacaggcctatgtatggcaaagaattgggtatagcagagtatggctgaaatgaaggtatgccagagtagtaccaaagaaaggatctcagacaggtctttagaattatgggtcttaaactttttctgttgaacaaggtatctcaaacttgaataatgcatggacccatttttaaaggaaacccatatatgtatatatataaaatcagagatcctttagaatgcatgctacccagcttgagaaacactgctataggtaataagctgagtaagaatggaactatgctttattgaggtataa

SEQ ID NO: 5419 - DNA, 959 bp, mus musculus
gacaactcatggcggcggtggcggcagctgcttgggcgcggtgcggtggtgactgagctacaagcctggcggcgggtgtgcgccgagccccggcccagcgcggcccccgcgtgcctcccaggctccgcacccccgatgctgcgcgggtgctgagcccgctccggccgggacgatggtgaagtatttcctgggccagagcgtgcaacggagctcctgggaccaagtgttcgccgccttctggcagcggtacccgaatccctatagcaaacatgtcttgacggaagacgtagtacaccgggaggtaacccctgaccagaaactgctgtccgggcgactcctgaccaagaccaacaggacgccctgctgggccgagcgactgtttcctgccaatgttgatcactcggtgtacatcctggaggactctattgtggacccacagaatcagaccatgaccaccttcacctggaacatcaaccatgcccggctgatggtggtggaggaacgatgtgtttactgtgtgaactctgacaacagtggccggaccgaaatccgccgggaagcctgggtctcctctagcttatttggtgtctccagagctgtccaggaatttggtcttgcctggttcaaaagcaatgtgaccaagactatgaagggttttgaatatatcttggcaaagctgcaaggcgaggccccttccaaaacacttgttgagacagccaaggaagccaaggagaaggcaaaggagacagcactggcagctacagagaaggccaaggacctcgccagcaaggcagccaccaagaagcagcagcagcagcaacagtttgtgtagccagcccaccaccaccacagcaccccagacagctaggcttagcccctctgccctccctccattgtacttgatcattaaaaatcaacttccagccctatctactgtctgggtggtgggttatggggat

SEQ ID NO: 5420 - DNA, 811 bp, mus musculus
tccccttctttgtggtctggaaagtgcctccaggcagaaagccaggaatattgtagggatcttttcatttctttctcttttctcagggatcacaattcctcactgtgtattgtccaatgaaaacaactgtttcatacattatggccaattttctagttgttaccggtgagagggcaagtcaaattccagttaattttcatgtctggaagttgaagtttcttcatagcaatcagtttttgcactgctggaattgttcttgataagtcaatacaggtattttccagagaagtccaagtgtcttctctttctttcttccctgctgctactgacagattacttcctagtctatgctttttcccctcaagcatctaaggaattacatttcccttgttttgttacagcaacccatctgttcctctagctttcctctgctggtgctacttcagtgtcacttttcctgtgatgggtaatctctgggggtagtgcttgaggctctccattattcagctccttttggggattcctactttggtgcatgaggctttgcagtcatctgctggctggatcaagtgcatgctgaaaaagacttgctccatattcaatttccccttttgtaagtgcccaaatatcagctcaagctcatcatttctaaaatatatagaccctactttcctcattccaaaattaaaaaaatatatattatacatacacatcatttcctacatacaaactgtagagaataatataataaacatatatcaatccaacatctagctgaaaaaaaaaaagcattcagatatagccgaaaccc

SEQ ID NO: 5421 - DNA, 729 bp, mus musculus
agtcttttttaggattgggtgcgggccttgggagcgcccccacgtgcaagctcctggttactctgcatgtaaacccacgcttacgtctcttccttccttcccactacagagttttatggacgaggagccccctacaatgccttgacggggaaggactccactagaggggtagccaagatgtccttggatcctgcagacctcacccatgacactgtgagccagattataagcctttgtaaaatcctctacctccttgtccatgcctttttctctttttctttttcttttcgtgtgtgtgtgtgtgtgtgtgtgtgtgtgtgtgtgtgtgtgtgtgtgtgtatctgggcaagagcaagccttcctaattagcttatttacccttcggtccacttggtatggtggccaggcattttcttgaaatagattatcctaccatgtcatctcgactcagaaaccttccatggctgtctgttgcctagagtcaagtccaaactcttatgaacttgtgatccaactcagtgatcatcacaatttggccccaacctgctttggcaacctaatgctccttatggtctgtacctgccaccccatcccctcagccccttacagccttgctattagtctctgagacccattccccaggccatgcttggtagctttgtggatgaactgggttgggaagaaaggtctccctctatgcttatatttctgtgaaggagaagatagcat

SEQ ID NO: 5422 - DNA, 752 bp, mus musculus
caaacagagaagacaccaatgccaagggccccaagggaggagcgttgcctagtgaatttgaggccactgtggctggagcagagtgagcagggagacagtgctagatgctgaaagcgagagggaacatgggctgttgtgatgacattggctcttactccaaatggaaggggacaccattggagggctttgagctaaggagggacctctgctgacttttgccttcccagggtggtctggctgctgagttagttcacagccgactgcagaagcacaaatgtggaggccgagagacctgtaaggagagtattgcagactaggcaggggtggtgggggagatggggagaagtggtcagaatctgtatgcagcctgaaggttttgctgatagattgggtgtggggatgagagtaacagaggccaggtgtcactctaaggcttttggcctgagcaatgatggaaatgccatgaattcaagtagagaagattgtgggaggaggaaagaccaggaactctgttttggacctgtgaggtgggagatacctcttagacctccccgtggaggccatgagtgggcagttggatgaatgagtctggagttctggagagggtctgtgctggacatacacatttgaaagtcatctgcatgtacctatacatgttacataaagccacagtcctgggtgagatcgctgagatgggccgtgtgggtgtgtccaagcactaactctggggcacatccacattcagagaggag

SEQ ID NO: 5423 - DNA, 664 bp, mus musculus
ttcttcacccccgacaactccttacttgcatatatatgcataaaggatgagtctgcctaaacaccttagaaaaatgcctacccttgagcgtccaagcctcagctgtgtaaatcgtcatgcaaatgaggcagcagctgtgggcctggttgccagagccatttgtgtcctctcacacctaaagaaaacacaaatactggtaggaaaagcccgctcctccagcctcatccctgccctgatgactcagggagaaaccacacagtaatttacctagcaggctccagaagcagcctcttcacttccctgccaaccctcctcacccacccgcacccccgcacaggcagggggaggtgataataagcaggctcttaccagctgtctttgcaggggcagcgaaaatgattgctcagccttgttcaggagaacatactcccccagccctggctaattcttgggcatgtggggcatgggaaggaaactggtgccaggctggctcaggtcttagaaaagtgtcattcatctggacagtgcacggactttgtaacaacttagtgatggaaccaaagcttacttttgtgccatttatgagggaactaatttataagcaaaggaactcaactatttgctcatttattcaatgtatacatgacaacacaataaaggagag

SEQ ID NO: 5424 - DNA, 1318 bp, mus musculus
aatggaaacttgaaccttactgaggcccctccccaaccctcttgtcatcctcctccctgtttcccacaaaggagatgaaacatgtgcctggggaacccagcaggaagctgggaatgggggtcggggcagcagatggctcagggccccaactctttagtggcaggagtcagccacagctgttcagcgaagcctcctgcaagtttaatgggggcagatgattggctggggatttgctggtggaagagatcaacgaaggggaacacaagcccaggcccttcatggggtagacaagctaacttcagactctttgttgaggggtgtctgagtgcctctggatttaggtcattgaaatgaccacctcccttacacaatagtctcatccctgcacaattttatacatttgcgcatcatgccactggaatcacccacgaccttttggaattgtggggatagacccaggaacagcctttgagcctgtccaaatcagagacagtgtgctcgtggttttcctttgttcttatccttctgacatttcagaaaagtgcaggaaggtggagagcttcagttcacgctgctgaactcagggaaatttgactcttgcacacagacaggaaacacagatccgaattcttcttcttttttttttttttttgagacggagtcttggtctgtcgcccaagctggagtgcagtggcgagatctcagctcactgcaagctctgcctcccgggttcacgccattctcctgcctcagcctccccagcagctgggacaacaacaggcgcacgccgccatgcccggctaatttttttgtatttttagtagagacagggtttcactgtgttagccaggatggtctcaatctgctgacctcgtgatccgcccacctcggcctcccaaagtgctgggattataggcgtgaaccactgcacctggcccgaattctttttttgagacggagtctcggtctgtgatccaggctggagtgcagtggcgcgatctcggctaagtttttgtatttttagtagagatgaggtttcaccatgttgaccaggctgatcttgaactcctgacctcaggtgatctgcccgcctcagcctcccaaacagacctggattctaaaagttacagcatctctgtcttttctctttgctttggtcagcatccctgggtcctgctttccactcggggatagtgaaggatatgaatgggttcatccgtctgtgtctcccacaggcccttctgcaggtcctggctcaacaactttgaaactggttggcttggctgcttggacgcctgtgtccattggcctgtccttc

SEQ ID NO: 5425 - DNA, 1111 bp, mus musculus
tcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggt

SEQ ID NO: 5426 - DNA, 1654 bp, mus musculus
gcacatttattatgactatcaaataaggtagcatatatgaaagtccttttcaaactgttaaaatgctagttattccaatgtaagggattacttaaaacagtgtctggcataaaataagcaccctaaaagtgtctgttaaattgaaaaataaataaaaataatttttaaattcagcttttgtttgttgccatacattgcttaaatcttgtgctttaagagcaggttgatggtaaattgggaacaagcatttagatgcctcagtgatttttttttgtgtgtgtgcaaatttgtgcctagagttcctcattagctcttccattttcaatgagaccacacagaatggtggcttgagcaccatcttataggagctggttttggagaggagttagactagggagtgtctaccatcttaggccataattgctcactccagcctcctagtttcaaccatttaccagccctccccaacaataaaaaagtacaaacagagaaataagatcagcttgggacattgccctctggaagacatccatgcatttctatagcctttttgtaggccttctttggcagtcacaaaagcttttacttgcacatttggagaatgcgtggtggccttagctccttgttggttccagctgagaaagaactcctgagttggaaactgaggtcagtgtagttcaaaggcaagctcctggtagccttgccctctttagattcctggccactcacccatcgacccaggtgaacttcactcagagaatttgaaaatgccctaaggaaatagttgttgctaaatcattctgtgtagagaatcaggagaagtgaatgtctaaacttgccatcatggttcatgaacttccttattttttaaaaatgctactaatttttgagcacttatctgtgctagaccccataaatgagcatataacatgtttttatctgtttaattctcaacttatctccctaagggaggttccatctttttgttacctgaaaggggtcctgatccagaccctgagagagggttcttggattgcatgcaagaaagaattcggggcaagttcataaagtgaaagcaggtttattaaggaagtaaaggaatacaagaatgcctactccatagctcccttggggcagctggttggctatttttatggttatttcttgattatatgctaaacaaaaggcagattcttcatgagttttctgggaaaggggcaaggattttctggaaccgagagttcctcttccttttagaccatatggggtaacttccagatgttgccatggcatttgtaaatggtcatggtgctggtgggggtgtcttttagcatgctaatgtattatcattagtatataatgagcagtgaggataacagaggttactttcatcaccatcttggttttggcaggtttgggcctgcttctttaccgcatcctgttttatcaacgaagcctttgtgacctgtatcttgtgccaacctcctattttatcctgtgactaagaatgtctaatctcatgggaatacatcccagcaggtctcagcctcatttcacccagaccctattcaagatggagtcgctctggtttgaatgcctctgacaatttccctgttatagagaggcttaaataacacagaaggtctcattgcta

SEQ ID NO: 5427 - DNA, 1114 bp, mus musculus
ttagtaaggagcacttaagcatcttagaactgattagaccatgtgggacaagaacaagtcagagacgctatgggggaatccagtgagacccattctactccccttaaccacataggcaagaagatgtggggaattgttatcagaatccactgcctaaaaatggtatatatattcttcattttagctgctgacaatacagttttgggagtgatactaatcgtctctaagccttgatttcttcagctataaaatgtaggtcataataaggcacacctcatgagtacactgggcatgcaaagctcttagaagagtgtcaacatagaggaaatattacctgttgttattatgataacttagtcattctcaattcatttctcatctttacagaatcctaagtaactcctctaattattgctttatgtacttaggcctgatattcaaaatatctaacacctgatttattacctgcagtgataaacaaacagagtgccactagctatggttttgaggtccctgtggattctacatgaatttagaacaaaaattctgactttcagagttggcaaatcaggtaaatagcagccctatagaaataggtagtaagggtacttctttttgcctagttaacctagttcttcgaaagcagggaaatttagcagaagtggacatttaaggacaataacaaatttcctgtacatcagcgtgtgtgtgtgtgtgtgtgggcgcgcgtgagtgcatatgtgtgtgtgggggggcgcgcgcgcgtgcatgtgtgggcgcacgcgcgtgcgtgtgtgtgtctgcgcgcgtgcgtgcgtgtgtgtgtgcgcgcgtgagtgtgtctgggcatgcgtgtgtgtgcgcgcgcgtgcgtgcatgtgtgtgtgttggggtatgggtgctgcttttctctacctgcctcttccgcctaccttctttcttactcctccacaggggaccttctggaattcttatgatgtggggaatgcagaaatcaccgtgtgaaaaggtagtgcatctacttgccagttggtcctgttccagcctccatcaggaaggcagatacaggacagaagctctttctccttttctcttgggcctaagtacactagct

SEQ ID NO: 5428 - DNA, 1018 bp, mus musculus
cagccccttccataaaccctcacatgcccctgagcaataaaacacatttgatgtgatgctttccatttgtctctagtgtttattttttgaaggatttttaaaacatatatcacaaatttcagacagataaatctgaaccagagaatgaactaaggacaactgatgaaaatagaggattaaagaatttgacacacagaagagaaaatgactgtaacatttaaggaggagtatttttatggaaacatattagctgtatttggaagactggctgggtgtgtggggagggggagaaaaaaataaattcctatttaatgcatcccacggagatagagttatatagtcagtaattcaccaaggcagaagggctctgacctttgctcttctttaaaggaattaagacaattaatgactttcatgcccattatgactataggcattagtagttctttgcctcctgtgttatgatctatatttcaatagtttactgggggttttattttaagctattttataccatttaatctacttcaccaaatcccacttaagaatcaaagcacaaacccagaaagcatctaacttctcttatctgtttgctataaaaattttcactacaggacagacgcttcattccagcaaaagcaggtagagcaaagaagaaaaaaaaagactacattctatcacgactgcagtggcatatgtcttgctatgagttttcctgcacaccgtttaatatatacctattgagccataattggaatatttagcgtttattgtaggatatttggattgtttttcaaaacacaaaatgctctagggtttataaaagagggatgatactactagtgatcttgtagtgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattgga

SEQ ID NO: 5429 - DNA, 1018 bp, mus musculus; identical to SEQ ID NO: 5428

SEQ ID NO: 5430 - DNA, 1018 bp, mus musculus; identical to SEQ ID NO: 5428

SEQ ID NO: 5431 - DNA, 1018 bp, mus musculus; identical to SEQ ID NO: 5428

SEQ ID NO: 5432 - DNA, 1018 bp, mus musculus; identical to SEQ ID NO: 5428

SEQ ID NO: 5433 - DNA, 1018 bp, mus musculus; identical to SEQ ID NO: 5428

SEQ ID NO: 5434 - DNA, 1018 bp, mus musculus; identical to SEQ ID NO: 5428

SEQ ID NO: 5435 - DNA, 1018 bp, mus musculus; identical to SEQ ID NO: 5428

SEQ ID NO: 5436 - DNA, 1756 bp, mus musculus
ctctgatgcgctccctccagctttcttttctaggatgcttggagcccccctccttcgcggcgttggagcgggctttggtttctgtttgaagcccggcgtcggctccggacgcgcgcagcgccctccgcggtggctcccaggaagtccctgggagtctgcggagggagcccctgggaggcccaggggtgggcgcggtccgacggccgggtgtccttcacggggcgtcctttccacccagctgtccatggagcgagcagagcccctggccgagcgcccgcccgggagcccggggcagcctgcgggtggcagtgggcaggagcccgcgttccaagccggccttgctccccaacccgctgctgccgcccgcgctgccgggcttcctaggcctccgcgagggcctcagcaacccacgggagcccaatccaggcagagaaccggggaggaacgccgaagcagctctttctccctcataatttgagatgctattttatcatcaacagtctgtgttcagacaggaaagattgggctgaataaatgtgtccgggaaacaggatgcagcctgcgtccaaccagagcgcggcggttgtgtcctgtgacccgctgtgaggctgatcattctgcattgtttactcttgtgcgtacatttcaaaacacggaattacatccggaaatctgggtgaaaacgacatggtccctaattgtaaagttttttcacaggacttcagataaatgcagtcatctgtatacctcaagagtggatttatttatttgggatttttttttaagactttatttttaaaataactaatgggtactaggcttaatacctgggtgatgaaataacctgcacagcaaacccacatgacacaattttacccatggaacaagctgcacatgtacccctgaacttaaaagttaaaaaacaaaacaaaacaaaaacccagcacttttaggctgacagcaaaattgagcaaaaagtacagagttaatatcccctgacccgccccccttcatccataccctccctcattatcaacatttcccagtagactggtacatttgttaacaatcgatgaatccgcatggatacgtcattattacccaaagaagtccatagtttatgtgggggttcactcttggtgttatacattctgtgggttttgacaaatgtataatgacacgtatctaccattatagtattacatagaatggtttcagtgtcctaaaaatcctctctgctctgcctagtcacccttcccttccccaacccccggccaaaatggatttaaaagaaaaataacgtatcagaccagaagtttctccctaattagttgcttgttttcctcatggactgcttccggctcctagagaagacatcatagcatgaagcattcttgcacggtttaggttttgttaacaggggctattagtgtgtgtgacttcttaatcccccttctgctgaggggcatctccagcccagttttaattaacagggaaatgctcatattattttggtacactgattataggcgaagcctaagtggaagtcactttggtgtcccaagggatttccgtgttaaaaatgcatagggtacctttttcttctctttctttttttttttttcctgttaattctcctcctccatgaactccagataagcagcaggcccgagccagatttcattactatcacgcactcttcatggtcatcttttaatatttgaaaggatcatttgttaactggaaatggtcaatt

SEQ ID NO: 5437 - DNA, 1756 bp, mus musculus; identical to SEQ ID NO: 5436

SEQ ID NO: 5438 - DNA, 1756 bp, mus musculus; identical to SEQ ID NO: 5436

SEQ ID NO: 5439 - DNA, 1756 bp, mus musculus; identical to SEQ ID NO: 5436

SEQ ID NO: 5440 - DNA, 1756 bp, mus musculus; identical to SEQ ID NO: 5436

SEQ ID NO: 5441 - DNA, 1756 bp, mus musculus; identical to SEQ ID NO: 5436

SEQ ID NO: 5442 - DNA, 1756 bp, mus musculus; identical to SEQ ID NO: 5436

SEQ ID NO: 5443 - DNA, 1756 bp, mus musculus; identical to SEQ ID NO: 5436

SEQ ID NO: 5444 - DNA, 505 bp, mus musculus
gtcatcaacaagccacggttttagctattcaggaatctttactttaacttcaactctgttcatgaatgtttcctcattttcaacagtaggatctacccgggcccttttcttccaaggaggctgaggggtctcactggtactgccaccatctccatttccaggtgttttctgtttgttctttttcgttttcacttcaacatttttctgttgcagaccagatgtcttctttcctggggcagcccctctcatcttcccctctgcatactgctcctgattggctttttgaagttctcgctgtttctgcaaattggtgtccacgtatttgagtactctgctctccggaacccactcatcccaatttttattccaaccactgtaatgtatgaagtatttcacttgtttgtcctttatggcaacctttacacactttgcttcataaagaagaggcccatgaaagcacagcactcgctcaccctcctggaatttaggcttcgggtcctgcttc

SEQ ID NO: 5445 - DNA, 147 bp, mus musculus
catacaggacacattttcaaatatacggtgaagaaggatgggccattacacatgtgcatagttttcacttctcttatcaggtgaaacattcccaactgtttatttttccttacttaaatgaaaaggaatctaggtcttccaccttct

SEQ ID NO: 5446 - DNA, 715 bp, mus musculus
catctttaaaacatgactattttgacattcactcattttaataagattttggaactctctgaaaacctctagcagctcttctctggggacagaacctccttaaggtatcaaattgtcagaagtctgtatgcttcatctgcgttcattcccagtggttcttgacttgagtgagtttccatgtcaaccttcctaggccttcggatgccatgaggtgtggggtatcattggaagatgagactgagaaaaactgattacgggttatggaaagcaaggactcccatataaacttctccaaaggattgggcaatatagagatgtctttaactggcactcatgtccatgcaaagtctatgcaaaggtcagaagttccagaggtggccagtatgccagctgctaggaagaaaatgagaaaggggtttgtttttcaggtgggaaaaaaagaatcctggcaagggttaggtaagatggtaagatcctagtcagaagggctgaggtccggagcagagcatcgtcctaatatgaaacttgaggctgcataaaaagcaagtacagcccagtcctgcagaatagggatccacgttccagcttaggtgagggctgcagcatcatgaactgcaacacctggagttcaccctaggccactagaaacctagagcagcaaaataatttccatgccatatgactggtgggttagagctgcgtgatactcagcctc

SEQ ID NO: 5447 - DNA, 462 bp, mus musculus
gtatgtgtggtgtgtgtatactgtggtttctcccctgaggccggcgcctccgggtgtggtgttggcgctgtgtctagggtttctagaaggggaggaatgagggaaagaggcccctccgggcactgggacaggctcaaggggaacagccccgagctgggtgttggctgagtgtgaattccagcagccaggctcacagacccgtgtcacctctgacgtcaagtggcagggacacgctaaaagcctttgagtctattgattgagaaggctccagaaggttttggagcgctggaagaaggccaggcctggaatttacgcgtcggcctcttggtgtctcctcccgctgaagggagtaaatccaggcaggtctggggctgccgggcgggcacctggggcggaggagcctcgaggctgtggtcctgcagcaccacctgggggcggcgagaagagtagccgcagaggctc

SEQ ID NO: 5448 - DNA, 1257 bp, mus musculus
ttttcttttagcttccaaattcccagccttgaacataacaaggagtgctaaatgttctgaactcaggaaaactgtccagatgggcccaaggaagcaatctgcctaccctccacgtgtacatatcatgttagggcggcctgcttggatttaggaagagcacactcagtccccagtgggaaatgtccatcccgattaaatgagggctgcggagtgtggaaaacatgagaagtggtggagagtttttctggagttgaagtttgagtctcactgtgaccagactgaacctactgaacccacactgataaggaaagcgaacattgtccttggcagcccttcaaggctaagcttttctcgggggtgagcagtccttgagcaattccttcagtgcattaagtgcaaagtggctcttcccttagctacaaataagcagaccactgttattctcaagaaaggagaccccaggagagtgcaacatcagcacagccttaccatgttcactgcgccaggcaggtggaggtaattgaacactcacaaaatttatttttgtgtgagacactcatctgagaggctgggtgccatttccactctatccctagcacccgacaatgttgcctccctagatcttgcttatcttgtacaccatgtatgccaaacacatcacccatctctttgaaatattgtcagaatgatctttgctgtgcagtattaaaacctgcaaatgcccttgctccgttttcttaggtggtcaggctgtctgtatatatttattgagaagacagttctgaaggctaagcatagacaggtttctgaaaaattatgactcacattccattttaactgtttttgggaatctagctatttagtggaagtctcaggttttcctaaagtgctgtgtgctcatacatttagtttttatttcctgaaaatggctaacttgggacttggaggtggctcaacagaggttgacacgttggtttggatctgggccatgttctcgtactctgttggtggtggaaataaagctggaagggtggagaagggtcagggagaagataaggaaagggaacacactgtggttcctacagcagttgcacagggacttcacgggtttacagagggaaaccatagctaggtttaagctttttcccttattaaaagcagctatatatatgcagatgtatgcatattcattgttgaattttttagaaaatatggatgagcaacgttaacaaaataaatgtcacactaaccctctgt

SEQ ID NO: 5449 - DNA, 1257 bp, mus musculus; identical to SEQ ID NO: 5448

SEQ ID NO: 5450 - DNA, 641 bp, mus musculus
tgtatccttttcctgtaataaatcataactgggtgtctaacagctttccatgagttctgtggggacttctagaaaataatttcaggagtttttggaacctcctgaatttgcgattggtgtcagagtgagggcagtcaggcaggctgtcccctctaactttgcaattgggagtcaaaaaacttcagaaactgctgctgatgtttacagctgctcagcagccctgaggcaaaagagtggctgggaaaaaaatacactggaagaactcatgctggccagagttaatacacctgccactatgctggaagaggaagaatggctcagcctccactccggcttcctaatctagcttcaaggcacttgttggcagaattaaaccatactcaacactctgcaaacaagggaatccgggaacaggcttctgaacaggagagaggcggaggaggtgaaccaatcccccacggggctcaccaggactctctctgaaaatccacttcctaattttcaactccaaagcctttgaggtcctcactaaggatgaggggtttgagatgtatgtgatgggattgtggagagctccatggtaaattctgcaaaaaatctccctcttcctttgaatgatgtattatccaggagtttcagcc

SEQ ID NO: 5451 - DNA, 1202 bp, mus musculus
cctttccatgtctggctcctggacattcagtcctctcagcttgaaagatacctcgtcagagaggcttccctgatcacttccctctctactcccgattctgtttcttcctatcagctgttttattttcttcacacagtctgccattttctgatgcttttcttatctatttgtgaattatctcttctgcccttacccttgattataacttctgtgatgacagggaccttctgttctttctcactcctgtcctagagaaccaaaaatggtgccaggtacatcgtgggtatctagtcagtatttttttttttggcctcttcagtaacccaacattttctttttacccgttcaagtcacagaggggcagcacagcgtgctggatggagcactaaccagtcaaagactcagagacctgggtccagtgtgggttgtccctcattcatcatgcaaggtaaagtacatcattcaaacactgtgactgggtcttggtctcctgaactgtatgctagggggagattccgatccagttcacaagagttcttatgcagatcaagttatgtcaataagatagtgcagtacacatgcaaggtagtgaggtctcaaccatttaagagccttcagaaataagaggagcaaatgcagggaagagaaagtcccagagaaaaccagcctttcctaatgctaagctctctgatggggcagccctggggactcattagctaatgcacattgacatttcaatcgtttcttcatcttccaggaaggtttttttttttttttttttttttttttttttttttgccatagtacagcatggttatttttagcaaaataatgatttcagacaagtgagataacttttaatctcctaactataaattctgtggacccaaagacagaagcatgagatgctttatagagtgtttctatagtttcccacctcttgaggtgggtccaccctgcttccctgctggtgttgaggctggatggaatccaggcagtctagacttagggcaggccccagcaggactgaccttgctgtagtccttggtgaggctccgcgcagtgagcttccatggatagttgcttcatggtcctgtggttgggggaacagggaggggcaataggctagagggttggggcagcaccttttgggctgaacttgcctaagcctagtggtgggtagggatagggttcagtgttca

SEQ ID NO: 5452 - DNA, 1148 bp, mus musculus
tggagtaggatttggacagtggagatgggacggggaccccaagagagatggcagagtccttgcagaaggggcgagctgggctggggctctggctcctgagccagggccagagggcatggggtagggggactttggagggtgtgtgtccctgttggggccatgtgcccagggctagagggaggtaggggcaaaggggaccaggaggggcccccctgaaaagagaccaagcctgacagtgctatctcccatgggtgggggtgaggtgtgtctgcagtggatagccctgggctgtcgtggtgggcccccttccctgggccatgtgccagatggtcactgctctgccattgcctgccacagctctgcgcttactgccgctgaagcctctaacactgacagcagagggtgggatggctgcggtggctcagctccgggggctgacatgtgtccggcatgttggccgacagatcccgtggtggaggtggtcagtgccatgcaggacttggccgtggaggagggtggctcggctgagctcctctgccagtattcacggcccgtgcaggccacgtggaagatggacgagcgggaggtgcacacggatgggcaccgtgtcatcatagagcaggactggaacgtggccaggctgaccttcaggccggccttgccctgtgacagtggcatctattcttgtgaggctgcgggcacccgcgtagtggccctgctgcaagtgcaaggtgaggccgcctggtgagcagccctaggcccggggcagctttggcacagcttgggctgtgcagtgatagtggaatggcaggcagtgtccggtggcgctgggacacaggtggctcggacaggtgggaacaggccccgtaggtggcaagctcgctgcaccaggagctgagctgtgagtaggcacggcatgcacagctgctgaacttgtggcttccatgaagaatgtgtggccaaattcaagactcctacacgtgaacccacaagagaatgagaaagggaggggagagcggagggcagtggattagggaggaggtctctggttgttgtgagtctgagcatggcattccagggaccaggcagcaggtctggtagctctgttggggggtgcagagaaagggggatgttcccagaccgtgaag

SEQ ID NO: 5453 - DNA, 1148 bp, mus musculus; identical to SEQ ID NO: 5452

SEQ ID NO: 5454 - DNA, 343 bp, mus musculus
gggtagcgggccatagggaaatcacaagcattgccaggttccctgcagacctctgtggcttgggcatcatttgcagtgggactcagcattacacggtgcacatctcagcagcccgtgggaccgtggggctggacggccctcctcctcagcaccaccttcttgtcaaacacagctgtacttggggagggtgggcagagcacaaagccaaggggacattggagggcagtggacagccaggcttgccctcaagggagcccagggcaaggagtgcactgagggtgactcagggaactggctgggaggggctgggaggcagagagggtgataggctcaacctggagag

SEQ ID NO: 5455 - DNA, 343 bp, mus musculus; identical to SEQ ID NO: 5454

SEQ ID NO: 5456 - DNA, 794 bp, mus musculus
aaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaata

SEQ ID NO: 5457 - DNA, 794 bp, mus musculus; identical to SEQ ID NO: 5456

SEQ ID NO: 5458 - DNA, 794 bp, mus musculus; identical to SEQ ID NO: 5456

SEQ ID NO: 5459 - DNA, 794 bp, mus musculus; identical to SEQ ID NO: 5456

SEQ ID NO: 5460 - DNA, 794 bp, mus musculus; identical to SEQ ID NO: 5456

SEQ ID NO: 5461 - DNA, 2961 bp, mus musculus
aatgggaggtggtgactgcctatccctgagagtcacaaaatgggtagattaattgaagtaatgctagctgctgtaactattaggccccaaatttcagtggctgatgcaacagacgtctgttacacattcatgtagagtccagtcagtgagtggaggtagtggggaaggggatggtttcattctgcactaccaaggattcaggcaaatagaagctccacgtatttcctagcacattgctttcaagaccaccttggacttcaataccaagctggcagaaagtggaagattgcatggaagattgttatgagcttggcctaacaatcttcccaatgattgggatacatcatttccttgtacattctgctgtccacgattgacatgactacaaaagaggctaggaaatgctatctagctgagtacccaggagaaaaagtaaaaggctttggtgaacaaaaaataactggggtagttctggtgcagtacaaaattgcccaaacctagaatagggacgtagatcttggatagcccaaaagaatgatcaaggtccatggcacatcctatttctgttgtctggtaccataatgaatgattgatacaaattctatatcaagaatacaaataggacgggtgtggtggctcatgcctgtaatcctagcactttgggaggctgaggcgggtggatcacctgaggtcaggagtccaagaccagcctggccaacatggtgaaaccccatctctactaaaaatacaaaaagcagctgggcgtggtggcatgcacctgtaatcacagctactcgggaggttgaggcaggagaatcacttgaatctgagaagtggaggttgcagtgagccaagatcacgccattgcaccccagcctgggcgacaagagtgaaactccgtctcaaaaaaaaaaaagaaagaatacaaatgaggaagcaccatttttctattctattcttttggctcatatattccagaatagaaataaactattttcttgttaacgtaagaaaacaggattgtagtgcccccactgctcttgagttcatgagtattacttgcatctacctaaacggggagcctgtcaggaaaacattcaagagtggaaagattaatcattggctttaaatctaagccaaattacaacaaaagccaaaattgataaatgggatctaattaaactaaagagcttctgcacagcaaaagaaactaccatcagcgtgaacaggcaacctacaaaatgggagaaaatttttgcaacctactcatctgacaaagggctaatatccagaatctacaatgaactcaaacaaatttacaagaaaaaaacaaacaatcccatcaaaaagtgggcgaaggacatgaacagacgcttctcaaaagaagacatttatgcagccaaaaaacacatgaaaaaatgctcaccatcactggccatcagagaaatgcaaatcaaaaccacaatgagataccgtctcacaccagttagaatggcaatcattaaaaagtcaggaaacaacaggtgctggagaggatgtggagaaataggaacacttttacactgttggtgggactgtaaactagttcaacccttgtggaagtcagtgtggggattcctcagggatctagaactagaaataccatttgacccagccatcccattactgggtatatacccaaaggactataaatcatgctgctataaagacacatgcacacatatgtttgttgtggcactattcacaatagcaaagacttggaaccaacccaaatgtccaacaatgatagactggattaagaaaatgtgacacatatacaccatggaatactatgcagccataaaaaatgatgagttcgtgtcctttgtagggacatggatgaaattgggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagggaggagggatagctttaggagatatacctaatgctaaatgacgagttaatgggtgcagcacaccagcatggcacatgcataagtatgtaactaacctgcacattgtgcacatgtaccctacaacttaaagtataataataattttttaaaaatctaagccaaattaatagataatgcatgttagaaggccaatgggggccatcaagttcaagggttttcaaaagaaatggaatctattggatcgtaaatcccatttaaccatcatttgtgtaggtagatacagaaagatgggaaagtgagggttgattatccatttctgctcttctttagtcagtcaagtgacctaggctgatgggttagtttatttctatgagaagaggagaaaaatgaatgaggaatcaccatgctgccaacagcaggagccaggcaacttgaaaatactgtctgaagaggtgaaggaacaagaataggaacagaaagcagaaggcgttggagggagtttcttgtgagaaaagtaaacccagagaaatgaataggctttcctgaggcttacagcaagttagaggtagagctagtcaaacccgcatggctgtctcttaaccaggactgccccttccacctcacgatttcaccttcttctttcattcctcctttcaggtatttgtttggaatttgtatcatagtgtttatttagttcattaaacatgaaataactggggtataattcattttgtcacttgcatagccccttgaaaactccatatcttttttcacttaggaaaactcctcactttctatcagaatatacagagcatcactagggacttggcctgtcagaaccttgatttcttccttagagccttagtgtgattcctaagtttcttcccagctttgacagtccatcagttcatgggataaaaaagaat

SEQ ID NO: 5462 - DNA, 1548 bp, mus musculus
cagaatttatctcatttaatccttatgacattccttaaaataaataatattatctccattttatagatgaggaaaccgaagcttagagaggataaatgcttgcccaacaacacatagcaatcaagcaaaactcaaggggtctaacccagagtttttgctctgaaccatagttgcccagctcagccagtcattcagtatctctgcccacaggggacccatggagtttgggagaagagaaaagtgaggagaccatattcaggatgtgtaggctgtatgttagggtcaaaggctccttcccacctccttgcatgtgcctatactatttttccctcctggctcccacggaaaagagagtaactctagttaaatgctgtccccaggacagtccaggttctcttttggcctgccccttgctgcttctccattcctgccatgggatgcatgccaccttaggaacagcatgcctcagctaggtggagtctaagtggagtagagagaaaagagctctcttgtgggcactcagctagggggaaaaaattgagctgtgctcaggcgactcccctagaagtgcaccccatgattactgctcatccccatgctgcacacggcttgctggtcctagagctttttgctccactggacagggcaacggggcccacagtctgcccagccgtgccctgcccctggacactcatgggctgctgtactgaacagggcaaaggcaagtgcagggacatgggttctggccccaggtctgatgccaacttggccacacccgcaaagtcattggacttctctggacttcagatttttctttttctttttcttttctttttttctttttctttctttttttttttttttttttgaggcagagtctcactctgtcacctaggctggagtgcaatggcactgtgttggctcactgtaacctctgtctcctgggttcaagcagttctcctgcctcagcctcccgagtagctgggattacaggcatgtaccaccacgcctggctaatttttatatttttagtagagatggggtttcaccatgttggccaggctggtctcgaactcctgaccttaggtgatctgcccacctcggcctcccaaagtgctgggattacaggcgtttgccatcggcctggtccagatttttatttttcaaatgaaatgagaagcttgggtttcactctaaacgttcttttcaactctgaaacccagcaattctgaatctctctacttctgggcaactctgtttccattcttccggggttcatgggagagaaccttcttcagagaggctgatgcaagagctccaggggaggggcactgagggcacatgaattgtggaacagaaacagcgatggttacagcagctggcagagtgaggaagcagcggtctcgggagtcccagcccgaaggcagatttcctggccacaaaagcaccaacggacaagactccaccaacggtgccccttggatggtggagtccagctgccaagctcactcaggggacagtggctcttttctcagtcactcatcatgg

SEQ ID NO: 5463 - DNA, 1154 bp, mus musculus
ccacagcctgaagaatgtcatcaaggagaaatatgggaaagatgccaccggtgtgggggatggaggcgcgtttgctcccaacatcctggagaataaagaaggcctggagctgctgaagactgcgattgggaaagctggctacactgataaggtgatcgtcagcatggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtggctaattagacccctccccttgtgtcaactccggcagctcaagacccccgagcaacatttgtaggggccgctgctagttagctacccttgcccaccgccgtggagttcgcacctcttccttagaacttctacagaagcaggttgcagtgagccgagattgcgccactgcacaccagtctggagacagagtgagagtccgtcccagaaaaaaaaaaaaaaaaaaagaacttctacagaagccaagctccctggagccctgttggcagctctagccttgcagtcatgtaattggcccaaatcaccggagccacgtgaccctccagtgtcatctccggggtggccacaggcaagatccccagtgattttgtgctcaaaataaaa

SEQ ID NO: 5464 - DNA, 1154 bp, mus musculus; identical to SEQ ID NO: 5463

SEQ ID NO: 5465 - DNA, 931 bp, mus musculus
catggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtggctaattagacccctccccttgtgtcaactccggcagctcaagacccccgagcaacatttgtaggggccgctgctagttagctacccttgcccaccgccgtggagttcgcacctcttccttagaacttctacagaagcaggttgcagtgagccgagattgcgccactgcacaccagtctggagacagagtgagagtccgtcccagaaaaaaaaaaaaaaaaaaagaacttctacagaagccaagctccctggagccctgttggcagctctagccttgcagtcatgtaattggcccaaatcaccggagccacgtgaccctc

SEQ ID NO: 5466 - DNA, 931 bp, mus musculus; identical to SEQ ID NO: 5465

SEQ ID NO: 5467 - DNA, 3031 bp, mus musculus
caaataacattcttttggagagacacagtatatagtattatacatactggaagtccctatgaaaggagttttcttcccagatgcccccaaatgtgtttttaagatatcctcataaatgctcttctaataatatcattcaaaatgaaaagtctaatgaaatccccaaggcagctaaataagtttagggaacaatagaatacaaataaaatcaccagtatccatttaatgcctcattttgataaagagaaaacagactggattttcaacatcaaatctattaatcagttacacagttactcataactgtgaatgtgcaggtctgacctaagatcattttgcgcttcctaaagaattaccactaagagtcagggttgaacttggtgctgtggcgcatgcctctagacttacctactggggatactgaggtgggataattgcttgagcccaggagtttgaggccagcctgggcaacataacaagaccccatctcttaaaaaaaaaaaaaaagtcagggttggagagaactcaatgaccttgattccaaaccaaacttctcagaagtccatggagtatacttggggcatggggcgggggactgtatgggaggtctaccataaaggcttagctctttctcattagaagaaagatccatgatttcaatgactgagatctagaaacctttaggagccagaggaatcatcacctagtaatttagcattaactctgtggtttagtggtggtcctttttatgttcaagagggggaattgttcaaacaatatagttggtttgaaatacttccaggaccaatgcaaacaccaagtgggctgcccagaaaccacacattgtttccctcagacaaaagataatgatgcactaatgagttttaccctttattgccctctctggaacacagcctcaggaagaaaacccacgaaaccaaattgttagtcctcaaatttacaatattttgcaatgacccctatccctttttctttaagtgctagtacttgggttaagtatttgtgttgttttactcataaattccaacctcatgtaatctcaaaagtgccctcccagagagagaaaggaaatgagtaaatgaggaaaaataataaaagtctccctgataatagaatacttccaagagacttaaagcacttctgagatattatctaattctgatgtactttgatctcattaaagggggagaaagtaacacattattttaactatggagtgtgaaagtgaggcaaaaagaagttggactcgtaggtccatttaacaaaaatcatttagtaaataatcaaaactatgaatggaggaaattagtacccaattaattagacttgtaaaagtgtatgtattgaggatttacaggatttgttggaatcatttgtagttgttttattgaagagcaagcttaatggcacaattgcacatcacttggactgaaatcacccacaacccttccttaacctcatcagtcctcctccccattcccgctgctatttctgtcctatgtgtttgtaaaatctccagaaagtcttgcttataggtatggtttctacatcctcacctctttcctatctaatgtggcttcattttcaaaacatttccactgaaagtgttcccgttaaagtatgttttgttttgttcagttttttttttgtgtttgtttgtttgtttgttgtttgagatagaggcttgctctgtagcccaggctggagtgcagaggcacagaggctggagtgcaggggcacagaggctggagtgcagaggagattgagctcattgcagcctcgatctcttgggttcaaactatccttctgcctcggcctcctgagtagctgggaatacagctgtgcacctccaagcccagctaatttttaaatttttttgtagagatggtgtttcaccatgttgcccaagctggtctcgggctgctggcctcatgcaatcctcctgccttggcgtcttgaagtgctgggattacaggtgtgagctattgctcctggccttcttgttaaagttgatagtactttttaaggctggaggaccacagagctgtttcttatctcttgttcttctctagtttctgtttaaatatgttcatccgtatccctaactttaagcattgttcttactccagtgtgtacatttcactctcacctttcatgtaaactttagaaaacctgagtttttcaaatgtaaatctaatagacatctcaaacttaacatggccaaaatagaacccttgagttctgcctgagactcttcttcctctagtcttgcttacttcaaaaactttgctccagtctcacctctaatggaatatgtgacacgttgtttttatttctgaaacgcttttttttttttttttttttttgagatggaatctcgctattgttgcccaggctggagtataatgacgcaatctcagctcactgaaacctccacctcctgggttcaagcgattcccctgcctcagcctcccgagtaactggggttacagatgcatgccaccacgcctggctaatttttgtatttttttgtagaggcatagtttcaccattttggccaggctggtcttgaagtcctgacgtcaggtgatccacccgcctcagccgcccaaagtgctgggattacatgcatgagccaccgcaccggactatttctgaaaccctcttaaagccatttctgtctctttttctccactaccaccctagtgcaaactgccattatttttcatttgtagattattccagtaattcttaaatggtcttccacttacattctcaccaatatacctttctctataaagcagtatgagttaagtttccaagtcataaaattagatgatgtcactttgctactctaaaccctgttgtggcttctcaccaaacacagaatccaaacatttatcacggtccataagaccatgcatgatctggtccccatctgccgtatccccatctctggatactggccccctcgcactgtaagttccaaccatcctggcctttctcttct

SEQ ID NO: 5468 - DNA, 2183 bp, mus musculus
aaaatcacgtaagaaggcatataaaagtgctaatgcaggttctaccagcaagaagaattcaaagagggaaccggaggagtttagggatagttagaaagctttagcaaggacatagataggaagttcatctttgaagagtggatagggtctgaacaggtacatgcacaaacaggtgaccagcggagagagcagcaggcacaagggccagccaaagaaccacttcgtgggtaacagtaaagagtctgaaaggccacggaacccaggtagtgaaggatttggaaatccaggcaaagatgtttatatttataagtgaaacgggaattttcaacatgagagtaaaataacaaacatctagcatcccttagtttagactctgctaagagcactgcctatccctggttcaataagtggaaaaggcatttttcaacatgagagtaaaataataaacagataacatcctttagctcagactctcctaaaaacattccctatctctggtccaatagcatctcattttaccaccatatggtcagttctttttattaacatagctgtggggttgagcatctggtgagacagttggatcacataaaccagtggaagggcaacgataagattttacctttcttatccccagtgcctctccatagtctctgcagcctacaaggcactcaagaatatccatcccagtctacagcaacatatgggagagactcggaggcagtggctggagacaaacaagcaggaattgcaaaaggatagcgaaaatggaggttaaattttttttcaaaaaaaaaaaaatctttttttttttgaggcggagtcttattctgttgcccaggctggagcgcagtggagcaatcttggttcactgcaagctccgcctcccgggttcacgccattctcctgcctcagcctcctgagtagctgggactacaggcgcccgccaccacgcccggctaattctttttgtattttttttttgtagagacgaggtttcactgtgttagccaggatggtctcaatctcctgacctcgtgatctgcccgcctctacctcccagagtgctgggattacaggcgtgagacatcgtacccggcctcaaaaaaaatctaaaagatgttgataactttctactcttctctgtaatctgtttcatagccaccctttaaaaatctgcccctttatttctgctcaatctcttcagtgtcctgtatactagaaaagactactgtgtttttttgttttgttttgtttttttgtttttttttcgagacagagtttcgcttttgtagcccaggctgcagtgcaatggcacaatcttggctcactgcaacctccacctcccgggttcaagtgattatcttgcctcagcctcccgagtagctgggattacaggcacctgccacgatactcggctatttttttttttttttttttttttttagtagagacagggtttcaccatgttggccaggctggtcttaaactcctgacctcaggtgatccgcccacctcggcctcccaaagtgctgagattacaggcatgaatcaccgcacctggccattctgtgtgtttttatgacagcaataaaataagtgggcttagtaactaaagcaaacatagcttctctctatttcctttgtgaagaagggattgcaggagaagaatgtaggaagttgcttccatctccctaatgccccaggctctcaggctatagctaagagcctggccttcatcaattcctactgactcagggctccttaccatcaactttctgttattactttaagaccaagaacgatttttttttattttttattttttattttttttgagacagagtctcgctccgtcacccagactggagtgcagtggcgcaatctcggctcactgcaacctctgtctcctgggttcaaacaattctcctgtctcagcctcctgggtagctgggattacaggcacgcaccaccatgccctgctttttttttttttttaaagtagagatggggttttgccatgttggccgtgctggtctcaaactcatgactgcaagtgatccatccacctcagtctcccaaggtactatgtttacaagcatgagccactgtgcccaggccaagaatgatgtttttaaagtcagttaaaatttatacctttgatagctcacttggaaaagtta

SEQ ID NO: 5469 - DNA, 344 bp, mus musculus
tttttaagtgaatggacttggttcagtatatcacaaaatagccacttgtataatgcttaattatgtatttcatattccctctgtgatgctcattaactgtagtatccccttctctggtttttcccattaacactgatcaccatgtaagtagaactaaagctccatgagagcagagaattttgtctatttgttcagtgtcctgtctctgatgtgcagacgaatacccagaagatacttgttgcatatgtgttgaagaagtcggtgggtgggtgggtgggtggatggatgaatgaactcttgcacacttgacatcttggaattctttcctatgatacacaattcag

SEQ ID NO: 5470 - DNA, 344 bp, mus musculus; identical to SEQ ID NO: 5469

SEQ ID NO: 5471 - DNA, 344 bp, mus musculus; identical to SEQ ID NO: 5469

SEQ ID NO: 5472 - DNA, 1136 bp, mus musculus
gtcttatagaaatatcttcattatgctttgaaaatgtgtacagatgcttctgtatctaatgagatagagatccatttaaaagcattactgaattcatagcatctttttgtcactgtatatcttctcaatcaatcaatggatgccaaaatccaagtacaacacagcacagtgttgtcatctgagcaaggcctcttttgcagtcgttgtctgcactgcccagcactcacggatctgccggctcccttgggttgcagcactctgtctgcagtggcaaaactcctaagaaacagttcattctgcccagtgtgaccctttgctggaagtttttcctgccagctacaataggcaggggtgtgagagttcacctcctctgaactgtctctattgctctctcaaggcaaatggactgcagagttgcactggcctcagagccactaaccatgtcatgactgcctcatggggaaagttccaaggggaacagtctgtggttccaagccatgttttgattcaagtctctgaggatgtccatacccttaatggctaatagaggagtggggtcctcgagcttcccaagacatatgaggaccctacttttttcccattaatcttagacgcaagctctagcttctgagatatctgagccagcattcacgtaaacaccccattctgtaggaatgaacagaaggaaaaggcagccggaacaaataacttccaagttaatattttgccaagactaacccagactggaccagactgtaaattcctgatggaagaagctgggattcccctcctccaccccatccccctaggccccgcctatactccattctccgtgtcctcaggtataagtcggagatacagcattccaagggagagcccctgagctcagggctgagtgaaacctggccttgaacccagtataaccttctagtggccctctgaacctctgaggctatgacagaggaagaggggcccagaaccctaacagaggagggagtggggcacagggccgagtccgtttccttgcctccgtttcagaagagctgtccttggtgttgaagcaaacctcggctgcttgtctcctctgcaggggagagttatgtaaataacgcctgcgtctctgggaactccactgt

SEQ ID NO: 5473 - DNA, 860 bp, mus musculus
tgagaaggaaagggctttctacagctggttaaaacccgggttcaacagaatcactctgagcagagccctgagctgggctggcctccacagccaagtctgaagagtccgcacgtgctttcacaatcattcactgaggccgggtaatgcacagcctctggcctggctagacatttccccttaggaggtcaaaactctcttctccacccagccatccctctctccacacccatctccttacacacaccttcccattttcttttcactcctcccaaaacctgccaagagacactgccaaggggcggtggcagggaggattacttggtgctggtgctgggattctttatcctcaaatcagcttttactgactgcttctaaggagcagcgctgagtttactcacctgtattcagcaggtgtttgtttgtatgcacgccatggtcaaaacccagcccaccgcccacagcccagcaactgtagaaaccagcatcctttaggtgggttcttaaactgtaatgtggccctggggtaatattccaaggtggtgcttcagaaaatggataggtgcctaagaaagctacgtgtcccacccctgtgcattcagaaatgtcatttgttccctttattgtgccagttcctctctcttcttatgacttaataccccattgttatttaccatccagggctcagtcatattatcccagccactgggcaggcccagacagcctgtggtttttctgcaaatcagagctcccagaggtcgtctttgcacagacagagacagaactcgccctgctcagtgcttgcctttcatgctagacagtcaggcccactctagccctcatacactccactcagaacctaa

SEQ ID NO: 5474 - DNA, 1637 bp, mus musculus
actccaatctaagcccttgtcatatctgcttagactactgaagaagctgcctcaccctcaagcagtgtgctcttccaaaacatgcatctatgagaccgtcactgatttcccattgttctcaggctagcaaccttatcactgtcatggacaagaaggccctgccgtcgggcccctgtctctctttctagcctcatcttgaagccttctccctgctccttgtactccagcctcctagccgccaatgtgtcagcagagagtcttcgcgtattcagtttcctctaggtgactgtctctcccctgctgtctctgtctcattaccttctactcatactctctaaatcagctggagtgttatttcctcatggatgacttccctggtctcctggtctaagaagtgttctttatttttttatttttattttattttattattttatttattttttatttttttatttatctatatatatatattttttgagacggagtctcgctctgtcacgcaggctggaatgcagtggcctgatctcggctcactgcaagctctgcctcctgggttcacgtgattctcctgcctcagcctcctgagtagctgggactacaggcgcccaccaccatgcctggctaattttttgtagttttagtagagacagggtttcaccgtgttagccaggatggtctccatctgctgacctcgtgatccacccacctcggcctcccaaagttctgggattacaggcgtgagccatcgcacccggcaatttttttattttttatttttttattgagatggagtctcgctctgttgcccatactggagtacagtggtgcgatctcggctcactgcaacctccatctcccgggttcaagtggttctcctgcttcagcctcccgtgtagcttggattacaggtgtgcgccactacgcccatataatttttgtatttttagtagagacggggtttcaccatgttggccaagctgatcttgaactcctgacctcaagtaatctgcctgccttggcctcctcaagtgctgggattacaggcgtgagccaccacgcccggccgagtgttctttattggctgttcttacagacccatgctccttcccctcactgtacttacatcagttcacagtgtctttggttgctgtttcttgattaatgtctgtctccctgatcagagtatcagctgtgctccagttgaatgatgaaggtaaatcttaaaaagataaagtaaaggaccatctctgtgagcaggggtcacgcccaagtgtgctcaccatccagagtctctagcacttggcacagtgcttggaacaactagttgctgaatacatttgttgaatgactaaatggctatttacttattgaatgtttaggtagaggaagaagaacccactggatacattcgattcgaaaaatttcttccggtgatgacagaaatactactagaaagaaagtaagtaagtaaatgcaattgttaaggcaaagtaatggtcagaattatgaatccattcatttcaggacgcttggctttttcactttgtgtgttatactcaagcagtgtgtcctaaggtggcctccctctaacctttcaagctacttctgaactggcagttggtacctgcttagaa

SEQ ID NO: 5475 - DNA, 1637 bp, mus musculus; identical to SEQ ID NO: 5474

SEQ ID NO: 5476 - DNA, 1637 bp, mus musculus; identical to SEQ ID NO: 5474

SEQ ID NO: 5477 - DNA, 1637 bp, mus musculus; identical to SEQ ID NO: 5474

SEQ ID NO: 5478 - DNA, 876 bp, mus musculus
tgctgaatttttcctcatgggattttcgaattcctgggatattcagattgtacatgctgctctattcttcctagtttacctggcagctgtcataggaaatctcctaatcatcatacttaccactctggatgttcacctccaaaccccaatgtatttctttttgagaaacttgtctttcttagatttttgttacatctctgtcacaattccaaaatctattgttagttccttgactcatgatacttccatttctttctttgggtgtgctctgcaagccttctttttcatggacttggcaactacggaggtagccatccttacagtgatgtcctatgaccgctatatggccatctgccggcctttacattatgaggtcatcataaaccaaggtgtctgtctgaggatgatggccatgtcgtggctcagtggggtgatctgtggattcatgcatgtgatagcaacattctcattaccattctgtgggcgcaatagaatacgtcaatttttctgtaatattccacagctcctaagcctcttagaccccaaagtaattaccattgagattggagtcatggtttttggtacaagtcttgtgataatctcctttgttgtaattactctctcctacatgtacattttttctgtcatcatgaggattccttctaaggagggtagatcaaaaacattttctacctgcattccacatcttgtggttgtaacactctttatgatatctggcagcattgcctatgtgaagccaatttcaaattctccccccgttctggatgttttcctgtctgcgttctacacagtcgtgcccccgaccctgaaccccgtcatctatagtctgaggaatagggacatgaaggcagccct

SEQ ID NO: 5479 - DNA, 1457 bp, mus musculus
ccaagacattattgcattaaataatttttgcgttggcttataagtgttttccttcttcctcctcctcctctcccatctctctctctctttttctctttctctctccctccctctctctctcattctctttctctcagcacttacacaatggtgaattttacacatgtctcagaatttgttctacttgggttccaagggggtcccgggatgcaggctatgctatttctgatttttctgatcctgtatggcatagctgtggtgggaaaccttggcatgattgtaattatctgggtagatgcacacctccacaccccaatgtatgccttcctgcaaagcctttcattgttggacatctgctattcctccacaattgcacccagggctctggcgaactccatgcaagaggaccacacaatttcctttggcggatgtgctgctcagttctttttcttgtctctctttggtatcacagaggctttcctcctggctgccatggcctatgaccgcttcatcgccatctgcaaccctcttctgtactctgtgagcatgtctcaccaggtctgtgtgctgttaatatcaggatcctacttgtggggtgtagtcaatgccattgctcaaacaaccatgaccttcaggttgcctttctgtgggtccaatgagatcaacgactttttctgtgatgttcccccactcttgtccctctcatgttcagatacctttataaaccaactggttcttcttggtttatgtggctccattattgtcagtacctttttgattgtcctggtctcatacatttacatcatctcaacaattctgaggatcccgaccatgcagggacgctagaaagccttctccacgtgcgcttcccacctaacaggagtgtgcttgttttttggtactgttttcttcatgtatgcacaacccagtgccatcttcttcatggagcaaagtaaaatagtgtccatattctacactatggtcatccccatgctgaatcccctgatatacagcctgaggaacaaagaggtcaagcaggctctgagacggagcatgcagaagctgtctttgtgatcaccgtctccatggatctcctcagtcatcctggacctcgccccaaagcgctgctacccatggaggttatgtcttaggaatatggcattccagggcttcttagtttctttcttgaagtctgtgatccagaagaccaagggtattttaattgtctttatatgtttaacgataaacaaaatcaaggcttatgaggaataaaatgcagactggcggcgactgaatagacggatatatatggcttttttgtctcacatattacatagtatcttggtccaactccgtcagaaaacaattatgtaaaaattgtatattttatttagaaaataaataaaatgtttatcttgaatgtagcttaccaagtacaaatatggatcctacacaaa

SEQ ID NO: 5480 - DNA, 5492 bp, mus musculus
aatgttaaagatgtattgattctataaactttgatagataggtatatattaacaaaacttctttttttgttgttattggtaggccaccatgaagactttgcttagaacttggtcagaattatatagagcatttgctcgttgtgctgctttggtggcaacagcagaagagaacttgtgctgtgaggaactttcttccaagataatgtccagtttggaagatgaaggcttttctgtgagtttgtcctgatgctacctttttttgtttgtttttaaaggattcttttcaagtaaatggagataatatttgtgaactgtcacctattactgcctctatttatatgtgataaagttgatactgcaaacaagtatgctttgtgtaacagttttgtgtctttgggctctaagattcagttttgggatcattaatagtgaagatcttttactatactgtgttatctccttgtgcttgtgtcattctagattaacacttcaagggccttgctctcctggacctcactttctcatacgtatctgttagatctttaaattcaatccctttgaaagtttgtagtcttagaaaatataagtctcttttctctttcttttttttttttttttgagacggagtctcgctctgtcgcccaggctggagtgcagtggcgcgatctcggctcactgcaagctccgcctcccgggttcacgccattctcctgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggaccacaggcgtgagccaccgcgcccggcctctttctttccctcctcatggaaaggacagctgttgggaacagattgatatgcgtcattccagaatagacctctttctgtttacgcatgtcatttgtatattgatccttgcatatgcatttgaatatatggtattcttgccaatgaaatccttattgcatttattccaaagtaattatgtaacttttcgtaaaacactgtcttggctcagtttcaagtcaatccatatagctctattatttgtttcaactgctgtctagtattctgtagtatggttgtaccattacttggaattctattatttatttatttattattttttgagacagagtctcactctgctgcgcaggcttgagtgcagtggcacgatctcagctcactgcagcctccgccttctgggttcaagcgattcttctgcctcagcttcccgagttgctgggactacagttgcacaccatcatgcccagctaattttgtatttttagtagagatggggtttcaccatgttggccaggctggtctcgaattcttgacctgaggtgatccaccttggcctcccaaagtgctaggattacaggcgtgagccattgcacctggcctggaattctgttattttaaggacattttgtttttttctattatttattactgtgtatgatcctggtaatggccttcacacagaaaccgttgtttttccatgcagattattgaaatgatatttgttgtgcctgttttctctatagcttatatctaacacatattttaatgaggaataaaagaaagtaaaaataacagttctttttttttttcttgcccctgagacagagtctcacagtgattgttggacgacaacccaggctggagtgcattggtgcaatatgggctcactatgacctctgcctcccaggttcaagtgattctcctccctagtagctgggactacaggtgtgcaccaccatgcctggctaatttttgtatttttagtagagagggggtttcaccgtgttggccaggctggtcttgaactcctgacctcaggtgattagcccacctcagccttccaaagtgttgggattacaggtgtgagccgccgcgcccagccaaaaatgacagttcttattgtaaaagattacaaacaacaaagcaaattccccctcacacgtcttctcctcagtaataatcactacccatagttagatgttcattgttttagtgttttaaatggatttatatacatatcctctacttgttattagcacaattctaattgtatttgtcggagtgactttaaaaatgtaaatcagatcttgtcactcttgaagtattatagtgttttgttagatttggaataaaaatctgagctccttacactacccatgaggtttctgcttccttttccaaaggacttacctaatcgcgcttgtttatttttgttgtatagcatcttatttcctttttagtactgtctcgaaattgtttatttctgtactttattatgttatttcacccacactccatgaggttagggacattgtctgtcatgatggtgattatctctgggatctgtctactgaataaacaatgtgcaggtttttataactgatcggaagaaggttgaccctcagttatcacctttaaaaaatggtcttagttaggctttctccctttgttcttttccagaagaaacttggagtctgtcaaatttcacaaaataccctgttgagattttgcttggctttgataagggtgaattcacagattaattcggaaaagaatttacgtctttctaatcaaattgttccttccagggatttgtgtttatttaggtcttctaaagttaacctaacttgattattgtttttaagctgttttttaacattataaatgggtctgttcttccctcatacttgcttgttgctgaaggacataaaagttgttgcttacatacttccttgtattgaatcatgtgtttttgggatacacttcttggttacagtgctattcttttaaattatcataggattaatgtttttttctgcatgtatatcttcattagtgatattggagttctcattgttcaatttttgtattatggcaatagtgacctcttagaatgattcagaaaactgttcttcaccaatttatatagtgtaaaaggaatgccatatctacagttgtattctttttttctttctctctttttctttcttttctttctttcttgatgaggtcttgctgtgttgcccaagctggagtatagtggctattcacaggcaccatgcacactacagcctccacctcctgggttcaagcagtcatcctgcttcaacctcccgagtgggttggactacgtgatgccaagcccaccaacctttttgttctgaagtcttctcttttcttggttggacttggtaattaaaggcttatctaagtctaccaaggaaaacaacatgtagttttattttattgatcattactacacagctttttacttttctttgtctttaatacattgaatggttttgttttaaagcttttttcaaacatatgcatgtaagactttgattactgccatcagtgatcatatagactactttgatgcctttttttttttttttgagaccgagtttcactcttgttgtccaggctggagtgcagtggtgcgatctcggctcactgcaacctctgcctccgggttcaagtgattctcctgccttagcctccctagtagctgggattaaaggcgtgtgccaccacgcctggctaattttgtatttttagtagagacggggtttctccatgttggccaggctggtcttgaactcctgacctcaggtgattctgcctgccttggcctcccaaagtgctgggattacaggtgtgagccaccacacccagcctttgatgtcccccccttttttttttaatagcaccagggaacttggaagggtgctttgtaatttgagaattttttatggatatgtgttgctattttatcattaattttttattttactgtattgtgatcagagaggatcatctaggacttctaattttggaattcatcctgtgttataactgtgataatgtagttttataattgtttatttataagacacttgggatcaggtatctccctgattatgaatttgctgtatattaacatgtttattaaatactttgatgccatattgttatacattagagattaatgactactgatgttttcattgtaatgtgttccttgttactgcctttttcttaaattctactagcttgaaatttattacaccttcttgaaaatttgtgtcaaatgtgtctttaaaaacaccatcctgagcaataattctttctttttttttttgacggagcctcgctctgtcgcaggctggcgtgcaatggtgtgaactcggctcactgcagcctccgcctcccgggttcaagcagttctcctgccccagcctcccgagtagctgggattacaagcattcaccaccacgcctggctaatttttgtgtttttagtagagacggggtttcaccatgttggccaggctggtctcgaactccagacctcaggtgatccacccacctcagcctcccaaagtgctgggattgcaggcgtgagccaccagtcctggccagcaacttctttttatgttttgtttccactgggtttagtgaaaacttttacttcataattttcaagaggaatttgatagagaatctgtgatcctagtatttccaatctcagtttattggttgatatgatggcttttatggggatcttaaaagtgaattatttttcttaaatattgaggaagagaaagtacagtgtttgactcagcagttaactgaaaaagatttgtaatcatgtatggtcatgcgcctcataacaatgtgtcagtcaacaacagaccgcaaatctagtgctacatatcctaagcagaacgttataatacggtatttttactgtgtcttttcgatgcttagatacacaaatacataccattttgttacagttgcctagagtattcagtatagtaactacacacctatacaggtgcctaggctatgtgtttgtagcttaggaacaacagactatataggtgtgtagtaggctgtatcatctaggtttgtgtgggtacactgtgttctcacaagatgaaattgcctgatgacccatttttcacagtggatctctgttaagccgtgggtggctgcacttaatgtactgtaagctgtggcatgtgtgttacataggatatatgggagtaacagtcttatattttttcatgttgcttacttttgttgaatactgtcccagtacttgaatgtttctaacagtggtactttcttccctagaatttgttgttcgtggatagaattatttatattattactgtaatggttgattgcattgacttctcaccatataatattaaatatcagcccaaagttaaatgtaagtatgtattttttaacctttgtttgtccagtatttcataagcagtactgaactttgccaggggaagtcctaatacctttgccacctcattttactaacttttgatcttgtttaaccatgttagtta

SEQ ID NO: 5481 - DNA, 5492 bp, mus musculus; identical to SEQ ID NO: 5480

SEQ ID NO: 5482 - DNA, 5492 bp, mus musculus; identical to SEQ ID NO: 5480

SEQ ID NO: 5483 - DNA, 760 bp, mus musculus
gagcacatcagactctctgtctctaacgtggcttttacaggggcctagagccttcggggtgggggaaagccttctcctgccattgcacgcagagcaccagagagagccaggctcccgagagggaccatgcaggcaccaagagaggtaggacttgagggcagtgcagctggaaggccaggcccaggcctcctggagccattccaggtccagcccagtatttgctgcccctggggaacctcgttcacactgacatcaactagagttggcttttcttaagattattccgagccgagggaaggttaatttatgcactgggcagtatgttcagctctgtgatgccagctgaccatcattgagaacttctctgtgctcaccactcatctaagctctacgtgcagcaccaggaaccctgacagccatgttatgtgtgttctgttttctccatttctccacacatgagaaacccaagtccaagctcaatgaacgcacttgcctaggatcaaaaatctggaaagtggctggtttgggattcaaaccccaaccatcctatcctagagccagtcctcaaagctgtgccctcaactgctgagacagcagtgatcctgcagagggagggtatgggaagacaccttcattctgaactattcccattcttctcccttttctagagttggaaaggttgcagattctctgcccaaccaaaagtttcagaggaacaactctgtgccaggcacccttctaaactcagataattagagat

SEQ ID NO: 5484 - DNA, 1725 bp, mus musculus
attcttggattattttcaatgctgggaagaacatttggcccagggaaaacttttaacagcaaagaagttaagaattgaaaatgatcatgtagtaaggcagaacggatctaggatgcaaggcagcagcattgtaaggaattatcctgtgggaagggaacatgaggagagggccaatagcaagcaggagaaacacaaaatcaaaataaggaaagggatttaccaactccagcttaagtgatagaactgggtatctctctgtgtagaggaaacaagtgtttgtccaaagagttctgtgtttgccttgtgggtaactaccaccacgtggatcattcagggtttaagactgtgtcctctagttagggttatttccaccatatttacctaaaaatggggaaatgttaatacactgttcatctgagcactttaaaaatctaaatgtttattttacaaatatcacttatagctagaaaaattaaacattctatatcaaaacatcaaatatcctgtatccaaagcttaaaagtacaattatcttctcaggactaatttggccttctaatcactcatctgcatttgtatgagcaaatactgaattcgcctttgctgaaacctaagggcttccccaggttattttcctcatccgagatgcctgccctcacagtctcagccacttcatgtagttaggcactaatccactctatttttatgcattatcactggattttgaatggaaatttacttgtcttgaattctggacttactgaagaggagcaaaacaggctcagccactctcactgccactatcccaaccaggccatacaaagagaaaacagaaattcaaaaggagcacctaggaccaggcgtgttggtggccaccagaagtccatctgaatgcggggtccttaaggaggaacactggggcttaagccccatcctttctgtggaggaccgattgggaagcactccccatttcctataagtcaagtgaggaggactcccgggcacatcgggagcaccagcttcacacttcctgctaaacatttgctgaacaacagcagcctctagggccaccacagcctggccaccagagaaaataatagtgggagagaccctaggtaagacgggcttgtgtccctgcagtgtggggacatgtgtgaacatacagacttgtgtttgctcctctcctgaaaattctgaggcaggagtctggctggagcatccaagaatgctgggcaaggaaacatggcaaccatcacctggcaaggtgaggcaggagaaagtcaccgttgggcacggcagcctccgagacacctttagcatacccggagcaagaggtctgtctgccaggtgagagaaggcaatgaggaggctgtgggcctggtctaaggggaggggagtcacaggagatgggtgaaaaagcttatcactcagtcagcaggctgagcagtccagaagccccacccggagatccagggaggagccgctcgcccttcccccagcctccctgaccccagcagagatggctgctatcagccaacagagcacaacagcagcactggctaaacaggcacaacttcttacctttttgctctctgatcctccctcacccagaatagggatgaaggagggaggaagcatgcaaggactccaaatcacggaacagcctgggaggagaggaaactgagactgggatgtgagattgaagtttttatttagattagatgg

SEQ ID NO: 5485 - DNA, 1046 bp, mus musculus
agaatatactaatataacgttaatatagagcatatcaacatactaccaatattacataaattgtaatgataaaattataattataaataatgattaataatgaccaataatatggctaataactaattattaagttggtgcaataacatggcaccctttttttgaaaagtctaatggaacttgccatctgatttcttacaccttctcagaatccttgtgaagttgctggctggggatgggaatagttacagtgcggaaactgaagcacaaagatttatatccaggcaaaaagttattcagggatgaatctagggcacggagtagacaaaacagacctgcaagcctgcgtctcagccttcagaggtgcagggagggtgaggcagtccagcatgtgcctttcccatgcccgcagctccactccttaggctacaaccaacgtggcctgtctggccgttcctgggtggtctctctcactggcactggctattctcataccttcttagagtgaaaacgacttcaccatttactttgaacaccaattgctagatttttccaacacttaatgccttgctttttataatccatttgaggattacatgaattccttctcctgccccaccacacacatcccgggctgaatagcttttggtttgcattcctgatgcaagtgctcagagctggtgttctccacgttttctttggactaagaaagcttatacatgaagaatttttcttctgcctggctaaaacctgctgaaatggtgcaaatcagatgtcacggatttgttttaaacagcagcatttaatgaaaaccaaaacaaattaataaaactacagaaaacagaaatactgacaggcttatcaataatggcaagtagtaccctctgctagaacaaaatactcatttcaaatcacgaacacttacaaaattttagaaggcaaagtatttatttttgactcatggattcaatgagtactgagtggaggaaactggaaggtggaagtgcaataaaagatatttatttgcaagtgtgcatgtgtgtgtg

SEQ ID NO: 5486 - DNA, 824 bp, mus musculus
cacaatcatgaagtctgagaagtcccacaacctgatgcctgcaagctggacaacaggcaagcccaggtgcatttccagctcaagcttgaggcttgagcaccaggggagccaatggcataagtcctagtctgagtctgaaggccccaaaactagcagcagccacgtctgagggcaggagaagatggatgtcccagctcaagcaaagacagcaaattcatcctttctccacctttctgctggaatccagccttccacaggttgtctgacgtcacctgcattggcaagagtgaatctgcctgactcagtctactctatcccatgccagggtcttccagaaacacctcacagacacacccaggaacaatgtcttaccagccatctgggcatcccctggccagtcaggttagcacatacaattacccctcacaggtgctgtcttgtcgaattcatctaatgtcagctctttctctggtgctacttcctgccaagagacctcagccccgtttttgccaggttctggtgctgctctgctggagacatgcacaccaggatgaggaacttttgaccaatcatgccctggccacgaacttctttttttcatacacatgttaatggaatcctgacagtattcccattttaggagagcaaaaggaagaagagctattcccaagcattgaaaataacattaagggaaactagagaaatagaagagtggtatcttagaatccaagggaggggagagagggttaaagatatggcaaaagtcaaaccagaatgggtcataaaagacattccttttgacaaacggaatggggccacagctt

SEQ ID NO: 5487 - DNA, 1063 bp, mus musculus
catttagttttaatcaatttggttccaatcaaagggatttttcaacgcttgaaacacactgagaggtctgaggacacaacgtatttctaaattcaacggggaaaaatctattttgtgtcatcattatgaccttgcttggtaatatcatcccttttgcccacacctgggtgatgtcttctttcttggtggagcttagtatgccaaccacacactgctctgtgacgtgtttccttggcagtggatccaagtccgtagcatccatcgaaggggtcagtgaaaggcaagcagcaggctggtgtgagctggacatctggcatgtagtaaatgcattgagaaagctaataaaccactcattgtgaatgactcctgaaattgattccaacatgagcagttgggggagaaataagcttttaggaaggtcatttaatgtcatatagagtctttctctacaacccagttaaactgcttagcagtttacaaagcaaatcccagcccaattttgatctggtaattaattgagccttctactcagggaaagtctgtgcatagaaactagatatggccataattctttagccttaataactcaggatttgaattgccagatggtctttgacacgagatcgctgctgaagagaaatggaaatcactccactcatgtcagtgctttgtggattcctcaccagtgacatagaagcttggtgtatgtagctgcacccctgcaagtgcagtcttactgaagttctcatattaatcttacaaacacattatcagaagtgggaaatgactaaggatatgatcaaagaggactcaaatgtttctccaggtctcacctgtgggaaagaatactatttcttacaaaaaggaagtggaaagggctctatgtctgtacatggaacgaggaaggttgaggtcctggagaggatgaaggcctgggaagctccactctcagcacctggaaggactgcaggcctcagggacaccaactaaacaagcgagagtccagaacaatgaaattacaatcaaaccaatgctgatatgcaatgctactaaccatggttta

SEQ ID NO: 5488 - DNA, 955 bp, mus musculus
gctctccatgctccccaaaacaacactcacgaaaagctgcccaaagctagggatacagaggagagggctactttttagagtgacttctaacaaaccatttttccacaagacaaaagagcagagagattcagttgtgtgttcatcctgtggtctacaataacagcagcccctccaccgtcagcaccgcccatgctatcatgcctctgccttctctctagagcagtgcactcccggaacacactgggaaggggcccttcctctaaactatctagctgtcactgtcaccacttaataaacagttaaaatgcagtgactcagattgcaagtgtcagtttggcctgggtgattgtcaaatggacccatcccagctaatttaggtcttccgtggctctactcaggatgcctaaaggcaggcctgatgcctacacatcctggcaaattccaggagcaaggggggcaagaaaagtgcatggagagtgcatccgggcatggtggcatccaggtgtgagtgacgtggaagaaagacttgggaaggaggagccacgtgctctcaatcagtgagtaatttatggtctgtgctccaaaaacagcagcagtcccccttctcctacaacctctggaggcagaacccatggctctgccatgtcaggtctctccacacctgctgtgacaagcaggagagaagagagtgtttgtcactcaagggagttcttcatggacggcttgcacttgccgtcgtgagccagctggtcccatcactccttgtacaaggggcttctctcctacgctcacttaattcagtcaaatagcatccatgtgtggttctgggccacattctatcatccagagtggctcattaaggatgcccaagtggggtgaagagtgtctgcaagtaattttgtaaattttaacaaacttaacaagaaacagtctaaagcattcaaaacacaaaatc

SEQ ID NO: 5489 - DNA, 291 bp, mus musculus
ttgctgtgctaatttcatgccctcctaccttgtgtatgcttggatagtgtggggccacttgtttgcctcttaaattgctgcccattggggcaggggccatggcttatgtatggtctgtgccaagagagatctaagcatgattaaatctggctgctcttctcttcctttttaccacctcttgatgtttgcatccttctagggcttaaagttcaagagcagcttttagaacctccatcgcggggttgtagagagaggagatctcatcctttttctgtatttccaaatcctatc

SEQ ID NO: 5490 - DNA, 612 bp, mus musculus
tggggcaagggacccaatccaatcaccactgccctcccaaccactgcttgcattctgtctataaacatatttttaacagaatacttgagtggagagaagacccccatcatggggggaaaagaaaccactgtgccttcacatatcttaaaccaatggcttttccttatgctgaattaacatgtcttctctcattttgtatgctgaaggattagcacctccctgcaattcaattatatgaacatttatggagcacctactgtgtgcctgcctgctctgttttggagctagagatacaaagataaataaaacacctccccttctcccaggagcctagtgactgcagtgagctgagaaaacagatgttttagtcatgatctaatgtgaacatttgtataatgcaagcatccagtgctctggggcaagagaagcattgtatttccagagtgaagttgagacttaccagttcaatgaaatgaatgcgcccatctcgtctgaatcattaattggctacaacaattacttcacatgccaatgagaatagagaggatgctgatgtgcacaggcagggaggaagggcaggggtggcacttcacagcgtgctcctgactctat

SEQ ID NO: 5491 - DNA, 1412 bp, mus musculus
tttactggcccggttttgtgtgaggttggctggctgctgtagcacgttctccccctcctcctcctcctgcaccccctcggttccctcctctgcctgcgggaataccacttcagggcgttcagcagccttcccagggtgggtcctggcctagtaccctaaaactataaccgagaatacctatcattgggcagcctaggaaacgcgactgggacttttagtaggggcccctcaccgctctgaagcactcacacttgagtcagggaacatgggtttgaatccccacccggccgtttatcttgtgctcttgggcacactgtgtcccctatataaaataagcacccatctcttcatctgtctcctaggcctgcgacgatgcaatgactgcacgcaaagcgcacattcacggtcaggtcacttctggcgtccggctgtggtccccgcagggtgcccgccggcggagcgcatcctccggcagggggcgagctccgcaccccgctttcctcatgggccggcgcggcccgccgttcaagtggggagcccagaggtgctccgcgccgtgggcggggggcggttggcgcgcacaaggccggactccggcggggcgcacctccacacgcaccctcgcgggcagcgggtcggagtcggggcctcgggccggctgggggcggggcatgggcgcggcgcgcggggcccggaacgccgagacaatgcggcgcgcggcggccaggaacggctcggcgggccggggcgcgcgccgccttccttcctgcgggatccgcttcccggcggcgcggcagcggcgagcgcgccgattggcggcccggtcctcccgccgccccgccccacgcccggccggccgccgcccccggcccggacccgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggtgaggcggcctgcgcggcggctccggccgcaggtatcccgcgccccagccccgcccgccgctcccgca

SEQ ID NO: 5492 - DNA, 236 bp, mus musculus
ataaccgagaatacctatcattgggcagcctaggaaacgcgactgggacttttagtaggggcccctcaccgctctgaagcactcacacttgagtcagggaacatgggtttgaatccccacccggccgtttatcttgtgctcttgggcacactgtgtcccctatataaaataagcacccatctcttcatctgtctcctaggcctgcgacgatgcaatgactgcacgcaaagcgcaca

SEQ ID NO: 5493 - DNA, 736 bp, mus musculus
cgcggcgcgcggggcccggaacgccgagacaatgcggcgcgcggcggccaggaacggctcggcgggccggggcgcgcgccgccttccttcctgcgggatccgcttcccggcggcgcggcagcggcgagcgcgccgattggcggcccggtcctcccgccgccccgccccacgcccggccggccgccgcccccggcccggacccgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggtgaggcggcctgcgcggcggctccggccgcaggtatcccgcgccccagccccgcccgccgctcccgca

SEQ ID NO: 5494 - DNA, 815 bp, mus musculus
catattggctcagcaaccaccgggagagccatcacctggaaacttgctgaaatgcagagccccgggttccacccaggacaatttttacagcatctccacgtacaccacaggcacgtgagagcttgcgaagcactgttcgagacggaaccccggctgcacactggagttgcttgggcgtttgtgaagcagagctgcctggctccactccctaaaattctgacttaaattagtctgggtggggcttcgagccttggcattttttaaagcctcctcccaaatagggttgataatcactgataaacagacagttacgtaacaaccttaggcagttgatacgtgctgtaaaggaaagtcatgcataacatggggatagaaagtggttctggagatcaggaaaccgaaatcaggaaaagcctctctgcagaggtgacatttgagcaggctggaatgcagagaggaagccagccacagaagatgtgggaatagaacagcttgggaaaaggccctgaaatgccaatgggcgggatcatggaaggactgaaggaaggtcagggtgtgtggggaggagtgggcgaggaagagaaggatgagagacgggcagaggggtgggcagtgccaggtcacagagggccttgtccatcttggggaaggaatttggattttgttctagtgtgatgggaagctgttgaagggttttgagcagggaataacatggtccgatatccattttaaagacttcactgtggttctagggaaaacagactagcagggcatgaaaggaaagagggagaccagttgtggggtgaggggctatt

SEQ ID NO: 5495 - DNA, 537 bp, mus musculus
cagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattcc

SEQ ID NO: 5496 - DNA, 537 bp, mus musculus; identical to SEQ ID NO: 5495

SEQ ID NO: 5497 - DNA, 537 bp, mus musculus; identical to SEQ ID NO: 5495

SEQ ID NO: 5498 - DNA, 537 bp, mus musculus; identical to SEQ ID NO: 5495

SEQ ID NO: 5499 - DNA, 537 bp, mus musculus; identical to SEQ ID NO: 5495

SEQ ID NO: 5500 - DNA, 1511 bp, mus musculus
cctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaag

SEQ ID NO: 5501 - DNA, 1511 bp, mus musculus; identical to SEQ ID NO: 5500

SEQ ID NO: 5502 - DNA, 1511 bp, mus musculus; identical to SEQ ID NO: 5500

SEQ ID NO: 5503 - DNA, 1511 bp, mus musculus; identical to SEQ ID NO: 5500

SEQ ID NO: 5504 - DNA, 1511 bp, mus musculus; identical to SEQ ID NO: 5500

SEQ ID NO: 5505 - DNA, 263 bp, mus musculus
acttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagcta

SEQ ID NO: 5506 - DNA, 263 bp, mus musculus; identical to SEQ ID NO: 5505

SEQ ID NO: 5507 - DNA, 263 bp, mus musculus; identical to SEQ ID NO: 5505

SEQ ID NO: 5508 - DNA, 263 bp, mus musculus; identical to SEQ ID NO: 5505

SEQ ID NO: 5509 - DNA, 263 bp, mus musculus; identical to SEQ ID NO: 5505

SEQ ID NO: 5510 - DNA, 576 bp, mus musculus
agtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttat

SEQ ID NO: 5511 - DNA, 576 bp, mus musculus; identical to SEQ ID NO: 5510

SEQ ID NO: 5512 - DNA, 576 bp, mus musculus; identical to SEQ ID NO: 5510

SEQ ID NO: 5513 - DNA, 576 bp, mus musculus; identical to SEQ ID NO: 5510

SEQ ID NO: 5514 - DNA, 576 bp, mus musculus; identical to SEQ ID NO: 5510

SEQ ID NO: 5515 - DNA, 800 bp, mus musculus
acaaccatgaatctccttcctgttctatggatcgacctattctggacattttatataagtggaattacacaacatgcgagcttttgtgcctggcttctttcacttagcatggtgtgttcggggtccatgcgagttgcagcatgtatcaatatccattccttttcatagctgaataagattccatggcatggataaaccacatattgtttaaccttccatcagtccatgaacatttgccttgtttctatttttttggctattgtgaataatgctgctgtgaacgcacagatacaagtgtgtgcttggacatatcttttcatctcttggaaattcaccgaggagtggaattgctgggtcatatggtagctctgtgttcaactttttctttccagaacaggaatggaagtttatttataaagctttagaacaggaaagaggaagatgcgcttggcagggatccaagtaggcgccaaggcccaagagagaaaagaagagagaaaaaagagagctgtgttcaactttgtgaggagctgccaggctgttttccccagcagccgcacgcgttacattcccaccagcactgtatgagagttccaattccccacatccttgccaacacccatcttctgtcgttttgattttagctctcctagtgggtgtgcagtggtatcttgtcgtggttttggtttacatttcctaatgactaatgatgttgagcatctattcacgtgcttattggccatttgtgtcttctttgggaaaacatgcattaaagttctttgcctgtttttgaattgggt

SEQ ID NO: 5516 - DNA, 2731 bp, mus musculus
gaggttagattttgatgatactgatccgtatttgtggtgttttgtcttcaggttaatcactttgtatgggattggaggtgactctgaggacagtcccgttatacactaattatgatggtggtatcatatactgacactgaatgatttgcgctgtaccatcttttacttcttacttcatgtttacagtattcctgtgcttaagaaatccaggattccatttcttatttagcagacagaaagtgctaacagattaattggggccagatccacatcttactcatttttgtatcttggaggccactgccccacagagtagtcgtttccaaagtgttgctcaaccgtcactgaaccactgaggttttctccatgtgttgttgatttatgggagaggcaggcgtggatttccattcctctgaatcccggccatggctctgtgtcttaaacaattttacatctaggattctttgctacaaacagaaacccacgtgggaggcaggtgggaaatgacctgatttctttattgttctctgtggagaagaacagggtggagacgagtgtgcgggacctggtaggggtgagtttgaatgtgactgtgaatggcctggctcgctctcgcctgggatgctcttgaaacctttctgtttcccctggtggtgtcccaggtgcctccccctgacccaccgctggtctgtgcttcacaggcacaagaaagaataggaaggcaccagggtatcgatatttcccagctgggaattctgagtttggctgtgagtgtgcttggaagggagaaggcaggtgtgttgaggatggagcccaggccaaggacatgccaccctctgagcagccagcatggaaagcagacatttcaaaataagtggttgtttactgcacaagctgtagcggaagcagtcgacattggagtcaggcaagtgtggtttggaatcccagctttgctcctcggtaaccattggaccttggggaagctccctgacacatctgagcaaaggtgccagtgccaccgtcagtgcccagacaggctgggatggagctggcctggaggctgcatgggaggcatgctaccccaaaagaggcacacacaacaaagatgcgaaactgcgtgctctcagcaacttaaaccaacttaaatagctacactagaaatgccccgctttcctggaattcattttaacaaccttctctgtcttggcaataatttctaaacacaagaggtagcacagagcaggatgtacagcagggaccttgtccaacagccttcagtgtgatctttggcaaattaatccacctctcagcgtctccatctgtgaaatggggttaagaataacaccgatgcggtagaccccgtctcactgggtcttcgaggcaacttcatgagaaaatgatccagagtgcagaaaccaattggggaggatggctctgtggtcacctggaggacatgcgttcaatcccaaaccatacagtttctgttggctgaatgcaggatgtctgccaaatccatcctgccctctggcagtgcccaaggctgtgggagcccacctcttacattagtgtgacctggatgtgagacatggagtcaaaggagatcattttggaacttttaaatttaatgactgccctattggatttcacacttgcatggggcttgtagccccttcgttttggccaatttgtcccaatggaaacaggtgtatttacccaatgcctgtaccccaattgtatctaggaagcaactcacttgcttttgattttactggctcataggcagaggggacctgtctcagatgagactttggactgtggattttgagttaatgctgaaatgagttaagactttgggggactgttgggaaggcatgtttgattttgaaatgtgaaaagacatgagatttgggagggtccaggggcagaatgatatgctttggctctgtgtccccatccaaatgtcactttgaactgtaatccccataatccccaggtgtcaagggtgggaccagttggagggaattgcatcatggggccgtttcccccatgccgctgttctcgtgatagggagttctcacgagatctgatggttttacaaacatctggcatttctccggcttgcactcactccgtcctgctgccctgtgaagaaggcacctgcttttcctttgccttcagccatgattgtaagtttcctgaggcctccccagccatgtggaactgtgagtcaattaatacctctttcctttataaattacccagtcttgggtatttcttcatagcagtgtgagaacggactaatacagccagtcttagacctaggggaagatgggcctgagggtcagagagttaggtttacaagggagggaagaggacagcaactgggaggggcccgtacacagtgggcacagtggcattgctggtgccagcactgctcttactcttactccttctagacatagcaggcaggaccccaggagagtgtggagagcagcgagatacttctgcagctcttcccacgttggaacctcagctcttgcagtttacttggggtgtcacggattttctcactgtccgatacaatcatattcaaatggggcaaaaaatgctttttcccatcaaatagaaacagctggaccattcgccattctgagttagtcacagtatggttccttatcaaacctgaaaaattaagaattgactcttgtgaaaactcagattttgaaaagaa

SEQ ID NO: 5517 - DNA, 2731 bp, mus musculus; identical to SEQ ID NO: 5516

SEQ ID NO: 5518 - DNA, 2731 bp, mus musculus; identical to SEQ ID NO: 5516

SEQ ID NO: 5519 - DNA, 319 bp, mus musculus
ccaacagagtatgttgacaaatctaaatttttacaaaaaaaattgaaaaaattgtattttagtgtagctttaacttccattgcttatgtggatctttttgtattttaaagagccatttggctgttttttttctttttaaggagaattagctgttcctattttttgaacatttttatatcaggcagttgagaattttctccttcctttatatagtttttccagcagaatcattattttttatttttacgtaagttggaaggtgttccctttggaaattctgatgtcgatctgatttttgttctctttttcgtagctcttc

SEQ ID NO: 5520 - DNA, 377 bp, mus musculus
acaagaattcaaagtataccagatgagtacaaagaaaatggaatagcttaaagaaaggcgttgctttttacctatgataacctttccctaaagctggcacagctcagtgtaattgggagaaaatgttcaacttgtgatttcttgtttgaaagggaaagagaaaagtgaaatgtacatccaatattctcaatttgtgaagggctgccagagaaattggtttctgtcttatatgactcagagtattgatggagaatcagcatactttgggctgcttagaacaaaggggagcttggtagtttgtttgttacaacaacagagaacctgcaataccccagacaggcaccatagggaggaatcgattattagcttcttaaaaa

SEQ ID NO: 5521 - DNA, 292 bp, mus musculus
atgcctagattatagaataatttgaagagtattttttgaatgaaaacaatgctgtaaaactgattacagttttcctaaaatgtcattatctctcacagctttacatctatccttgcttgttgtgttctgtgaccttttgtagctctcccctttcataattgaaaaaccattcttccttcaaaaacttcacctcagatgacatctcttgatctttcttcagcacagtgcaggaagctcttaagacagtgggagctctaagaatgtaaagcattattactattatttgccaaag

SEQ ID NO: 5522 - DNA, 1009 bp, mus musculus
atacattaaatctctttcaaatgcagagattaataaaaacagttcttcaactgggtttaaaaaccttttttcatgctgtataaagaaagttattttattttttgacttagaaatatccgattagctgcactgtaactgcttgtaagatctttactaccctcttgtgatggttaatactgagtgtcaacctgactggattgaaggatgcaaagtattgatcctgggtgtgtccttgatggtgttgccaaggagattaacatttgagtcagtggactgggaaaggcagacccactaatgtgggtgggcaccatctaatcagctgccagcacggccaggatataaagcaggcagaaaaacgttaaaagagtagactggtctcgtctcccagcctccatctttctcctgtgctggatgcttcctgctgtcaaacatcggactccacgtttttcagttttgggactcggacttgttctctttgcttctcagcttgcagatggcctattgtgggactttgtgattgtgtgagttaatacttaataaacttccatatatatatatatatatatatggataccctattataatatatatatatatatatatatatatatatatatatatatatctcctcttagttctgtccctctagagaaccctgactaatacgcctcctgaagttatttatttgttggttggttagttgtctcttcccacatggcccacctagtgttttcaattaataatgttgaatctccatttccattaaacttacaaatacattttgaggatttttgcttctaagaaagagggagatcttcaagacacagcaactattccacaaaaaagcaatcagaacagcaagatacatgaaaacaaacaaacaaataaacatgtatttcaaagaatcagagaagcaatgaagaatgaagactgtaattaccccaagaaggaagccccttgaagaggcaccctgagcactttcagcaatagctggatgtggtcatgggtc

SEQ ID NO: 5523 - DNA, 1030 bp, mus musculus
gtcaaagcttttctctgtggtccagtgctcagctgccattggactcagatccaaacaagtttagggaaagagacagtacactgacctttgtttcctgtttccttccaactctagagcaagttctatttcagctccaccatcaacaaatagctctgaaaaccaaatagaccacactgttggaagtcagagagagtgaggtcaaagagaagtcccaaaagagggaatataacatcttctcatttccttggtggaaatttccagccttcacactcatccatcaggatatcctccttctctgctcttatcactcaaatgtttcatctgttccagtgtccacctgaagatgacacagctgtatcaggctggatgatcttttatgttgtgtctgcattcattgctttctctatttcctttcctttgtgatattttcagcattaggaagtttcactcactttgaccattgttttcatacatttgggttttagacacaggattgtttaatttgaatccaaaaggatggacaggaaggaaagcagacagcagagatatcattcacttcctaactgaaatcataacattctactttcatgactttgtcacactacagaaaaatgcagggcattcatttgaagaaatgtaaacagtaagactgtgacatgttctcttcttcagggtcttcattcaaaaggtgaagactaaacttgtttttggaggagatttttgacttttctgattgcacattctcctaataaaggccagatttggctcaaagtgaatgtgcaatttcctagcactaaaattctttcatgagttgcttaagtattaatagaaatcactcattgcacttttttgataataggtctgcagaaattaagctgcctgattgatgcttcaacattgctactgaaacttttgtatgtgtgtgtcttggattttgttttatttcctttttgtgcaaaagctctggtgctaaacagatctggttatgaatattggcttggccatgtaccaaatgcatagctttgggcac

SEQ ID NO: 5524 - DNA, 737 bp, mus musculus
ccatacagcagagtagatacagagtgctgccaggagctgccaccctgagcacagaaggctactctgcagcagccttgggactgggccacatggccatagaagcagccagaaaggaagaaagggtggggtgaagccaaaattcaagccaggcattttcaacttcagcccttagctagtgaggtcattttccatgtaatctctgtttccactagattcaatgtctcttaaatgttgaacacacaaaatctgaacccatcccatgagccatccagaccaacacaatgatgcttgcattcctggcattgtcatctggatcaggaattagtgtgagtccaagattcaagcctgggcttgaggttacactttgaccaccacttccatgagtgtcttgtacttagagaggatagccctggtttccagagagtacactccatcatatctctaaaaggcagaagtgtctgggggttcagagactgggctagaattccagctctaccacggacttcctgtgtggcttttgccttcagtttcctcctatgttgtgtgggaataataagagaacctacttcagagtgatagcaaagatctaatgagctcattcatgtaaagcatttgaaatactatatgtggaagcattctgtaatgtaaaatataattatcaatgctcacacatgtatactctcctattaaaattatacagtttcaaactctaacatcgcaaggctgctactgattct

SEQ ID NO: 5525 - DNA, 499 bp, mus musculus
tctcacctgtaagccaaccatcttctggacatatgaattcgagagagcttcaaacttgagccctcagtgatgtgccccactgggcatttccttgacagtgtctagcatcctgaggccatgtcaccagtgcctctccaaggaaagctcctcaggtacagtagtttgttttcacagtgtgaacagtagcctgaaataaggttagcatggcagcttgcacaacaactttgcactggattgtgatgagcaggggtaggaggcgtttcttggaggttgattaatccatacgtgtttatgcagactttccttagagaacacctcctcaccctgacagtcagtgtgtgcacaggcctcctaatgcactgtgtgctagttaaaatgtccaatgtggaaagtattataacagctatgcaaccaactctgattggaagcagcttttgcttcagatatgatctgtgttaccagaaaattgggcatgtgcagggctggcttaatttcttta

SEQ ID NO: 5526 - DNA, 1015 bp, mus musculus
ctacctttctactcacctaactcacacttgtgttatttgatgcagatccttaaaaatggctcatggattacagaggcatgaaactggtatggaaacccatagaaacaaatgaattttaacacatgatcccctcactcccctatggcctcttttatttccagagtgcatgcttcttaacaaacatccattcaccctgtggtcctcagagaaggtggcaaagaagaggcagttttgatgagttaattttgcccatttgccccacaatattctctctggagggatgtggaaaccctaaatcatcttgaagagtgcatgaactttattttcttaatcaagccccatgttattaagttttctcattattcactgagttttttccattggccaagtctgtgccaatccctcaaaacatctgaaactcagaaccacacgtgaatgatctgatctttgcctagcaccatagcacagccacctcccttgccctggaatgcccttttagcaacatagctggtttcccctggcatttttgacattcacatcgcactgtggactcccactgagcctgctgtcaatgaaatctctaaggcttttccccatgtattgcagtttagccatttctcccccatctcatgtacaatttgacttttgaacccaagtgcaggaccctccatttacccctattaagtttcaccttgttagattcaggctattgttccagcctgtcaaaatcattttagatctcagccctgtcagctgtctccctccttgctttatgccatctgcaaatttgatcagcatgctttccatgttttcatctaagtcatctatggaaaggttgggtagcaccgaggcaaggacatggccttctaggtcactggagattgctctccaggttgccagttatccatcaatcaacagtcactgagtactgtctttcatccaggttccagtacactgagttacattatcatccagccacatttctccattgagtccacatcaatatcaggggtat

SEQ ID NO: 5527 - DNA, 1002 bp, mus musculus
acataaagaagacatttctaatggctcaggtttcccaacaatggaatagtctgtgtgttgagtaaatgagaggttaagaggctggaaggtctctggcaactgaaagaagatcccaaacctgaaaggaggtttaacgaatccattccagaggaaaggtgctataattattagggaagtgggattcgaaaggacatactttgattaattagaaaggtcaggaaggtggcaaatgtgttggcaaagatgcagaggtagggatcacaggtgtgtctgggggtagtaagtaaagctgattggctgaggtgaggactttcggttgcccaaatctccccttgcaatgggcaaggcctagtgaggtgcaggggttgggttaagaaaactgattacttgaagaagctgggaagatttaaaggggagagagaggtggggagaaaagagggccagatctcgaaagagccacagttcaaaagtaaagaactcaatttctaccttcaagaccaagaggccaccaactgcatccagaaacaagaggtcaagtcagcataggatcagaaactaggaagcaagaaccaggcggggggtcatcggaagtgcttctggctgcaatgtcagtgtcaagggtgtcctttctgcagccgcgtggtttaaaggtgctcagggggtgagggcaaacagtgttgagaataatgggctcacttctacgcagtggggctggcctcacagctacaggggacagactgaccccagatgtgccccccacccacagcacagcaaacccctgaaggatgaatagagactcccaccctgggaccaggatgcccggcacagtctggggctcggtgacatggctcctgtcccagaacatccatccgggcagagacaacaaaattgcaggctcgaatctgctctttgccattttctagaaaatggcttcacttataaaaagaaggaagggaaggaatatgggccaattctgagggctaattgtctttgctctcaaca

SEQ ID NO: 5528 - DNA, 144 bp, mus musculus
aaaatgccagaagcaaattgaaggatttttttacaagggtttcagattcatataaatttgcacttaagaataatgtgttcaaaaaatatatataacattccatgaaaacaattcaataggatattaaatctgtacaatcttttt

SEQ ID NO: 5529 - DNA, 358 bp, mus musculus
tggcaggtgattttcatattactaagaaggcagctatggatttaacagagcaagggaagttcactaaattaactagaaactgagtgaaggcagataccaaatgagtcctgggaatatgagacaacttcaaagacaattttcactgattgacatttcaccatttacagtgatgaaggaataaatgaccatgagagaatttatgtttttactctattgaaaaatattaatcataaacataatttttaaaacaatgtataaaataaatataaaaccaatattaaaaaacaaatataaaatttatgagtaaatagaaattctccataccattgcctgttgtatgaaaatgtcaacaaaattc

SEQ ID NO: 5530 - DNA, 423 bp, mus musculus
tgtttttattttctcccctgctatttgctgatctgtcaggtcagagaattcaaaaatcttgttatttcttcctaaagaagtcacaagctgatctatcatttctcctgttgaaaatatgaggattgcttttgagatgtaatggctctcagatttatttattattacatttaattttgtatttttggcacatcaaattccaagctaatgttttatgctgcttcacccacaacttactatgcaattgatgcctttagtatatcatttctctcatctgctaagtgtatctcagaatgtcatatgacttttctctagatctctgacatcatgactatagtttatgtgatgcatgaaatgtatccatttttgactagttcatctttggaatgtaaactgtgctgctaggcagcaaaatcagagggaaaa

SEQ ID NO: 5531 - DNA, 1112 bp, mus musculus
acctgcccttgtccatggggaacatgttcagccattcttgagccctctgtatcttcctgcatctcacagccctttgctggtatttgcctacttggaagagctcaaggtcattggcaagccagaagatttcaatgtacactcattcttctctcaacagatcaagccacaaaatatttcttggatgctagtcactgtaatgaatccagaaatatcaaccatgctctgcctttcaggagcccactaagtcactggagatgtcacaattcaaggtgatatatgatccatgactctatggcgatggggatgatttccacatgtgacttgtgaaagcaaaagggcttgatagtcacatctcaaatcattaagggccagttaacttggtccccccaggagcatcaattccccagcaggagccccacagttcacatttttccatccagataaagacttgtttatccttactctttattccttatctctaagccagttccctatttgtttccaacattctctccattcccatggtgactcaactcctttaacatgctttggtgtggcacctgtcagaggacgcttgaaagtgtaaggagattgtgtctcctgtttcccccttatccgcacacttattctgacccttcacaaagctctagtagattagggaagcatgatttctccttaccaaagacaggctgcctttccacaggaggtggagttttctcaagcacccgtaatcctgccctgagaggttctgtcagcttgcctggcatggaaactaaactctcgcaccatttcccagagacccctctggtgccttcggttcttcagcacgagggtcagtctcaagaaaaggctctcattttgtcctatgcttccatgatgtcaatcttcttatttattggcagcaggctggactggggggtggcagggggtgcagagaggggatacaaaacaaaaacaaaacatacagtgtgccttactttccattgcttggagatttcaggcactgtaattcatctgaacttgtgcagaagataatagtaaggttatctgtatcacatttcattttatgacatatcaccttgtttacaccgctctttgggttgtatatggga

SEQ ID NO: 5532 - DNA, 378 bp, mus musculus
actggcaaagagctgatgcagtctggaataaaatccaagaagaaaatgttattcctcgtgaaaagacattaagattattagcagaaatccttagagagggtaaccaggaagttccgtttgacgtacctgaggtaattgtttttggcataatcgtaacagattttgttgtcagtataattaggttatagattagcctacttttatattgaaaagattaccagtttttatttaacagaataactttgttttaaagttgtggtatgaagatgaaaaacattccctgaattcttcgtcagcctcaaccacagaacctgatttccagaaagatatattgattgcctgccgattgaaccaaaaaaaaggcaagcacatacgggg

SEQ ID NO: 5533 - DNA, 144 bp, mus musculus
atgcaaaatggtttatcgttcaaactgtccactctgatccaaccctgtactgatagtacttcccagtatgatattgtgatgtttcatacaatgcagtgaacataaccaacttgttacctaaataaagaattgataaaaacagtg

SEQ ID NO: 5534 - DNA, 441 bp, mus musculus
acttggacgagagtgcattttgtggttagaggcgaaacaagcaaaaggaagcttttttaaatgaaaagatttgctttagtaaaaaaagaaaggcagaatgagcacaatcacagtagaaggcagacctggggataattagatgaggcctgtgctttatggaaatggagttcaaatagaatgttaaatctgtcaaattgattcaataaaggaaattcatgttgcgccagcattggggtgaagaggtaacagaactcatccaaaattccaaacattcatagaaccttttgaaattcctgcctatttgtaagagctagtatccgaaacaataagttagacatgcagtctgtagtgggcactctatatggggcaatatgctaattattttacataccttatttacaaacattattgcattaacactcacagaatctttataagaca

SEQ ID NO: 5535 - DNA, 441 bp, mus musculus; identical to SEQ ID NO: 5534

SEQ ID NO: 5536 - DNA, 175 bp, mus musculus
aaatcatacagagtccacatgggaaacagatcaaagtgaagcttgtctttttgaagcaggaaagatgtctgcagaaactagcatttcttagcattcctcagtatttatgtgagaggaggactagcgtctaccatcaaagattaagatcttccattattaagattaagactgcctt

SEQ ID NO: 5537 - DNA, 175 bp, mus musculus; identical to SEQ ID NO: 5536

SEQ ID NO: 5538 - DNA, 719 bp, mus musculus
agaagatagtaaattgtttgttgtataaatgaaaaaaaaaagaacagattgttctgaattgcatttctgcaaatttctgatcattgttcccattttagcaccattattttcttagtattgttttagttgaaaacagagaataagaaaaaggtttgcatgcaaacaaagttgacccttggacaacagaggtgtttaggtgcattgactccctacacagtcaaaaatctgtgtataaaatgtgactcccaaaaaacttaaatatgactatcctgctattgactggaagccttaccaataacaaactgtggattaacacgtattttgtatgtgtactatatactgtattcttacaataaagtaagctagagaaataaaaatgttaagaatatataaggaagagaaaatatacttgctctttattaagtggaagtgaatcatcctaaagtcttcatcctcatcatccttgagttgagtagaatgaagagaaggaggaagacaaggggttggtgttgctgtctcaggggtggtggtttatctgtgagtttttttttttcagattgccatgaatctccaaaaaagtttctaatatattcattgaaaagaatctgcatgtaagtgggccctctgaagttcaaatccaagttgttcaaggatcagctgcagttatctgtgattatgagcctcaggagcacgtcagaaggttagaaagtgtgaacagt

SEQ ID NO: 5539 - DNA, 1361 bp, mus musculus
ttttttaaaaaattgggtttgaaatcaattttcttataacttgtacctattttgacaataaattttcagagtagaaacaaatatttctaccctcagtcattaaatgtaacttttaaacatcaactcttcaagtatcttaaagcactggtttatccacactcaatctctctatacagcaacattccatttcttcaattacccacatgacaaaagttttgtttgtttgtttttgccttagtgatatgggagggggggcagagaggtgctgggtagagaaacgcgggtccctggctagggctccacccccacggatgtaggtgaggacatgcatttctgccttcataccaaaatgctgcattttccaagaccatcctggcctgccatgtccccatcctgagcttataaaaacccgatacccggccaggcacggtggctcatgcctgcaatcccagcactttgggaggccgaggcgggcggatcataagatcaggagatcgagaccatcctggctaacacggtgaaactccgtctctactaaaaatacaaaaattatccgggcgtggtggcgggcgcctgtagtcccagctactggggaggctgaggcaggagaagggggtgaacctgggaggcggagcttgcagtgagccgagatcgcgccactgaactccagcctgggctacagcacctccgtctcaaacaaacaaacaaacaaacaaaaaaccccgagaccctagcaaggcagagacataaagcagctggatgtcatgaagaacacatctgcagaagaagacacaagggtctggtcatccagagcacgccggcggaagagcacgctgacaggccgtagcaggccagcaggccatcgatctgcagaataacatggtgtttgcctggagcagtcagaggagagcccgggccaccgagcagcccgactccagggtaaaaccatctccgttctgattcgcccatgtgctgagggctacttctactcaataaaaccttgcattccttctccaagcccacttgtgattcgattcttcctgtacaccaaggcaagaaaccccgggatacagaaagccttctgtccttgagacaagatagatggtctaattgcgctgactaacacaagctgcctctaggcggcaaacttaaagagcaccctctaacacatgcctacggatgcttcaggagttgtaaacattcactggtatacattgctgtggggtcggtgccccacagcctgcccgtctatgtgctcccctagaggttggagcagcggggcaccgaagaagtgagtcacacccctatcacatgccgtgtgatggggatgagggaacctttcactattttcaatagtgctt

SEQ ID NO: 5540 - DNA, 475 bp, mus musculus
tgtgtgtatatatagtgtggaacatgttttgaattacatatatacactgtggaatggctaagtcaagctaattaatatatgcatgtatcttaaaattaataaagtacaccatacgataaggtataggcaatagctactacaagaattcagatgagaaaatgcagctattgtgggacttggcattcatgcaaggctctaaagagaaaggaagaggaaggaaaaatttggtgatcactgaagcatatgaaacacagagaattattgaaggaggagtgttgagtaagttatagtctgattggcaaaaaggattattgaaagggatttgaaggaaagtttaagctggaagaaaagccttgcagaaaaacagttaggtgatacctcttatcaggtaagccctgtacttatgcaagaccttcctgataagaaagagggaaatgattcatgcttctctacgtattttgctaatttataaact

SEQ ID NO: 5541 - DNA, 363 bp, mus musculus
tcaattttaatataaaatctaatttttattctatttatggattgatttttccttttttaaattactttaataaaagagagattttattatagggccttgcttttcttacttttttttcaattagtgtatttggagcattcattcatgtaagtacaaatatttctacttaaggaagcactgtagtttatttacccatcatttaaattttgagttattaccaatgcctcctaattccacacaatctgtggagaatatgcttgatgcatttcagtaatcttataggatgaatttcccataaataaactgaaaaatccaatgataaccacataaatattttaacaaatacaaattcttaactcaaat

SEQ ID NO: 5542 - DNA, 973 bp, mus musculus
tgctatttttaacaaaaatctgctaagtcatttaaaacaagtcttagtgaaccatttatttaatttttcctatagattccaagtcccagtggggtcagattccttggcgatcagaacatttttctactcagctttacttcttgatggaacattatttccagtttagtggtagcctttaaggacaaaaatggtcataatgaaggaaaatgccacaggagtatagaaaagagtcttacacaggggcatgaactcttactatatactccctgttcccagccctgattcacactgaatgttcccaatttatgcactatcaacctattgaactgtagcagcaagaaagagtattatgaaagtctggatgatagccagcagcaaattcatcatccagcagtcagggaaaaaaatctaggctagcctgatgaagaaaatataggtccacttgaatctgaagaagactcttcttgaatctgaagaagaaggaccaggtgtaaacagtatggtcaaatcaactcaaaaaatggagataccagcaacccagagtcccatctagttgcctgtgatatttctgaggaaaccttgacaaattatacattatttactccatttctggtgtgattttttgccaactcatataccaatgcatgtaagagacgttatttcctctatggtatgcctaatagtttataagtagccctctccaaaacacagagaatggggccaacaatattgctttcctaaggcagagctcagcaggaagcagcagctctcctaacttgatgctgctggtttttactcacagggaaacttgagcctctgactccgaagctggaaatagaaggttgtcaccaaaagtagacaggtggattgcccaaggttattaaatatgtctataaatgacagtaattattcctattatttatccctacctgaatgaaaggacttcttaattagtgcctgagaaagtaaatga

SEQ ID NO: 5543 - DNA, 245 bp, mus musculus
ctatccatcacctcaagtcccatccaccacacatgcctttggtgaggccagttgcagccagctttgctatttttgtatagtcagtttcctctggactcataaagactacaacagataaacttttagtttttacaccgtatttaagtcttactgggaaaagaagtcaaggaagctgttttcagtttgtctcttccatttctcatgagttagcattaatgtccataacatatataaatttttagcca

SEQ ID NO: 5544 - DNA, 535 bp, mus musculus
ctactgctattaggtttataaagaaataggaaactgtaataaaaaagcactgcatgtgagacgagatcacaccactgcatgctagcctgggtgaaagagtgagactctgtcaaaaaaaaaaaaaatcactgcataaataggttggtggatttggtgtaaacatactgttctgtagaattctgtaaacatctgttagcttcaggaaagctagtatctagaagtgacaaattatcaaccaaagagtagttatattcccactttcccagtatctccatttactagtattcagatcaaagcggtgaaacagatgttatattctggattcatagacattatttagtcagggaaacttaaaagtttctcagaaaatattggaggtttattcttttttatagccaggtatcagaatatgcaattaatgttcacaaaatctagaagtaagttgatcaacaactttgtcaaatacagaaagtacctgaatatctacaaagaaaggcacaattgttttttattttctgaacattttgaaaccaag

SEQ ID NO: 5545 - DNA, 1007 bp, mus musculus
aattaaaagtaagacatgttctagcaccctttttttgttccccttttcttggtagtttttggaagagataaaccatagttagtttttcctcaattacagcttttaattattttcttttcaaattagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcaga

SEQ ID NO: 5546 - DNA, 185 bp, mus musculus
ggcagagcagtgattccacagagggcctgggcagcagtgacagctgcagggacaaatctccaccttctagtagctgtgaggacagcaaatatccagggagacaggaagaggagaaagatgggagtggacttcagaatgagcccatgttgggatgcctgagtttctgagaagatatcatgtgagac

SEQ ID NO: 5547 - DNA, 302 bp, mus musculus
tcaaaatgaagctttaattagaatatatattagaaccaaacttataaagcagagtaggacctggagtggagcctggactcattacttacagtctaaatggcagcattatcatacatccttcaggaagaacttagtctttataatagaaacaaagcaatacctgagcttctgaacaagatttctctacacaaagaaatatgtgtgaaacaataaaaacctggaaagcaatctagagtgtggttgaataagctatagaaattgctatgaactaaaataagtgaggagcaaaatatggattgagt

SEQ ID NO: 5548 - DNA, 375 bp, mus musculus
cttcagccatcttgccgtgtgccttcttctagggctccagaacttttttatccaagtcttagcctactcacgattgaagagtaaataggagttgaaacttgtctgttacaaattcagcttatactggtctcctggaagctggaggctcctttgggaacataagtgggtagaatgcatatatttcactttgtgccttttattttcggagtttaaaaaaaaatcccttactttttatactgcctcatactagcctctctaagataacttaaaccattttctttacccttttattgaagccaatggggcattgcaaattatcattgtactactgagtcagtaatagccatagagttttttaaaagcattattaaagga

SEQ ID NO: 5549 - DNA, 68 bp, mus musculus
gataccaaaattccttttgataattttttaagtttccagctcttcaccgaaatgttgtattcttattt

SEQ ID NO: 5550 - DNA, 68 bp, mus musculus
aaataagaatacaacatttcggtgaagagctggaaacttaaaaaattatcaaaaggaattttggtatc

SEQ ID NO: 5551 - DNA, 68 bp, mus musculus; identical to SEQ ID NO: 5549

SEQ ID NO: 5552 - DNA, 1140 bp, mus musculus
actgagacctgtataaaataatgttcttagatatgtgaggagttgtattcccctcaggaccttggtttctctatcaaaggagtcaggtggtggctaagtctccttctacttgtaaagctccatactctagttttgtttatgctttagctctttagtgtttacactggttcgtctcaaggtttaacatacttatgaattactagaatcttgttaaaatgtagattatgatgcagttggtctagggtgggttctgggctcctggttttctaacatctcccaggtgatgctgaagcagctgctctgtgaaccacatttttactagcaaagatctaaatgatgtacagaggtaaggggggaaagactagttctttgtcttcctgtggtaatacattcacctgcttctgtctcagggctaggattcttgactttcttctgcagaacactgaaacatgcctcctctttcctggccccaccaagcagagtttaggcttcaagaagactgaatgcatctgtacagagcacaatcccttctccaagaaggaaaccatggggcttatcaagaaaggtctgtacttttactgtcaggcatcctcagccctgctgaaatatgaaataaatgaggtggagtttaattttagggtctacaaatctgtaatgtgttcatcattcctgatgccattttacatggcaggctggtgttgtcagacatgttttgtgaggagagctgcatttgagttctggtttaatgaagccttcgcatacaccctcccaggtccctcctctaatctccacttaccggagaaagagatgccacttgtatgaggggttttcactattggaaatgcacatctcttttgctttcctaggggcaggctctttggggggattttcctaagctggactgcaggctggcttcccagcagagggcgcactgccccagtgccatggcccagagcagtttcctcctcttttgggtggacttccctccccactaggctggttagggctgagaaggaatccaggagaaatgagctttcagcaaaggaggacatgaagatgagattaagggagaaaatcaaatctaatcatttcagatctgaatcagtgacttttaaaatgaaaggtctacttggctaccgt

SEQ ID NO: 5553 - DNA, 494 bp, mus musculus
caatgttgtctgcatccgtaccttccactcacttccactagctagaagggtagaaaaggaggaaggcactaagtgagaaaaatggtcctatttgtacaaaaaagtctgtcctttgaccagcatggcctaaatctatccagaatttcatgatgtgaccacatcaattggaggcaataaagaacattaatgggaaggcccccttactgtgtggagcagtggtcttggaagcctcaggggagatagttgcagccacctggtagattgtctaaatatggtacagagcctgcagaaggaataggatgactgttctggatgccaacagtaacggtcccatgagtaagtgatgtctggggttacctccactccctcaggtgctgtagcctgaagccagcactgtgattggtcagaacatgggtggataagcatggatcacacatagttcaagctcaaggctggcagtggactataggtagtccagagtcctaaactccttc

SEQ ID NO: 5554 - DNA, 149 bp, mus musculus
atattaaaaggctcttatcttctgacttagcacagttctcagtattcattacggtgatatcttgctgagtggaaataatgttttatataggctttttgttgttgctattgttcaaggattgggagtcctattcaagcttcataggataa

SEQ ID NO: 5555 - DNA, 998 bp, mus musculus
gatgcagaaaactatgatactctggatctggattcctgggtctgaatcttggctctatcacttattaacagtgtgtgaccttaggcatgttatttaacctctcttaacctcaatttattttcactttaaaaaatgtggataacaaccttgactgtgttgtagggttgttttgaggattaaatcagttaatgtgcatgaaactggagggtagtgtcttgcatttagtgaacacctccaaaatcttagccattattaataatattatccagaatatataaaaattacttaaattggccaggcgcggtggcttacgcctgtaatcccagtactttgggaggccgaggtgggcggatcacgaggtcaggagatcgagaccatcatggctgacatggtgaaaccccatctctactaaaaatacaaaaaattagccgggcatggtggtgggcgcctgtagtcccagctacttgggaggctgaggcaggataatggtgtgaacccgggaggcggaggttgcattgagccgagattgggccactgcactccagcccgggtgacagagcaagactccgtctcaaaaaaaaaaaaaaaaattacttaaattaataagactaacagtccaatagaaaaggagtaataggtatgaattaataatagaggaatttgatatggctaataaacatataaaagatgcccaatgtccctggtaattacacaaatgcaaactaaaacaatggtaaagtgtaaatttatacccatgaggtgaaaaaatctagaagtgtgaccttgcaaaggtgtgggaccacgtgaactctcacacactattggtctgagtgtaaattttcaaaatgggtgccactaattaagagagtaatttggtgatgtctagtaaatctgaaaatacacataccttacaactcagagcttccattgctgagaatgtactatagagaatttcttgtaaatatacataaggatatgtgtaagaatacttactgaag

SEQ ID NO: 5556 - DNA, 990 bp, mus musculus
gatcctgatcaagactctagagacaggccactggtttccctccaagtttactcctcattcactgtctttctttctttctttttttttttttttggagatggagtctcactctgtcacccaggctggagtgcagtggcgtgatctcagctcactgcaacctctgcctcccaggttcaagcgattctcctgcctcagcctcctaagtagctgggactacaggtgcatgccaccacatgcagctaattttttgtattttaatagagatggggtttcaccatgttggccaggctggtctcaaacttctggcctcaattgatccacctgccttggcctcccaaagtgatgggattacaggtgtgagccacctcgcctggcatatactgctttctttagcttccatagcctcaaccgagagcaagagaataaggcttctgacattcttcctaggaagctttacggaacagattggaaaattcacaacaagccctaagtggcccatagtggattagtggggactgtggccgtcaggactcccccttagctgaggcttctgtgtcttctgtgtctgctttcttagggccctttagcctgtgagctcttaggaatgcaggaagaccctctctttccccctgggtggtaacaaaatttcccctggtccatcattcctgagccctagttcagtctgtgtgcggccaggtcagcgctcaatagggttccaaacctgttggctgcaagcacagactccctctgagtgtgaatgttatctctcaccagatgagggatgtgctcagcccagatcaaacacttgtttatctacagggtggtgagagccaaaactctgcttctgtttctccctggtggtttatttgcttacccttatcacctctgagcagtggtgttgtttgcatagagttctcggtttctggcatgttaaatttagaggtaccccaggcttctcggagggatcagagtgttgagcaactcctcagg

SEQ ID NO: 5557 - DNA, 1322 bp, mus musculus
ccaaatagaagctgaaagtgcaggttagaaaggaatagagatatgggaatcaattttaaaaaggattaaaatgaaatcttcaaatttttccttatttaattagtgataggagaaggaaaagacccagaaatgataataaagctgctaggtagaaaattaaaggaaaagaaggttttaagaaagagagagtagaccgggcaaagtggctcacgcctgtaatcccagcactttgggaggccaaggtgagtggatcacctgaggtcaggagttcaagatcagcctggccaaactggtgagaccctgtctttacgaaaaatacaaaaattagctgggtgttttagtacgtagctgtaatcccagctacttgggaggctgaggcaggagaattgcttgaacctgggggatggaggttgcagtgagccaagatcgaaccactattgcactccagcctgggcagcagagcaagactctgtctcaaaaaaaaaaaaaaaaagtgggtaatgtttacagtcatgtttgaccataggcagcctcagacttctgtgtctccacaattaccattaggaagttagaaatgtcacaagatattatttcctccgtagacctttaagataacagtgacatccagaaagttgccttactcttaaaggactgatcactgccattactttatatataatatttaagggtttcaggagaaacaaattaccatttctgtagttgtttaaggtatttacagtattactccccaaatggccacttttagtaatgattatatttactaacatcaactagaaactatgtttgatttttctactcttcttgtacataggaagaaaatgccaatcaaaaatgaaagtcagttaaaaccacttgaaagcaatgtctgttcctttttagaatggaaagttggaggaaacttcagcctctcctcttagataaaatgcatgccccaggttaagaattccaggtgtaagaatactttgtacctttttgccacatagttccataccacaagattcccttctcagtggacactgaggttgcatagggaatagatcaccttccttctcagaattcttttttgtaatgaggagaacgcagggatgcaagctagccccctactccagggtgtggttgagaaagggctcccaggcacctgagatgccaagagaagtgggtcattcccttcctgctaagcagcagaggtttttgccaaggatctaaattccatcttggaaactcatttctccatagaaaccatttcacaaagagttctataaacaatggccttcctgcaaaaagcctacttaaattacaat

SEQ ID NO: 5558 - DNA, 1285 bp, mus musculus
gtcccctgaagcggggccagctgagcttcccctgccctagacctaagaggttctctgtcccagggttgtggggtttgggagattggaggtcaaagttggaaactggctttccacccctctgctgggggctggagcctgccctttccatggaggggaggtggttgggacagtgagggcaggcaaggcctcccagctttcccaggccccagccctggttgcttcacttgctggaattgcacaccgcatcaggcctctgaccccctagagaaagtctgggggcaggggctgggagagcctggtctggagtctccagggtcccctcaggcctctgggcaggcctatcccgtcatctgccagcaggtccagaacatccatgggcagctgtgactctggccactagaatgcagcttcaaaagcagcttcaggttccggtcccagggtcaagcctggctgtgtgagccctgatcactcttcctgggaatctctgggagctagacaccatgtggacatagctggatctgcagagccaggggtacccacagggacagtgccaggcactgactacacaagcaggggaggcctgtgtgtgccaggcagaggagctgggcctagggagggggtcagagctgcctctcagggctgagctgggcaaataggttcttactgagggctgcccccgtctgggctgtcagatgccaccccagatatagtatctcttttctcctcctgtccacactacacacagcatagtagaattccagcttctctcactctggccctgctctctgccttctgtttatagccctcctctttcagatattcaacggctgcttccgcatcatttaggccaagatcacctcctcaggggggccctcccttatcacactagctaaacagcagcccccagcccattccccactttacctttcctcatagcacttatcactacaagacaatatagtcaatgttcatttattctctgtctctcccactggaatgtgaactccatgagggcagggactttggcctgactagtcccagaattcccagtgcaaacaaagtaggcatgcactaaatatgttcgatgaacatgagcaagcatgcacatgcaactgacacacgacaaacatgtgcacacgcagacacacaacacacatgcatgcacccccgcacgcacttgtgagcagaggcattcgcatgtctcacttggctcagctcctgagagcctgagggaagcattatcacccacactctcccactcaggcagcctgcagtcggactccgc

SEQ ID NO: 5559 - DNA, 649 bp, mus musculus
tctacaacaaccctatgaaatacaaagaaaaccaagaaacaatcacatcaaatgataaccagtaagagaacagtcactgccaatctcctaatacagggtcttgcccatggtccttaagaagagctagtagaaatgccttgcccatgttggaaaggtatccgattgctgcactggtgtgtagggggagcatctcacttaccagggactgacttcttccttgattcctttgtagtgatggaaacttccctggggatggatacttccctgggattgcaatctccaagccagacattttgtctgccacaaactccagaattctccaagtccttcagtagcagaaatacccagacacttgagagtaacccatcacctgagcttggggacatttcaataactccagtccagagtcctactaatctcttgacactgtctccagctccaagccaggaaaaaaatgagaatgagaatttggatgagattaaaaccaacctttcaaagcctctagatgtccaccagatcctaataggaaatcaagatcctccactacttcctgtagaaatccccgatattcacccgcttctggcctgcattgatcctcttggccaagaggagcagcctggttctgaaaatgccaatctaagaaataaga

SEQ ID NO: 5560 - DNA, 1416 bp, mus musculus
ggaggcctccttatgttgaggaccctggtttcccaggccttggggtgggatcaggtggtaaatacatgaatatattacttcccatattcgctttgatcaggaacagggagcagagccagtgtgagtaaagaaaacagcaaagaaaaatttgcagcttgcagcttgcagcttgcatctctggttgtcaggctgctgtgcctgctgtgaatgaaagggacgttgccctcctccctcagcctccctgcagcctttccttgctctgcagcccaggacatcaccagcatataatcaatagcagcccacaggccacacgggtggtcctccaggcccttgagcatttagtggcagtaatcaatgcagtgttccccctaatgatgagagacatctgcccttgattgccctaggttacaatggctgtgtcatcctgtcctgccacttgggccccgagaaactactacttcaaagatagtataatactgtgcttgctgtgtttactctttaggtttactttcccttaactctagagtgaatcctctttgctgtttgccatcttttctcagatgccttggtgttgagacaacacagaaggacatggtaaactgaaaaactggaccactgtacagctgatgttatcctggacaacgtgtaatctttcctactgctccccattccatcttagcccctttttcacctctttccacatctctttgtttctctaaaattctgggtgcaatacgtcagctaattgcctttacatcttatttgtaaaatgggattccaatattaaagaggaaacagtgtggtcgagggtaaagtacacacatttaggaaacatcaaacgccagcttcagacctggccctgccatctggtaactgaagacttggtaaagttattgaacctctctgaacctctgttcccttatttgtaaacttggaaacaagtcattacaatgccgagtcatctttcagtgacaatgcatgcatggtgcttaatatcattgctattatcaccaccagctgatttttattattattattatttttttggtgaaaattagatgagatgtgaaagtactttgaatacattgctaaataagttgtaaaatatttgcctacttttggccaggtgtggaggctcatgcctgtaatctcagcactttgggaggccgaggcaggcagaggacttgaggtcaggagttcaagaccagcctggccaacatggtgaaaccccatctctacaaaaaatacaaaagttagatgggtgtggtgctgcgcacctgtaatctcagctactcaggaggctgaggcaaaagaatcacttgaactcgggagttgaaggttacagtgagccaagatcgtgccattgcactccagcctgggtgatggagtgagactctgtttcaaaaaaaaaattgc

SEQ ID NO: 5561 - DNA, 1072 bp, mus musculus
accacccagacaatcctaatcacctcacagaaccatgagaagtaataacaaactgttttatgccactaaccttgggatagttttctgtgtaccaataggaaatcagaagagtagataatggagaaatcatcagtaaagtttgaaggggagagtaatgataaattcatattcataactgatcattttgaataggtagggacatagagtcaggtaatagaagataaacacccatgtcttctgctcccaccatacattcaagtttatctggaatttgaggactgctggacaaaattgagtgaagttcattctcctgtgtacaattggtattatggagattcaaaacgatctaccaagaggaagagagaaagggccaagcccttgacgattaaagtaccagtttccaattctgatggccagctattaagatagcctccaggcacacctccggcattcatggttgggcaaaatcatctgaaaacacagtacactgtggagtatcagctgtttactttcaagatggtattgccaccagggcagtgcttgctgcctatgctgaggcaacatgagagagtaccgtactgcatactgctagcccagtaaaagaccagtattcaaaatctgatataagccttctagggaatgcatatcactttcccaccatgatacggtagaaaaattataagtagaactatcataaatcacagaccatctgtgtagggaaaagtaacctcttcaggatattgaatctgtctctctaaaacatgatatatttcttcgtatattaaagtcttctttaaagtttaaaaagttttacatggtcttgactatttttgtcggatatatttctagatcctttatatttttcttcctattaaaaacagtatctttcttaaaaataccctttctaactctattgttggaatacaaatgttcatttgggatttatatgttgatctcacattcttcttgtttactaaatttatccattaattctaacaactaatttgaagagtcttctgggttttctatggagacagcatgtcatatgcaaatagtgacaacttaatttact

SEQ ID NO: 5562 - DNA, 1460 bp, mus musculus
atttgtccaaatttcctttaaatgtttaactttctttctcactaccgagctgacctctttcctatcccttctggcctctgtgagctccgccctctttcccagttcatcatgagctgggaaattcttacatcaatgctgacagaggaaacaatgcacctacttcataagagaggattaatttctttcttttgctccaagttttcaaccttagagtgtttatatttttcatatactttgacctatggaatattattaatagatttcctgatattaaatattcctttactctgtaattaaaattgctaatttatttatttatttaaaatatgacttaatttcttatgccagcatatcatttggaatttttgaaattatattcataaactagattagcatataatttctgattcctggattcattcattcacttactaatttatgtatcattgaacaaatatgaatcgtgcctggctttatggaatttatagtccagtaatagatacatataagtatccttgaagaagtgacatccaaactgacctctgtgttaattagaatggggcactgtaacacagagatctgattatcttaactgactcaaatgagagatagaagtttcttttactcctacacggcagtctgaagtgaagcatataggcctagtggggtagtcacaccaacctcaacatgcgacccccaaggttagctccattcctctgcctttccaggccagccatcaagaatatgtacacggagtctaggacaagtgtccttacggagatagcctgaaagttgtacacaagtcttctgctcacatcctatatccacacttagttgcaagggaggctggcaaatatactctgtattgggcagccgggtaattggtgaaactgagggtaccacaaagaagaaaggaagactggataaaggagagcaattagcattcgctgcccaatatctaaaagagtaaataggaactaatcaggggaagggtatagggagtaagaaagactgttctatccaccttgcagttccaaagaggatactgagaagcaaatgggcagttttgtaatgcagtgttggaaatacaatgaaaaggtatgtgcagcgtactgaccactgaggggcacatgtgaggggcacctaacccaagcttggaaggcaagatgagaggagctttcctatctaggctgaagtctgaagagtgaagtcaatcacccaataattgttggaggacaaagaagcatgaaatttgaaggccctgacataaggctgagcatagagtgattaagaaacgtaaaaaaattagtttggctggtagacccattgcagggaaagtcatgacaagaaatgaggctctgagaggttagctagaggaagatcatgctttactgaaagctaaggagattggactttattctaaaggcaagaaggatttgttcaagggttcaactcaggag

SEQ ID NO: 5563 - DNA, 713 bp, mus musculus
aattagccaattatggtaaaacaaaaaataatttgacaataaagtttatatatgcacgaatgacctctactcttttataaatcagtcacagtgattccaaagtccatgtgaggaattaaatgtttctcactttaagcttcaggtgtgatgtgactccaggagcattctaagtcaagctgaaatgcttctatttaaggattgctagtcaagtatccctttctttattcgggcacatattaatgtgtgattctcattgaggagagctctctgctttgatccataaatcaggaaactgtaagaaattcgcattgccagaaactttccaacttgaagtcagaactttcgtatcattaaattgatccactgatacttgttttgattaaagcaccagctaacttgtaacagcatctgcactcagtgatatgactcaaacaagcataatgaatgcctatcttttaattttttatgaaaaggcttcataatatataattaagatgttttttacatgttctactgatgagccatctgcaggtatgacatttagcatctgtacttaaaagtagccacctgttacggtctggttatcctgactgtgaatcatttcggataaatggaagttggtatcatttagattcagagttcctcatgaatccctcatctttttgacatttattattttattacaggctatctttcagggattttttaaagtt

SEQ ID NO: 5564 - DNA, 789 bp, mus musculus
ggagaccaatcactgtcagcttccatcattgtaacaatgaagtagtatttcaaaatgaaagtaatataaagatattttttgacaaaaattgacaggacatgtcacctgcagatactttctagagaaaattttaaatgttgtgttgatggaagatttgcatttcaaaaaaagaagtaaatgtacacaatctgttaaatatttaggtaaccaaatagattacttgcagaaaataataatggattgtagagtttaaattttaaaagaaaataattaatatatatagcaattagtatgtaatttttgatgtggaagaatggaattaaagtgttttacaatctttgcaatttggaagacaaagtaaaatgtattgattacacttgcagattgataaatcaagtgtgtattttgtaatggctagggctcataatacacaatagaagaacttaatatttactaaataaaaattaatatagaatatggaggagaagatcaagcagattaaatttggatttttgagagactaataaaattaaaatgtctctggcaagactcaaaacagatggaggatagggaagaggaagtgtctgccctcacacatcagaagtgagaaagtttctagttatataaactaaagatattaaagaacagctccaaaattttagagacaactcaagtcaaaaattgggctttgaaaatgatgtgagaaaaacattaaaaaatcttaattgcttgataattaatatagactctgaatagtcaaaatcttctaagaaaacttcaaacttagat

SEQ ID NO: 5565 - DNA, 1081 bp, mus musculus
acgttagtacattccttattttaaaaatgatagacttcatgtgctgtatttctcaaatgaaggcgaagaacacctacgttgttctcaatgttttatttcaatacttaaggtatccaggacataataagtctttcttctaaaattaagtaaactgagaaggttcttcattctaattctacttctctgactcatttgttcaagaatagaactcttgggacagccaaacctgattctctttttatttcctccaaaggcacttctctaaccaactgtattccaccttaagggaatcattgcttatccagagtcctcgtatgacctgttgacagtggtttaaatatatccattcaatgaagcatgaccacataaagtattggtcaaactttgatacaaaaactgaaaattttgttaaacagccagattaggagtcagtaagtctgtagggcctgagattccatttttctaataagctgtctcatgatgcagaaactgttagtcatggaccactatttgagtggagtgggagtcaagagtactcacccatggtctggcctacttctgtatgaactaggtgaaagttcttgcattatgtggcaggtcatagctgtgtttttttgtgttttttgttttttgagacagagtcttgctctgtcacccaagcctgagtgcagtggcatcatctcggctcactgcaacttctgcctcccaggttcaagtgattctcgtgcctccgccacccaagtagctgggattacaggcatgtaccaccatgcttggcttatttttgtatttttagtagagatgggggtttctttatgttggtcaggctggtctcaaatgcctgacctcaggtgatccactctcagcctcccaaagtgctgggattacaggtgtgagtgaccacgccccatcaggtcatttttgaacagctattatatggttctggcatctatcagaaaaaataaatatatataataaggcacagcctctgcctttaagaacaaaccataatctagttagaaagcatagctctaaacataaacttggtgccatataactgactaggctgatgataatgaca

SEQ ID NO: 5566 - DNA, 617 bp, mus musculus
gcagtgtctcctcaggaggtttctgtccacaaaataattttacgtttatttttgcaatatttagataaatctttgcacaaagtatctccagattgatgctgatatactaagatccataaatattcaccagttctaacccaagtatccttttccggatacatgcgaaatcattggatgatgtctgttttgccacctccatgtttcatcaatatcttactatctccacaatgaccagaagagaaatgcaattaccctgtcagccatggcttgatttctgatttccacagagctcaagttttactaaagaagacttcattattttgttaggcataatagcacagaaggagttccagcttcctcctggagctgcaaactgcagcaagttggagtgaatttatttctgaggtttgacaattcttcaatgttaatatattttcagtctaattttgttatacattagcacatgctcagaatgtcaaccacccccttattgcagatcacagatttaggttaagtttgtattgccaagtgtttgctaaagagtaagtgccttatgccttgccaaatttatcgatttgagttttgtttgatttagctcaacattagagaaagtgagt

SEQ ID NO: 5567 - DNA, 792 bp, mus musculus
tccaaggattctaaaaagtttatctgttgtaaaaacattctccaaaataattagaataattattctattagatttttctattaggacaatatagcatgatctttcctaaaatgtgttttctttgtttctgccttgaatctgattcagcctttgaaatcaggtcaagaattccgatgttcaagatctggtcatttattttgttttcaaactcgaatatatgcaaaaccctacccataacactgaagggctattaccaattcccctaaccaccaaatagtcttaatcctccattttgaggaagcatcagttctatcccagctctgctgcccataaaaagatagcagcgcgaatcagattctctcttccccacagaaccaggtttcttttttttttttttttttttttttttttgagacggagtctcactctgtcgcccaggctggagtgcagtggcgcgacttcggctcaccgcaagctccgcctcccgggttcacgccattctccagcctcagcctccagagtagctcggactacaggcgcccgctgccacacccggccaattttttgtatttttagtagagacggggtttcaccttgttagccaggatggtctcgatctcctgacctcgtgatccgcccgcctcagccccccaaagtgctgggattacagtcgtgagccaccgcgcccggcccagaaccagatttctgagacagaatgatcagggtcagagatgacatttaggatgacaagtttaagggtaagaatgttgcctatcctgggttgaaactgtt

SEQ ID NO: 5568 - DNA, 609 bp, mus musculus
actagttcccagagagttgctcgtacagtttgggcacatagtcgtcccactcagcctggtaacacgtgccagccaccggggccccgagctcgtactttttacggaaggacaccacctcaaatttgccacggtggtctccagatcggttgctgaggatgggctcgtcacactttagtggcctgtcctgctcataaaccagccagacatagcggtggagacctgtgcccttgggaggccccgagcccacataatcggagaggagtgtgtcactgctgatgtcattgcccttcatgttgaccaccaggaaatgatgccattctctgtatttgggatccttcctgctgggagcatcagggtctgtcaggaccaaggtgtagagcttccctgaatcaagaccatcccactaaatgctggtgggtctattcttaacctgggtgggcgtcagcactttgcccagctcgtccaccaccgcccgggcgtaggtgacatgcagcaggtgctgtgaccgctcgtccatttctcgcaggctcaagggcccggaccacttgctgaggtccaccggcatggcaaggccaagcagagcatgcagccgggagtgccgcggtaggc

SEQ ID NO: 5569 - DNA, 2495 bp, mus musculus
tgaacaaatttatttccacttggcagtgaatttttttttttgagatggagtctcactctgtcacccaggctggagtacaatggcatggtctcagctcactgcaacctccacttccagggttcaagcgattctcccgcttcagcctcccaagtagctgggactataggcacgcaccaccacgcccggctaatttttgtatttttagcagagatggggtttcactatgttggccaggctgatctcgaactcctgacctcttgatccaccctactcggcctcccaaagtgctggggattacaggcatgagccactgcgcccggccttttttttttttttttttttaagagacagtcttgctcttttgaccaggctggagtgcagtggcgggacttgtagctcactgcagccttgaacttctggactcaagggatcctcttgcctcagcttcaagtagctatgattacaggcatgagccactgtgcccagctgcagtgaatcttgagagtagccaggagtgtccagtggatagtgtggttaggttcttcattcttctctgaccaatctgccctgctaagagtcccaggagattctagctgaatagaaagtcggtcttatttggtaaattaaactgtatggcttagggaaataccaggaggctgggaaagacactagcttttattaaacacctgtcacctatcttcattctttcgtgtcccacattagggtattctgatgatatttttgttttgttttgttttgttttgtttgtttttttgagaccgagtcttgcttcattgcccaggctggagtgcagtggtgtgatctctgctcactgcaacctctgcctcctgggttcaagggattctcctgcctcagcctcccaagtagctgggattacaggtgcccgccaacatgcccagctaatttttgtatttttagtagagagggggtttcaccatgttggccaggtgaactcctgacctcaagtgatccacccgcttcggcctcccaaagtgttgggattacgggtgtgagccactgcgcccggcctctgatgaactattttgactgtttttttctctccaaacccaatttgttactgtcttatgagtaaagcggacagtgtaactttgtacctgaatctcatatggtatcctctagcatctgtattagtttattcagcattcactcatggtgctaggttttagagcagcagggataagaaacacgatttttctctttgaagaactcccagtctggtggggaaatagttatgtagaaaggttgagtgtgctggcagaagcctgtggtctgagctacttgggaggctgaggcaggagtattgcttgagcccaggagttcaaggctacagtgagctatgattacaccactgcactccagctggggaacggaggaagaccctgtctttaaaaatcaataagcaaatttcaactatctttttttttttttttttgagacagagtcttgctctgttgcccaggctggagtgcaatggtgtgatctcggctcgctgcaacctccgcctcctgggttcaggtgattcttctgactcagcctcccaagtagctgggcctacaggtgcgtgccaccatgcccagctaatttttttgtatttttagtagagacagggtttcatcgtgttagccaggcaggtctcgagctcctgaccttgtgatctgctcacctcagcctcccaaagtgctgggattacaggcgtgagccaccacgcccggctcaactatcttttttaagaaaaggtaattacaggtgttaagtgctgtgctatgggaggggagcatggagtaaggaccccctcagctgaacatgtgggaggtagatcagagatcagagtggaggaagagaccctgagttttaggtagaggtggaggcaggttgggatggggagtaggcattctaggtagagaggacatggtgggcagaagagaaaagtgcctggcatagtcagagactgcaagtagctggacccttggactcctggggtcagtggagagccaaggtgtagatcctgagggagggaccagatggcctgctttataagctaccataaggagcttggattatatcctgaaaaaagctggagtcattgaaggcttttatttttttttgagatagagtctcactctgttgcccaagctggagtgcagtggtgtgatctcggctcactgcaacctctgtctccccagttcaagctattctgccgcctcagcctcccgagtagctgggactacaggcacccaccaccatacctggctaattttttggtatttttagtagagacggagtttcaccacgttggtcaggctggtatcgaactcctcacctcaggtgatccacccgcctcggcctcccaaagtgctgggattacaggtgtgaaccaccatgcccggcctcattgaaggcttttaacaaagatgtgacatcagacttatgaatttgtttttaaaacattattc

SEQ ID NO: 5570 - DNA, 2495 bp, mus musculus; identical to SEQ ID NO: 5569

SEQ ID NO: 5571 - DNA, 2495 bp, mus musculus; identical to SEQ ID NO: 5569

SEQ ID NO: 5572 - DNA, 802 bp, mus musculus
gcctccaggaagaaacacttatttacggacaaatctgtgatgccctggtccgacctgggacactggggacattgctcctatgctgagttactgagaagagccagccctgcagctgtgcccagcctgccctatcccctgctgatttgcatgttcgcagagcacagccccctgccctgaagacttattaataggctggtcgcaccctgtgcaggagtcagtcccaaccaggacacagcatggacatgagggtccctgctcagctcctggggctcctgctgctctggctctcaggtaaggaaggataacactatgaattttctcagccagtgggctcagtacagcctggctcttgatggaagccttcctataatatgactaatagtatgaatatttgtgtttatgtttctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcccacagtgtaacaagtcataacataaatcacccaggggagcagatgcgtgaggctcagctgtcccagatgccccttctggtgccttcgcc

SEQ ID NO: 5573 - DNA, 1162 bp, mus musculus
tgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattacagcctagccgtctttcctgggccgagaggagcccatgcttcagtcaccagggactgtctgatagggcccacgcctgttagccatgccggccgacagcaagataggccgagtgcagagtgggcgggatgcggggtcctggcactaggcttttgtgcttaaggcacctctgctcactgacgacaaggtcaaagagcagtggttctccacctcagctgcttatcagaatcaccaggaaggtttaaaaagtcctgatgtccagaccctaagtcagaagccctgaggggaggatccaggtattctcatgcagaggccatgcttgtctatgtgggaaatcctaggaatctacagaaagcagacaactagggagtccagcaaaatctcgggtgcaagataaacacacaaaaacctgtttctacctcctagaaatgaacatgtagacacaaaagttaaaaatatgtactgtttacaattgctgaa

SEQ ID NO: 5574 - DNA, 602 bp, mus musculus
ttcttcccttagaagaactcttgaaggcagaaattgggtcttacttgctttcatcttcctagatcccagcacagaatttgcctcagaatgggtgctcagaaaatgttggttgatgttaaattgcacttcacaatcacattaactaggtatggaaaattaaaaaaaaaaaacagagagagagagacatgcatgaaaaggggggggaaggataattcaatgacatgagctaataaaagtaaggatgtactaggaatattgaaggccaatagttttattttgaagctttagaattaagaaacttaaccagaattttctataatataaagaatctatttaggttattattttgttggggacaatgtcatactgatgacacagaatgaggacgtgaggctgtggactccggtcatgaaatcctcatgtgttcatgtgatggaggaagaaatcttatctcttgatagtgtggtggcactgtgataatgctgtgacgtgacattgtacccaaggactctcctggccatatacttcagtaaggccaaggacagtccggtactatcttgcatcatttgccagctctgtaagtttcttgtgattcttttaga

SEQ ID NO: 5575 - DNA, 331 bp, mus musculus
atcattgccagagaaagaatgacttgcacttttaaggacaaaaacaatttgagtgaatcaatgtattgcataacaattgtattctactttcacatttttccataatatcatgcaaatagagatggatggtaagtactagtgtatctgttgggtctgaagaggagagaaaaccaaagtccacatcctctgatattacttgttaaggagacttttgtattttcaaaaaaagattggaaaattatcttgtattggatggcatctaatgacattgtcttcaatctcttcattcctagacatggagttgcaaatgttcttgagtgggatgggaaaa

SEQ ID NO: 5576 - DNA, 783 bp, mus musculus
aactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctgtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaacatacatactacatacttaaatcaggaattctagccatctcacagaataccaactaaaactaagtgcattgagatctgagattggtaaacccagattcatttaccacagctgtaattaagtttttagaaactattctc

SEQ ID NO: 5577 - DNA, 783 bp, mus musculus; identical to SEQ ID NO: 5576

SEQ ID NO: 5578 - DNA, 783 bp, mus musculus; identical to SEQ ID NO: 5576

SEQ ID NO: 5579 - DNA, 783 bp, mus musculus; identical to SEQ ID NO: 5576

SEQ ID NO: 5580 - DNA, 783 bp, mus musculus; identical to SEQ ID NO: 5576

SEQ ID NO: 5581 - DNA, 783 bp, mus musculus; identical to SEQ ID NO: 5576

SEQ ID NO: 5582 - DNA, 1095 bp, mus musculus
ggcccaggttcagtccactcctggagctttgaggggctagtgtgtaaagggcacagaagcccttttgctaggtgcactggcctgagagcttcgaggggatttgccaatgggattgtgccacaatttttattactttttccctagtcttcgtggtctaagttttgttttctcaatctttcttttctcatcttccttgtgtggagttaacttttaatcagggaaagggaatacatcgagctattgatgaatgaatcactggagaaaacagtgaagtgggatttttatttcagggtctcttaggtggcagtgccgggtgacaggtgggggtgtcccttgtcttccattgtcccggagactaaccatcagcctctacctaattgaatggcatttttatgtgtttttcatgaacggtggtggatggagatgtgtggaggactagcagctcttcatgctggagggagttattccgcctctgctctcagacagcctgtgaccaggcacgggtcacattgctgccctggacttgcactgtatggcatttgaatgtcatgtaggggcaccgtgtatttcagtggctgtgtctaggcagcccgaaagccactgaatccctcatgtccactctgcagccgacattcactcagcatcctggaaaagtgcccactggggcaggagcttctcttgctcatgtggacatgacggtaagtccttcttggagaggcagcatcaagtcatgttgttcgttctgtggccaggaggtacaaagtcagctgtttctgcttttaagtgatgtgggcttaaggaagagggaaggaggaatgaaggaaagaaaggaattgaggagggaatgaaagaaggagagggagggagggagaggaagggaaggagggagaggaagggaaggagggaaggaagggaggaagggacggagggagggaggaagaagccccatggctttcttgtaaatagcagctgccctgaagtctgtgaagggcacaccaagagtctggctgggaggttgtcagctaggaaactgtggcccaagttcgtggtgagtgaggagttactttcttcccttgaccactggagcaggataga

SEQ ID NO: 5583 - DNA, 669 bp, mus musculus
agtactggtatttttattggttgttttttgcattagttaaaaagcacttcacatttcaatggttttttagccttatagtgaagaagaagaaggccaagagtcaagtgaagagggcagtgaagaagatgtagaggcggtggatgaaacagcagatggagcagaagttaagcaaaggtacaaaagtgggaaaggatatcaaagtaggtttaggaaacattttatttgtttatttttattattataactaattcaatactttcttgaaatggagacaacttgtacctggagagcttttcatactattgtctgcttaaagatcattactgttttagttttgtaattatttttaatacatttagctctacctcgttttcatctggaaactgttagattttcaaaacttactgatgattatcaactgtgattaaagaagttccctaattgagtgaataggcataacctgacctgactcactttgctattttgtctccccagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcag

SEQ ID NO: 5584 - DNA, 833 bp, mus musculus
gattttctttcatagccaacattgaagccgcgtctgactcctaattcagagttagaaagccacaagacctccaagttctctcctctcctctcctggacacattatagatttttcagtatcctcaactgaatgcaagactgtgttccggctagtgcagtatgcaggagactatgacccaggggaggcatgtcacataatcattaagaatagagagacttggcttctaacttggctagatttcttagtagctgtatgactttgggtacattctgtcatccctcagagccgctgttttcttacatgagaaataaaattaatggcccctaaagagttgtgtgtgggacgggtgcagtggctcacgcctgtaatcctagtactttgggaggccgaggcgggtggactgcctgagctcaggagtttgagaccagcctgggcaacacagtgaaaccccttctctactgaaatataaaatacaaaaaactagcccagtgtggcagtgggtgcctgtagttccagctactcgggaggctgaggcaggagaatcacttgaacctgagaggcggaagtttccatgagccgagatcgtgccactgcactccagcttggcgacagagcgagagcgagactccatctccaaaaaaaaagtaaatgtagcgtgaagattaaaaggttactcaggtaaagctcttacaactttagcagaaacagaataagctctcaatatttgtaccatataaatgtgacatggtgggtgtgtaaaactcctgcaaggagtactgtgattggcctaacatcagatgcaaacacagcaatggcttcatgcagtttagtgg

SEQ ID NO: 5585 - DNA, 833 bp, mus musculus; identical to SEQ ID NO: 5584

SEQ ID NO: 5586 - DNA, 628 bp, mus musculus
ggattctggatattttagtattaatatgaatattatttcagttctgagatacaattaaaattatttgcaaaccagtttgatctctttgcatcttgcttttaagttttgtttagcagatcacagaagtgcttagtttcagtctaatttttccccaatatggacacaaaatgttatgaggactccactcaatgacctgtgaattatgaggcatggttctttccttaactcaggtagttttgtcgggtaaagactcaaagggatcctcttcagatctctggagtgctctgcctatgcagtctttccatttccagtactctgccctataaactcatgctgctttcactttccaggactttcaacaatgaatttcttcaactcagagatacctcaggatcctacctaatatgttgtctcttcaccatgtcctagggaatctctagccagtaagatcaggcaaacttgagcctcaactaattttttttttttttatttctcagagcagtatccttcattggctgatattcaatgtcttaagaattgatgtttgatacattttatttggtttcttactttggttttcattttgctttttattttagttgttttaggcataatggtaagcccagtc

SEQ ID NO: 5587 - DNA, 628 bp, mus musculus; identical to SEQ ID NO: 5586

SEQ ID NO: 5588 - DNA, 892 bp, mus musculus
tctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacc

SEQ ID NO: 5589 - DNA, 892 bp, mus musculus; identical to SEQ ID NO: 5588

SEQ ID NO: 5590 - DNA, 892 bp, mus musculus; identical to SEQ ID NO: 5588

SEQ ID NO: 5591 - DNA, 892 bp, mus musculus; identical to SEQ ID NO: 5588

SEQ ID NO: 5592 - DNA, 892 bp, mus musculus; identical to SEQ ID NO: 5588

SEQ ID NO: 5593 - DNA, 1007 bp, mus musculus
cgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtcagtgacccctacactcaccggcccccgtaaaccctcgcccgcgccctgaacctcccagggaaccagcctcctttctctccacccgcgggctaccctgcgagccccgggaatgaacgcgcctcggtgccacagtatctccgcttcccgatgcgccgaggccgcgctcaccgggacgtagagccaaatgttgggccttgagagcccagagacccccatacctaaactacactccttggccacttgcgtccctgcctgcctctccgtgggcttctcggaaacctcagttctttagttctctccaggtcgcccccttgccctgcagcctcctttcctcttggccctggcccctggctcccacccttccactctgggtcagtgttcatgaagcttcccctctccctatttcccagactcgtcggcgcgaggaggaggggggacctggaaggagttgactaagttggagagagaacatggagctggggtgggagtgtggaccctgaagcagcaggcgggaggcccgtgagtggcgcgcctggtgtgggctgagcaaaggcgcgggaagaggtgccccggctcacctgctcccaccgcttgtccccaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcgcggggggtgcgaggcggggtggctgcaggccgcccggtct

SEQ ID NO: 5594 - DNA, 1314 bp, mus musculus
aaccccaagagcactggggaagcaaattcgtttagctgggcacattatcagcctgaacaaaatcaaggttctggtggcaggaagacaaggaaacggatttgggttaggtcaccactgggaccactgtggagaattaggccaaatctccatggttcctcaaagctgaaggttctgcaatgacagcagtggattctttctgggtccttgtcagcaggcgaagctgacacagaaacgttcttggtttctttgccagaaaggtgttatctgagcttccagcagctgctgtaaaatggaaataatggctcttctgccccaagggccctgctgtccagagctctctggaaggtggcaagaggcctccatggcaagcttgaagggatgagatgctaatgtgcaaactatgcttcagggtagagatgagacaaacaaacaaaaatgcacagagagaacagagcttaggccctggacctgtctggcttcacatccatgccactcgcccctcccctcctccactccgtgttgcatggagctgcccctgatgactccattttggttggagatggggcttggccaacggggagcactagcaggagatggggaggtgggaggatgggacaagccaaggttttccctctctgtctacctcgggtagtgtccctgctgcagctgcggttctgccatggctccggcgcctctcccaaaaggcctgctgtggtttctgttttgcccctgtgctacagcccctgctctccagcgacagcactttcctggccttgccccccagcccagggttgtcacatctgacactaatctcagggttgtgtgtttggctgctcagtctcccacccactgtgtaaccaataaccaatactctgcctcaaagtccttctgttttcaagactccagtggtctttgtctcctggttagatcctgactcatacaaaccatacaagaaatacccaaacacccatctcttagctttaacaatgattaccattctgccacatttgtttcatctatttttatttttgtggaaaaaaaaatctcaggcatcataatgttgctaaatgatttcagcatgtatctctgaaaaataaggacattttcttacataacaggcatatttagttgttcacacccgtgttcacaaattaacacacctaacaacatgagcaaaacttccttatggccatcaaatatgcaatccatattcaaattcccccgattgttccaaagatgtctattttacagttgctttgttcaaatcaagatttaaacaaggttcacacattgcatttggtagatatgtctcct

SEQ ID NO: 5595 - DNA, 368 bp, mus musculus
gcaaacacagaagactacacttcccgttgcccctgcagtttggtggggtcatatgactaattctggccaatgaaatagggcacaggtgacacctccctttagcccgaggcttcaccctctgccttttctcttcccctgccacagccactgaggacattctagctgctcaggatgcaaaatgatggagctgctggcagcctgaatccccaagtgactgtgtggagcagagcctccacctgactaccaaaaactaccaggatctggtgttacttgttacagcaacgtaacccaggctctcctgatgatgagtactctgatgaggctcttgcttcacagaggaggtgacaattaagccttgaggagacaca

SEQ ID NO: 5596 - DNA, 810 bp, mus musculus
ttgtataaatacacacaagtccctctgtttcctgttccaaaaagaactggaaattgagacctgccctccatgaaagggcttctgatctcagagggaggtttgtgcaaggtagcagggaccgctctctgagggatggctccagccaggcggctccctgttccgtctgcaggtgaggctggctgggggcagcatccctgcagcactgaggccaggacatctcgcagctcctccctggctcctggtgccctctgctggcatcatcaggaaagaagaaggcaggttggcagttcagggtcaaaggagagttcctgaggcttgacatggccagctcttttcccctgggacagaagcctgcgatagacaattggggtaagaaatagggactgagactccaacagcacacacaacatccttccctgccaaagcaggaatcctgccctctccctacagccacccattcagcctgccctgacatctctccaaatctacagattcttaacctggtttctagaaatatgcatactgggagtagggtgtggaaagggtggggtgagccccttccctccctccaatctcactgtcccaaaatcactaggccgagtccatgggtgtgaccaagtattgggatgctgctcttgggggaggctattgctcagagggaagtgatttgaaaatcaaattggtgaggccagaacattccattcttcagctaagcagtttccaaccagggcatgcaaatgagccatctgaggcataaaagccctggagggttggtctgagggcccttggcaggggcactgtcctaacact

SEQ ID NO: 5597 - DNA, 341 bp, mus musculus
gtgttttatgggacagaaactgtttctagcacttttgatacaccaataatgaagaattaaaaggaaatatgggactctagaaatctaaataatttaatgttctttacaaatattggcagatttgcacctatgattttaaagttagagatggtcttcaagcactacacattttgaagccttgagattaatcactgattgttggaggtgggatcccaagacctgtctcttctttgctctacaatacaaaatattagaagttactttcaaaaaactattcgtcaaaggaaggtagcaatatcagctttattgagatcaaatgactgcagagcacgatttccacc

SEQ ID NO: 5598 - DNA, 379 bp, mus musculus
aagaaaagaaaaaagaaaaggaaacagattctaagaaaccatggcaatgggtgtttgtaacagctcagatatatagccccattgctagggaattgctattggactgcgagtcacacattgaaacagattttagttaaatcaagctctgacatgattgtaacaaaaaccaaatgaaacgtctgccaaaacagaaattgtgtcaaattcctaaacaaggaagaatgtctataatgggtgccacatctgaacagcagttaaacaagttttggtaaagtttacaaaattctcaatggattttttggtgtcattagacaatgtttttcctatttattttaactcatcttggaaattgttttttcaaatatacaagaaagaagta

SEQ ID NO: 5599 - DNA, 1098 bp, mus musculus
acctctcatcttcccctgtgagaggggatcgtgaactattcacaggcctgattttaccagagtggaactgagtatgtgagggacaggaatgtataaaggcagggaaagtagaagggagagaaaccagacactggagaaaagataggattttccagagtatgactatcaaaaaaaaaaaaaggttaaatgcagattttagaaagttacttacctcaaaacactcagggaaaattccaaagttaaaacaatacagggtaggtggggcatgtgacactaagtgccatttagaaggaaaaatgtggctttctactaaatcttgactatgagaaatcctcattaatcaacaaaaagatgaggtaggagggaaggttcaaaacatggactacaactataattctcagttaatttgaagcaccttagtgagtaaattccaacattggcgaaaataattcatttcttttgctaccgaagatagttatccagataaaatgtatgtagatcagatggccctatttgtttcacagtttactctatttttagtccctcttttatccagggaaaggggtgggagagttatttgggtcattttttgcttgagcacagaactcaacagcaattaaattatcatcgagcaaaagtgatattttaggcacagttgtttacaaaacagtaaataaataagaaccactggttcctttctatataaacacgcttctcctaggaattcatccatttcagaatttccccttcactaggcagaaatttgaacttgagatgaggattaggcctttcagaattctttggctgctgcctacatagcaaattgtacacattcaattgatatcaattggtaatgagactagcactccaggccactgttttcagtgttcaaaaccacactgacttccttctaatttcctgttgtgcaaatggagctcttaaatgtggtgctgcattaatagaactcttttcagaatcattttaacaatgacaaaaataatgacacagaggatcaagcctaagctgactagtgatgatgatgataatgatgattcattaccttgattctttgtagaatgtctgcaaatgtagcttcag

SEQ ID NO: 5600 - DNA, 195 bp, mus musculus
attttgatatgcaataatatattttgtgccagccattaattatattaaaaaaaaaggatgaaaagctgcatttgttaaaaacatacaatatttcagcaaactcaacacacagaagtcagtgctagaagctatcttccagcaaatcttctagttgaatatacacagtttgaagtgggaaataaaaataaaactaaa

SEQ ID NO: 5601 - DNA, 611 bp, mus musculus
tgtatctcagggattacccccaacagccctggggtacaatgagccttcaagaagtttaacaacctatgtaaggacacacagccagtgggtgatgctgcctggtctgactcttaccattcagtggcactgtttgttgactgactgactgactgactggctgactggagggggttcatagctaatattaatggagtggtctaagtatcattggttccttgaaccctgcactgtggcaaagtggcccacaggctggaggaggaccaagacaggagggcagtctcgggaggagtgcctggcaggcccctcaccacctctgcctacctcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtgggaggcgaggcagcaccggctgctcacgtgctgggtccgggatcactgagtccatcctggcagctatgctcagggtgcagaaaccgagagggaagcgctgccattgcgtttgggggatgatgaaggtgggggatgcttc

SEQ ID NO: 5602 - DNA, 493 bp, mus musculus
ccctccactaattccttttttgattttgagcagataaggaggactctgtaagcctcagagtcatcacctgtaaaatgagactaggaattccttcctggaggagctcctgcattacctaatgcataaagcacatgagatgtctggcatgtggtaggtgatcagtaagtgacacttactgatgcatttcttccttggggctggaacaaagaattagatgtaagtgctccagatttgcataaggctaggattgagtctcttcattacaaaccaatttggggaattataaaagaaaatctttcatttgtggaaatcacttgactgtcattagatccagtcaatctctgagttggaagtttttgaactaaaagttgaccttcctcccctctcaaaccaccaccctgccactgtgcagctaagcttcatctgcatcctcagcaccctctcctcatgcccttgcagtctggctcccaccctcaacaagcctctgcagcag

SEQ ID NO: 5603 - DNA, 954 bp, mus musculus
tgagacttgagagagtacatttctaacaagttcctgggtgatgccatgctgctgcctttagcccacttggtgtggagaggctgtggacatggagcatggagctaggagtaaaaatgggggctgggtggaggaaggggaggatgagggcttgtcacctgggctgatgattgcaccctggcacacttcagctgtactgcatactggtaatagcatccatggtgctcccagcctccaatgggctctgggagctgtctgcatccctcagccagcttagctctctttcccaatccaaatagcagcaacatcctcaacctccaaccgcccacctgccattataaaattcttccctccacccaagcctaagctttctgccagggtctggctgggtttcctcttccttttggcctcccatgggccctcaatacattcatcaccccttctcgatagctcccaccttttgcctttcccacctctttttcctcaaccataaacctgtttggcaccctcctgtcctacagccactgtgctgggaaactggccctgaacctgggtccccttccactgctctccagtctctccccatcctcacaccctgattgcatcgaagaacaaactcacacttgtagtttctctctccttcgtctcatctgttctatgtaatctatcactaccaccattctgccttccccgctctactgaaatggctcatctggagttaacactggccttccgatttcccagtccaggaatttcaggcccagtccagcttgtcctccagaacactttacagtgttgatcaccagtgcccagtctccctatagctctccagattctctttggccccttctcagcctcttttcctggttcctcttcctccatccagtcctcaccaggtaacatttcccagcttctcctctctccaaacatcctgcgtgggcagattgcccaagcctg

SEQ ID NO: 5604 - DNA, 1446 bp, mus musculus
aatcagcagtcaccatggttattctaaatactcatctgatcaagttccttattgattcaactatttcccaggactcccatggtctaaggcagagtcagcaaaccatggcctacgggccaagtcttccttggtacctgtgtttgtaaagaaagccatgcccatttaattatatgctgtctatggctgcttttgcactatagtggcagagttgagtagttgtcatacagactgcaaagcctaaatatttactgtctggttctttaccaaaaatgtttatcagtctctgacctagatagtctctgggtgagtctctctctctactggattttgtgtgtgtgtgtgtgtcccaagtctctttcacgcctgtgtttggattcgctcacgacatcttcataaggtgcacacataaaatgtagcatttctctgccctctgaaaatgcttcttctaagtggcaggtcgagagttgtagtggttaggagcatgggtttggagccaactggtttgtctttgccacatcctgtctgcatggcttaggccctagaagcacaaaactgctttaaagtggggtgtcagtgcctctcaccaaggactgtgagacatgagcaaagtgctgtgtgtcaggtgcctgacattgtgtgcttgttgttggctgttagtgtgacttgtgactagtactcaaacaataatagaacttgaagagtatcttcccttccccaacccatccttgttttggtgatttgaaaagagacttctgaacttctttgggatttggcaactccaaagtgatactcagaactcccgggcagcccgtgtggaacattcagtgcgtttgttcttggagtgtggagggcttttctgtgtattaactctgtcagtccagagaggagtgtgttggcttttgcctcccaggcaagtgtagagccagagccctctgcaggtcagccccatctgcatctcccagccagtgtggcaggggccatgcctgccagtgacgtctcgggaattgtgtcatggatggtgccactcacccgagtcaatgctattcttgtttctgaggtgaattgatctctgtctccagcagcctgacccaaattctgatccctagtgatcacctcttatctaacaggacaaacccggtccacttgtgttctctaatgaacagtaatggaaatctgaggcaaggtgacatttccccttatggtccatccacacgttgttaaccctggcttctctgggctggggtactgtcctagaaaagctgccagctcaggctcaagcagctgtgggctcccagcttctctctgccgacccccatcccactttgcctgctgcctgtttcctccttgacctccaggttctgtgtgcctgttcttccctacgttctgcctgtctcctggttccctgagctttttagtcctggactggccctttggcttctgtctttc

SEQ ID NO: 5605 - DNA, 1169 bp, mus musculus
ggctggcctctggaagtcagtcggcaagtctgacaaatagctcttgggtgtctgtggaattgctttttgttagaggcataatcgttggaccacttgctgttttagcctttgtgtaagaacagagtgtgttccttcagcggggctgcatcttatccattcgccttgcacatatttatatctggatggattcggcgaggccagtaaatggtctctctgctttcccaagatagggcagatttttacacccacatataatctcttttctgagaatattgtccaaaaactaggtcatctattgtaaaggaaattagatggtaattaaatttagctggaagttacagtattggtggtttcattttaaagagagtgtgcttccctaattactttattgctacagttatactggttggtttttattttttgaggggggcatggggtggtgttggaaaaggttgtatttagtaagttagatgatgaattctggacttgaatttttagttggcagagtcccacgtccacgtgcaagtttcctttcctttgtgcccttttcagatctacctgacagaagtcagctctactccctgcgcagtcattcagctcagcctcctcgggatatcttttgacaagagagccatatagacagatgagactaggctagcaagaggcagctgatttcagtgggttttcctgtatgcggtccctggttacagctggatgggacctaaatgatctcgcactgtgtccctcccttctcattttccgattagaaagggcacaaagacagaagcccggcagaaggccagcttgctagtggagcgtcagagctcctgggagagcacaggtcaggtgacaccctattcagtgacctgtcgtttgccacctttgatgggtggccctgaggtcagggaagctgggaagagttggccccagctgggatttggcgtcatcatgcccacaggaaatgctgagtgacaggacaaccttggaacaggctagcaggcccttgccttggtacatgggttacgtgacttctgcactttttcttagcgctgagattcacagagatcactcgatcccggggagcaggcccaaagtgctcatggctcaccacttgctctcctccttgcccctcaccatgaacgtctttgacatgaggctagctgcctctc

SEQ ID NO: 5606 - DNA, 1314 bp, mus musculus
ggcagagactaatgccacaaaatgctccagcagctcctgctggggtgggaaaggctgagctaagaaggtggaggttccaggccttttctccaaagcccagagcttcccttaggctgccaagattgcacttctgccatctcaccaaggcctgtgctgtcacagagaggaccagcagaggcaacaagtttgtgccttagcagaaacccatcatcagaaacatataaatagcaaacatttacaaaaaagaaaaaaaaagaatgctaacattctgaagtggtaaggtcagggacatagctgggtgaggagagcaacctttaaaaatagatctgtgaaaagactttgaaaacccttgttaaggacatgtgtggggagccagctgttctcagggtatacatgccatcctacctcatttccttggagtttcttttttcttttttttgagacaaggtcttgctctgtcatctagactggagtacaatggcatgatctcagctcactgcaacctcctcctcctgggctcaagcaattcccctgcctcaccctcctaagtagctgggcctacagatgcatgctaccatgcccggctaatttttgcattttttgtagagatggggtttcgcaatgttgcccaggctggtcttgaacttccgagctcaggtgatccacccacctcagcctccaaaagtgctgggattacaaatgtaagccaatgcattcagccatttccttggagtttttagccccacttaccactttctctttcagggaacttctggaaagagtatcatcagggtagagacagcaattctagagaagaagctgacatccagtattgtccatgcccaagaagcagctgctgatctgcttcaatttttctaatttctggggaaaaaatatttaggcaaatcaaactaaacacacaatgagaaatatttttggcagtgttttttttttgactttttattttcatagaggaaaaataattggaaacattgatactgacttctgtgaagtcgacctgtgaaaatgaagtgggaccaagagggaaaggtgttggatcttaattagtcagaacattgtgaaggggagaggcaaggctcaacactgtgttggatttctgttttgctctctcacagccccactgtctgcaggcctcagcatgtgtaaccccattctgcgtctgctcctgggcttggctggctggtctggggtgagaggacagagcaggggctggaaccttagcctcgagccatctggaccatggctcattcctgggctccaatgtcactggggacttaccgtcttagtaataat

SEQ ID NO: 5607 - DNA, 1033 bp, mus musculus
ttcctatacgttcttctcatcttgagttcctgcaccatgaaatttttcctgacttacctcttccctccccacaaaatctgggctagttggctctcctattccttccatagctttctgaagttttcagcatagcacttatcaaggggtgttgcaatggttgtgtatttgcctgtctgtctcactagaagcttcttgagacagggactcttgttcattgagagaacatgtgccatgagtacagagtctagcctttagttgtcaattgctcagtaagtgttagttgactaactgaataaacagagtagcataaatgttttagtcaaagtatgcacaaggcaataaggaactaaggagagagatacaggaatgtctcctatccaatctgaaggatgcagcccaggaaatgtttgaactgagtttgctaaggtaagtataatctttgaccatcttgagaggaaggacacaaggggtatgaaaaagaacattttagataaagaaaacaccatgagcaaaaactagtggaaaaatgtaagcaaattacttggagctaagagtatttggaaagcacaaaaaatgtctctggagaggtgagattttctggagctttggtcaaatcgcaaagtttggcagtccttcttgaaacaggggagcctctgaaggaagtataatgggaaacttacatggccagattcatgcttcagaaagatcattctagacatacctaggagaatgacccagaggtatggaatcagatacaggaaaacacattttgtagggcttgcagccatctagttgataaatgacaagggctgagtaataacagtgatggttattagcaaggagggagccaattgttctcagagtgctgggggaaggtgctagtatcgaaccaaaatattctgtaagaactgtcatttgggggattatccagctgtcagcactgtcacaggcctggctggggctaagctgatcctgtttgtgtatctctggaaccactgctggagtcggcggagagatctcccccctacttcag

SEQ ID NO: 5608 - DNA, 1017 bp, mus musculus
gagtgtccacattctgaaccactaaattatgttgtctctgttccaccaaaattcctaatttcatactgcttgtgttggaaagtgtgttaattgacttctacttacctgtgaattgctgaatgtaatctctgagtaattaacatccttgtttttctgcctgtaggtccgtggggaaggtgtacaggagactgtggtcccggaggagtccagagtcgggcagtgtggtgttttcatgttgacgggtggacaagtcacctgtctaactgtggtgagagcaacaggcctccaaaggaaagaagttgtttccgagtttgtgactggcacagtgacctctttcagtgggaggtttctgactggcaccactgtgtgcttgttccttacgctcgcggtgaagtcaagcctcggactgcagagtgtgtgacggctcagcatggactgcagcaccggatggtgcgctgcattcagaagctgaaccgaactgtggttgcaaatgaaatatgcgaacactttgcccttcagcctcctacagaacaggcttgcctcattccttgtccccgggattgtgtagtatctgagttcttaccatggtccaactgtagcaagggatgtgggaagaaattgcagcatagaactcgcgcggtcatagctccccctctctttggtggtttgcaatgtccaaatctgactgagtcaagagcctgtgatgctcccatttcctgtcctcttggggaagaggaatatacatttagccttaaggttggaccatggagtaaatgcagactgcctcatcttaaagaaattaatccaagcggaagaactgttctggattttaactctgattcaaatgagcgagtcacctttaaacatcaaagttacaaagcacatcatcattcgaagtcttgggcaatagagataggttatcaaacccggcaggtttcgtgtacaagaagtgatggacaaaatgctatgttaaggtaggagacctttgatgcttgaatttgattcacctaaaatatt

SEQ ID NO: 5609 - DNA, 472 bp, mus musculus
taaaagctatccaagcaatgagattcactaattcatagtaactaagtagttaattagaagtctgtaattatctttgccacttaattaagaactctgtacagatttctcaatataacttgttggaaactctacttatcttggttattgggatttcatgaggaaactgctttcagtgtattagattgtctcattaaaactttgctcagccatctggggaagcacaagttgattcctaagagtctaatagttcagggtttgctggtgaagtgtgactgaaagggcataggatagcacaaataactttctaatcctcaatcactaaggtggatattaacccactatgcacagctatggcattattacttacttatgttggtattgattcttattgactgtaggcatcaattcttatcgtttactgcccaggctgtataagatcattgcaaagctcacctattctacaaatgggtga

SEQ ID NO: 5610 - DNA, 377 bp, mus musculus
tgagttcttgagaaacaatagaactaccatatgactcagcaatcttatatctaggtatatatgcaaaggaactgaaatcagcatgtcaaagaggtaactacattcccacgttcattgcagcattattctcaatcatcaagatatggaatcaatagatgaatggataaataaaatgtagtgtattcacacacacacacacacacacacacacacacacatgcacacacaggaatattatccagcctttaaaaaatgggcaaaatcgtatcatttgcaacaacatagatgaacctggaggatattgtgctaagtaaaataaccaggcacaaaaagccaaataccacatgatttcacttacatgttgaaattaaaaagtc

SEQ ID NO: 5611 - DNA, 807 bp, mus musculus
ttcaatttatttaaatattacctataagccaggcatatctctaagtactagaaatgcagggaagataatatttttatccataggtgatatgtatacatatttttaacaaaaattgcactcatacagagtacatacatttaaccttaccttttgtcagtcaacaatgtcatgtaaattcacgtaaagacataaacttaaaaatgtaatttcagtggctatgattacattgaatggccatgcagtagcttatttaaccaatatttcttttttttgcattggaactagtttctaattttcccctattaaaaatatcctgatcaagatgtttgtaaaaactgtccacattgtattggataaataattaaatgtgggttttatggatcaagagaatgggtcaaaaacatggcagtcatgtttttaaggtttcaaacaggttccaaatgtcctccaaaaatatttatccaagttgtgtaattcctaaaaggacatgcaagtgcctatttcctcacaaccttgacaatcttaataatgtaataaaaaactagattttatgaaaagagagtatcttatttagttgtattttccctgtttttgattactaattgaacagtttttcataagcatattgcctatttgtatttattacttttctgttttctactgattttttaaaattttctaatataagttgttagcagtcttggggtgtttgggataaataatttatgcttatttcctttaagaaattaatacttcagattggagaataaaactactgaagagtttaagaaataagctgacaaagta

SEQ ID NO: 5612 - DNA, 1487 bp, mus musculus
gggccctactactctaccaggaacttgtgtttcttttctccaccctccctctatccttcccttccttcctgcctttcttccatcctctacagaattatagccctaattgttggaatacgctgaggctgtaaccaactatcattaggacctatttactttcttgattctgtaggaccttctcaggcaacaactggacattttctttgtaaatatttagcacgattggaggatttatgaagttttattgcataaatttatcatttgttccaggtttaaacacaattaactgatctgtagttaaagtgcttttctcccaacctttggtggctgcaatactacctcttcattatctcttcacttggatgctggaaggaggtaacaggagtgtgttggtagttgatgcaactatcagtagtcaagaggagaggctagaggggaagggaggcaggcaggatcccagcaggccctgtgatgaaagggcacctgggtcaagagaacatcactcaagactgacaaggcagcaaagagcttcttcctgggtgccaatattgcatctctaccaaatcagaatgatttggtaaatgactgataaacctgtcattatctttccatgggtagatagaaataaacctgtcattattgttccatgtgtgttcccatgcattgtccacagatgcatgattatttaactgaataatcaccttgtctacttgtacatcaaacatgacagctttcattacaaaggaattatttaacctgcctcaaatgttgcttcatatatggagcgaaagcaggggaacagaaccatggaaggttagaattggaacatcttgtttaacctcctcagtttgtagatgaagaaactgaggcccagagagagaaagtgatatccccaaagtcacacagccagattgtggcagatcaagattaggccccaggattagtgcctctttggactatggtaagctcactctgtggggtagcccggagctctgaggtgcctatttcctgtaccaagatgattatgaaagaacaatgagggggacacatatttacaaaatatcatcttagttaaccaaatgcaaatttcccaatttgagaatacttaagagttcctaagagggggaagacagagacctgggatgaaaagatattggagtaaatgccattgcccctcgaacccccacaacttcttatcatgaatgaataaagcactattggttgcaagtgcccaaacacagctcaaacaagtcaaacaactacaacagaggaaatttaatagcctatgtgaataggaagttcagtggctgaaggtagttttaggcaatttaaaccaaattttaaaattcttgagcaggatactgggccagccattctgagtttgtgtgtaattcccttaaagtgggctgggtgtggcagctggagaaggcttgatgttagaccctggagagcagagaacaaaaacctaactcctagaaactaatttg

SEQ ID NO: 5613 - DNA, 190 bp, mus musculus
tattttcttatttaaacatttgttgcaaggcattcagtatctgaaatcatggttctagagagatgcagacctggtctttctattttgtgctgaaaaaatgatgtgaaaagtatctaaattagcctggttgtgttgctgtctgggctgtagtacaggtgtctctgccctactgccatttaaaagtgaataa

SEQ ID NO: 5614 - DNA, 183 bp, mus musculus
acttctgctaggcaggcagtattcaaagacaaaagaggccagaccaatgacttccaagagcttatttagttttaacactatccatgttggtagctccttatattttactcatcaggcaagaccattgattggtagttttattgatgtgtggattgcactatttcccaacgagttcagcttcat

SEQ ID NO: 5615 - DNA, 330 bp, mus musculus
aaaaaaaaaggaaggaaaaaagagaaaagaaaaccataaaaccatacaaaatagaaaaattaaaactgtaaaagaagagagatttaagggggagactaaggttaaaacgtaagaggctagatctgagtgcaatgtgtgatgcacacaggaagtattactctcccttgttatgagaaatgagtaatctgaaacgaggtgacttgcttgaagataatctttgtaaggagaggagcctagatttcaacccaggcctggctaattccaaaacttgcatacggtatttgtgtcatccatactagcacttaaatttaaaataatcatttatttaag

SEQ ID NO: 5616 - DNA, 1004 bp, mus musculus
gtgttcttttaagagatggtgccatggaaacagaagctttcttatttttttccaaatagtgatgctccccaataatcccagtagaattttttttattggtttaatacacattaggaatcctagaccacattttcttcataatcccaccatacatttttccgccaagccaattaactacctgaattttctcaagaacatttttttaatacaaagggaatttagaaacttctataaataataatcatacatttgctatgttatgaggctgtgagcctcctatcactagcagtgctaaagcaaggatatgcaccagatactaggtaagctgtggaagaatctcatgtagctggtaattagtccaaatagataacctttaattctctttatggtcatatctactataattttactattacttaaaatgaaatttggagtctatgatttgttttaagcatattaccaagctatagtagattcatacaaaattgctctgttttaatactcacaatgagagttcattattgtgtcactcagtggtgctggagtactagacctttgagttccaaaaattaaaacgcttgggaaggaagtaattgacatttttcactagaaataatctcatgacaccaatatagcttttaagtacaatttggagaaataaaaaataattttgtccttgagtctaattagtttccttgataccaatgatactgcatttctctgaaagaaacaaatgataggaacatagctatcctggcataataggtttctaatgaattactgatattcatataaaaaaagaaagactttgcatttaaaaaagattttgtattaaatatcacactgtgattattctcacaattattacaaaatacactggaaccccagttggtgctaacagtcaaataataggctatttagggggtagaggcatcttaattttaagtagttgttaactatttacaatgcacaaattccataataaaaagaaactgaggaatatt

SEQ ID NO: 5617 - DNA, 1276 bp, mus musculus
ggataaatgaagataaaacacagcctcacaatcagctcagaaagattttaatatcaaattagtgcatatcagtgcaatttacaaagtaagttatttttaaaaaatcttttagattcagagttgttttctttaacattttggggcaaggggtaaaagtttaaggaacactacttggcctagctctctcaatctctctattacactttccttttactttgcccatattcccttctagctaacagttgtatgcaaactttcgagtcagaagcaaagcagtggccttattcctgttggtgactgcagcaaagcaatgtcagacagaagagagggttggcatgcttacactctgcatgccaatgcaagacatcagctctaggggtttgaaagcctgtggcagtgatatctaagccagcagcagtagagcttcctgacctctacatcacagctatggcagtatgaccttgaaattagtagtccggttgtaactcccctgattccaactcctccagctcctctgatttttgaaacccttaatcagtaaatctctccctgcttgaattccaagagtgctttctgtttcctggtctgaatcatgactgatacagcatttggtagcagtgatttgagaaatgcagcttttcaaaacattatatcctgagcatatgtattttatgacaatttgtgatgcagtttgtttgaatcttaagcgtaaatagaggtaccactctccacccaaggaaagctattggcagcataagtaggtacaaatgtctttcttttccttacaattcattatcttttaacttactttcatatgtggatcatgctgtgggaaacaaatacgatcattatcagtaacaaataaaatcttctttatgaaagagatttttttcctatgcctggcaattttttcttattatatgctcttctgcttatatagttgcatttccttggatagctttaaggttactataaacagatatctcactgataatgacaatggcagccttgaaattccaagccatttctagcaattcatcttgaagcagcattttagttctcttttcgttgattatcttcatgttatactattaggtccaggggcttagtcatttttttattactttgactagaaaatagacacttagatatttgtaaaaagttctatattgttgaattatggcaagtacactatccacccaagcaatgcaaattacaaccatgtgcactgtttcttatttttgcaatgttataggagagctgacttatttttcac

SEQ ID NO: 5618 - DNA, 9720 bp, mus musculus
atgaaaatatgaatttttaaaaaagaagatttgttgaaattctgtttaaaatacaattagaatatcagatccccttgccaacttgatgctgcaggtgaatactcccacaccccatttcaggagatgactagaggattaatttccagaaaagggaggagaaagggtctccagactgccatgacaaacaccacagactgggtggcttaaacaatataagtttattttttcgcagtactggaggctagaaattcatgatcaaggtgcaaagtgctgtcagggttggtttctagtaagggttctcctcctggcttctcctcttggctgccttttcactatgtcctcacatggcctttcttttgtgtactggaggaaacagttctctggtgtctctcacacgtcttataaggacacctaaggataccagctctaccatatcaagccctcacccttatgactgcacttaaccttaattactaatttgtaggcctatccccaaatacactcacattggagattagggctttaacatatgaatttggggccaccaactcaattaataatatataccatagttgtaaggtttctgtatcggtttgaaccccgagagcacgtcaatagacaacacgaggtggtgtggagcaacatgctgttttaatgagcgcctgggtgcaggcgggctgaggcctaaaatggcatcagcaccaagtgaggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtttggtaagggtggaggccctaagataaaagttcggccatacatgattttaaagggactataaaaagaggctgcttttggtgttgtgtggagtctcatgagggcaaaagggagattttttgtccacgactggtgggtttttagagccagcttcgtgagttgcgctttaagtacagatttagttttttcaactttgcctgaagattgaggcctgtagggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggctatttgtttcactacctgatctgttagcgcatttccagccgatatgtgattgtctggggtttggtggcccctgcaatgaatgatggcaactttctgcaggagcctgatagcttgaaggagtttgttgatgagagagccatttatgacaggagtgttttttgcagctaggaaaccccgttttttccaggtagacgagtgtgactgtactatatggaacgtataatgaatgacaaattgaatatatgttaatttgttgtccggctgtcagtgtgagagcttgagtgagggcaatgagttcagcttttgggaggtagtgcctaggggcagtggattggcttcaatagtatgtgggggcggggggcgggggacactatagcatagccagcatgccggcgtccttgctgtaagaaggagctgccgtctacaaaccaagtaaagaaggggttcatctgttagatttggaaaaggtataagaaaggtttgaacagtgttcacacagaagtgtttagggtctttggcggttgtagcttcaggtaagagcatggctgggtttagatgggagctggttagcatagtgatttggggggtttctatgaatagagcatacagttggaggagtcatggggcagagatgagactagtacactgcagtgagttggcatgtctttgatgttatgggttgaataaactgttaggttggcatggagagatagttttaggcttttaagggttaggacagcagctgccgccaatggtcggaggcaggcaggccatccaagaactgaggctttaagctgtttagagaggtaggcaataacctgaagggtgggtcctttagactgggttagaacacctagtgtaactctatgctgttggtcagtatagagggagaaaggtttggtgaggtctgggagagtgaggacagggctgaggtgagagccttccagagtagacggaaaggttgggtaataggctgtgcagatttttaaggctcatggagtggggctttagcagcttggtataatggtttggcaagtagagcgaaggagggaacctagagcctaaaacatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggtactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaagcgataagtttcatctggctttttgacaggtagaactggtttgttaaaaggggagtttgttgggtggagtaggcgactggtgaggaggcgaaaatgataggctttaggcctatgcgagttgcttgggagatgggatactgcttctgtgataggaactgggtgggctttttaagggcaatgtggatgggggtgtggtgttttgtgactgagggtgtggaagtgtcctaaacagaggggttaactacggatgggggataaggaaaagttgcatgttttaaggtggcaggttggaggagtagaagaaagttagaagccccagaggggtctgggttggtgcgttgggtactatggggaacatggaagtgaagagtagtgtggagctttgaaaggagtggagtttggcatgagggtaggactaagaaagtgagtgaaggaaaaggtgtatagggagcagaaaagtggaggggtggcttggggtttggagacttgtctattaatttctacaatagagacttgggagaactcagtgggtcctgaaaaattaggtaaagcagtgtaggttgccctggtattaattaaaaaacatactggcctacctgccaccatcagggttacccttggctcggatgaagagatggtagttgccagggtgtccatttcagggcaccgtcactcttcagtggcaaggccgatgagatcctaataggaggttttggccagcttcggaagggatgggggcggtccttgtggggtccgctgacagtccaacctccggtggggtcctccgcaaagggggcatggcctggtgggcttacctgggtttgggcattgtctggaccagtagccttcattgccacacttgaaacaggcgccaggtggaggtggattgctaggaggcttccctgttgagctgcagccctgcgggcctggtggaggtaagcatttgagactacctgtgttttgcctttcattttcctcatcacgattgttaaagactttgaaggctaaattaagaaggtctccatgtggggtttgagggccgtcatcaagcttctgaagtttgcgtggaatattgggggtggactgggaggtgaaccaaaggtttaagatagtggttccttttcagctggctgagtttaggttggtgtattttcttatgacttcagttaaacaagagagaaaaagggctggttttcgtcaggaccctgggtgatttctgaaagtttttcatagtttactactctatgggcaccctttttgagtcctgcaaggagacacacaatcatgtggtcttgatggtggcatccagaggccccatcttgataataccagtgggggtcctgattgggaactgcctctgcgccagtaggctgggcaggagtttggtgatgaattgtatcagcctgcgcctgagctagggtccagatatggtcttagtcttctggggtgagggtggaagagaataatgtagaggtcatgccaggttagtttataagactgggtaaggtactgaaactccctaatataagaggtggggtcttctggaaatgaaccgagtcttttgttaatttgagacagatcagtgagggagaagggaacatgaactctagtaataccttcagttcctgctacttcctgaagtaagggtgggtcataggctaaagatggcatctgaaggagtatgggccggagggaaggaaaaagccggaagtggttcctgctgagggtatgaagggggaagggagttgagttgataagcagtggaggatacatacgggcgtaaggtggcaggatgggtttataggcttcaggagagggcgatgaggaaggagaatgagtacaggcaatgctagaattgtcctgatgggacggtgtaggaaaagaagtggatacagctgactgggaaggtggtggctgagaagatgatgactgagaagacaacgaacgggttaaagaaggcgattgagagaaagaggtagtggctgggaggcatggacagcagtctgctggattgaatgaggaaaaagaggtagggttgggaggagaaaggtgatctggatagcaagaatggaagagaaggatttgaacaggtaaacaagaattgtagaggtcgggctgtgatctgagtgcaaaaaacgcctggacatacagaatttctccccatttctccagtcattggcaataattgcttaagttcgttaaaattataaagtcaaatgttttatttgagggccatttagatgcattgtttaatttgtactgcatccaggctatattgtaaaaaaagacggggcacttagggtggatatcttgtctgaggcctaaggtttgcagggttcttttatgaggcagcctagagggctgttttttggaatagaggaccaagaatttcccataacggagggtaggcatgggagaacagagaaaaaggagaccgtcctggacagctggagggagacgataaaaggagtgatcgtcactgctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacgcagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatcttctggccagctctcttcctgcttctgctattttgctggtgtaccctgctgatatatgtggccttgcaccttggtactgggcctgagaagggaggagttactcatcttaaactttcaggccccaggaagaatcttacaatagtgaaaaaaaaagcattaaataaatgtttatccacttgcactcttatttagctaccagtccccacacaggaggctggacaagtctactctgttatctgcacaacctaaagagtctgacatgagggcatttcccagcacgatgggcaaatgggatcaccttacaacaaaccccatcacgtgcagaacacactgttaaaaaaaaaaatcatgagccaaactaaatttaacggagtttaattgagcaaagaacaaatcatgagtcaggcagcctctcaagccagagtaggttcacagactccagcacaggcatgtggttggaagatttgtggacagagaaagtaaagtgatgtacagaaaatggaagtgaggtacagaaacagcctgattgggtacagcccagcatttaccttaatttaacatggtttgaacagttggtctcctttgattggccaaaatgtggtgattagcacaagagtaggttacagtctgcttatgcctccatttaggtaacagttcatgattttcagagaaagctttaggctggacttaaaatatgtaaggaggcaagtttaggctaaagttaatttaacaatctccctttttggtcatcttctcaattttgagagattgaccaaaactttagtcattgatgtaactatcaccatcataaatgtccttatttggtttcaaaacccaccggaaaatagcataatagtggattttgtaagataggaacaaggacttcggtaatttttttttacgggttagagtagagggtacctcctcatgctggaatatcctgtttacaggagaaaaacaaaacctagtctgttctaggatatatctgtttccttgaagtcttattttttattatgtcacatttatcataagtgactgctttttggtttggtctggtctgtggggtcctagtgcatgagctcactccaaaacagtatcctcccataattttgtttaaatctgttaaaagaaaatccttaaccaaattaaatttatccgagtataattgagcaaagaacgattgacaaattgggctgcctcccaagccataatagactcagagatactccaccgcagccacgtggtggaagaagatttatggacagaaaaaggaaagtgacatacagagaagggaagtgaggtacagaaacagccaggttgtttacagctcagcatttgccttatttgagcagggtttgaacagtttctcttctttggccaaaatgcggtgattagcactggagcaggttacagtttgtttacatctccatttaggttatagttcactatgcacagagaaacctttaagccaaacttgaaatatgtaagtagatagctttaggctaaacttgattcaacaacactcatgtttattatacccaaattacaaaacttttcatgaaaatctatttttatacatccatgttgtgtggaaaattttttaaaaaaagaaaaaagaaatctgtttttagtttatgaccatatgaatatgttaacctattaaattttttttaataactttatagggggccaggcatagtggctcacacctgtagttccaacactgagaggccaaagcgagaggatcacttaagcccaggagttcaagaccagttgaggcaaaatagtgagaccccgtctctacaaaataaataaataaataaataagtaaaataaataagagaagaaagaaaaattagtggggtgtgggtggctcatacctgtagtttgagctactttttaggctgaggcaggagctcaggaggtggaggctgcaatgagccatgattgcaccattgtactccagcctgggtgacagactaagaccctgtctcaaacaaaacaaaacaaaacaaacccctcaaacctcaatagaagagttgtaaacaaaagcaaactcaagttcctaccaattattattaatcattacattatacaaatttctattggttttgtgcgactatgttgtagatcagaatatcaacttctagtttaagataacagattgagtctgagagtggtggctcatgcctgtaatcccagcactttgggaggctgaagcgggcagatcacaaggtcaggagttcgagaccagccttaccaacatggtgaaacgctgtctctactaaaaatacaaaaattagccgggcattgtggcacgtgtctgaaatcccagctactcaggaggctgaggcaggagaatcgcttgaacctgggaggtggaggttgcagtgagctgagattgtgccactgcactccagcctggtgacagagcgagactccatctcacaaaaaaaaaaaaaaaaaaaagaaaaaagaaaaagaaaagataacagattgagtacagaccgaaaattctccgttctatgacaaataccgaggagtgactgaaaaaaaaattaacaaacatatagcaacagttaaaaataagtaaatagaaatctgcatagaccagaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaat

SEQ ID NO: 5619 - DNA, 9720 bp, mus musculus; identical to SEQ ID NO: 5618

SEQ ID NO: 5620 - DNA, 293 bp, mus musculus
gtgtgtgtgtgtgtgtgtgtgtgttgtaaaagttaagaggtgtgcatacttctgagtttgaataagttgtggctgagactatttgaattgatttcatactgggaaatggcatacaagtaaaatcagtagtctattcaaatcattgtacagtcaagtcagctaaatatatggcaatgaagaagtaaaatcaaacctcaaattgaacaaaaccagtctattctgtagtcaagtagacactatgtctgtctctctaacttctctgcccagaccaaaatcatgatttggagaatgca

SEQ ID NO: 5621 - DNA, 1004 bp, mus musculus
attttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatggtgaggctgtaaatcatttttagccactgcactgacctctgcagctgttacaattacaaatgcactacatgcctgggtgtttaccttaaaatttgaagaacagctgcagaggcatggaatttcatgagcaaagattagaactgtaattttagggtattgtgaaatttttttgtcagcaaatttgtgtcatttgtacatccaataaagaacaagaacaattagagcccatttctaagagataaaaatatctaaatgtattcctatctttctgaaatattttacttttgaggaaaaaaaagttgagaccgacactccctcaccttttgttcttctccaccgacacctgaaacgccccttcacactgtgagttcctgagtaatctgtggctacaggtttcataggaactgtcagtcacctaaagagaatttcctcatttatcagctgtttaagtcccccccacccccccaaaaaaaaaaaacctgaagtaattaattaatttttgagcacagtgtgagctgattccgacaagtctgtcctgggcatgcgaggggactggtgtgcgagggggccgggtgcaatgatggcactctgtggagcagattgcagtgattcctgtcataccatcccgggcagtcagcccattagctgccattgatttactgaccttttggcccgcttctctctctctctgtctctcggctacagacctgccacctggaactccagatgcttttgcccaactgctgacctgcccctactgcgaccggggctacaagcgcttgacatcactgaaggagcacatcaagtaccgccacgagaagaatgaagagaacttttcc

SEQ ID NO: 5622 - DNA, 259 bp, mus musculus
ataactagatatatatatttatacatatgatatataaaaaacatatcttcccttgtttacccttttcagggaaaagtaatatataacttttccccatagtcaatatgatatctcaatcattggctagttacctttcaacaggattattacttatcttgtctgtcagtcattacttaatatgtctgctagttatttaagttagattataatccagtaacatggaaaacattttaaaattaagtagtggtataaaatttta

SEQ ID NO: 5623 - DNA, 441 bp, mus musculus
caatatgtgaaaaaaaatccagttttgcaaaatcaagtcattcttcctgaaatttcgttgaatagcatatggagctctctacattccagtgataacatctttcaagctattaatttgaagagatatacgttaatccaaatggagacatatatttggattaatgtgagcctctttagaaatctctactatgactttccttaatgtgacccttttaaattaacaatttaccaaaatatttttatgtacacaattccatccaccttcaatctggtgacgtagaaatgaccaccgatgttttcttatcacatacacttagtcagcaaagtgtattgaaatgactcccaaccctttccctttttgttttcctttgttaaccagttttcctttcctggtcactacctgtatccctgatactaaatttgcctgtgaaataatgaatct

SEQ ID NO: 5624 - DNA, 1111 bp, mus musculus
ttcccaggggttcatgggccatactttgaaaatgattgtcacagagtttagagtttacaaaattcatatttgatctactagagtcaactatcaattagagcttttaccaaatcccataaaaatgcaaggactttagaatactttgattccatttaccatctctaatgccttgtatgttattattgtcatatatctaaatatatatctattatcaaaacctataggagactattattgctttgtacaatcaatatttatgtggctttatcctcaagtttaccatttccattgctctttattttttggcgtgtatttgtatctgtatctggaatcatttttcttttgcctgaaaaatgtcctttagaagttacgtctgcatgagctccaaagaatgaaatttttcttttcatattgttgattacatctttattttgcctttatttttgtagaatatgttcactgaaggtagaattttaggttataatttattattgttgttgttttattatttttcatatttcatatgtgccattccattgtcttctcttttctactgtttctcagtcttacctggacattgctcctattgtcttcaaagacctgttttgtttgttaggcttatattttgtccagtttttctactgttcttggcaaggctttttttcatacaagattctccatcatgactgggagtagaattctcttctaattaatttttaatcataaagtaaaataatggaagaaaggttgtatctaattctaattgcatttaattattttaagtattcaggtacttcaatatttgtttaaccttgatacctagaagatttgagagaaaaaaagtgggctacatttaatctatacacacactgcttcctgtgggttctaaggtagaaagctaaaatttgtctttatgtcagactcgtgtactttggaatgaatcattttgataaaccctcttagtcatgaatatgtaagccaagtaccttcacattgttttggcagaaggcccaaatatttgttgagtaataaaaatgccaattctttaagaggttgataagtattttctttatagtgtgaaagattataccagttgaatagtgtgaaatgg

SEQ ID NO: 5625 - DNA, 198 bp, mus musculus
ttttaatttatagatgcaaatgttcagtttaagagaaagtaaaatgattgaaatttttaacacaattaatagcgtattattggtatacttggaaatgatagcttttatttcttctagacaagtcttttagacttactaatttggaaaaacattttgggagagaacttggatgctctcaacattaaaagcatatcctag

SEQ ID NO: 5626 - DNA, 202 bp, mus musculus
agaatgtgtagacaagatcaacagatacagcacaacatgtactttctgagttgcgatgtaggtattatcaatatagcaccttagaaaacagaaatcacttcatgtcacctccacgtaaacaaagactaagcttttgcttttcagattaactctttattccccggacaaagaaaagggagtatttaaagcaaagtcgttgagg

SEQ ID NO: 5627 - DNA, 108 bp, mus musculus
gactggattctggtacacaacatccctggtatttttcatatgaaataatgcttaaatgttataaacaagttctacaaaatgttctaaaatcttttttggtattttcat

SEQ ID NO: 5628 - DNA, 1614 bp, mus musculus
tacacagtactgtttgacagttcatcacttcaccagccacggaagaagcacatccatcaccaaaaagtgtgcctccagaagtgaatgtcattttgtcggttgccaccacagccgagattctgaacatacggtaaggatcgtgtgtgtgtgttattgtctaaactttcatcctagtaatgtaagtcgtagatcaaaggagaggcaggaaggatagtaatatgtggaccatgtttacattttgaggaaagactccatacaaagataaaatggagaccaaagaacagactccatacaaaggtaaaatggagaccaaagaacagagactccatacaaagataaaatggagaccaaagaacagactccatacaaagataaaatggagaccaaagaacagagactccgtacaaacataaaatggagaccaaagaaatgaaggaacccttgtcttattcactgcttctgcttagatgaggaagggagtctgaaggattagcctcagtttaatatgatgaactgtagataccttttagatcaattgatggctttaacgttctcattctatcattctaaatgagcatttcactcctttatatgcctggaattctgaaatgcttaagaaagaattacttgaaaatatgttcatttcatgaggttttagaatttgatttaccctgtaataagtacagaaaatgattctcatatcagtggcttttaactctagctacacaagaatcacctgggtagcttttacaagctctgcttgttgttgagggatgcaggccggcaggctctccagaccagttgaaatggaacctcagggtaaggtcctgggtgtcaggatctttttaaaaagttccccgaggtgattctgatgtgcagccagggttgagaaccactgatatggatgcctagagttgatgcctttatcatacctagtcatcctggaagcctctatgaatggctgggtttatcaggttgagacattgtacctggcacggtttggtattacctgaaaacatcccctgaaaacaccagttagggacaagcctttattttttcttacaccactcagcaaccataattagtaaaccattgttgctgtaatgataagaatcaggtgttagcatagacaatagagagtcattattatcccctaacaagtagcactgagaaagaaaatcaatgactaatccgaaaggttcctagctttcatttttgtctgagtgttttcccttacaaacctttagaagatttgtggactcaatcaagcactcttatgcagtttctcttcctctttgccttgctaatgcttggatttgatgcagataaatcacagttaggataaaagactttcagcatggtttttcccttccattctattggcattggtgggggaagggtacccaagagcctagatgatgcaaaattggataaccaactccaattgtctgtcttcagatagagctcaagaagcctttgttttatctttctttcttttgccccttccctcttctattattcactgtcatttcctctctccttttttgtaacaggagtgtaggtcttgctgtgaaggaatgatctgcaatgtagaattacccaccaatcacacta

SEQ ID NO: 5629 - DNA, 1063 bp, mus musculus
tggcagcagcagcaacagcagtagtttggggatatttcccacccactattgagtgggttatattagcaccaataaaaaggaaattccaagagcacagttggatcacattgcaccatttctttgttatttacttgacggccttctctcttaatcctattggccaatcttcatgaacatttgcccagccttcccttagagaatgagctgtttgaaaactcaccttgttctgttcttctggaaggggatttttgggaagataaaaatgagggacactaaactacaaacttagcctctctacaaactgagcctgacacctgcctcatgcactgttctttctggcaggaaattgagaaggctgtggtagcccgaaaacggtgagacactgagagacactgggagacctcactgtggaaatgcctctgactgtgtttagctgtgcaggtcacagattagcaggttgcagtggtttctaggaggcctgggctttctgcagaggaggccctgctgagagaacagctgaagtttgcccccaagatcagagagcaagcttgtttaggttaaggcttcaaagtaccagcttttattacattttaatgatcagagtcatattttattcatagggctcaagctgagcaccccggagttagtaaagcacaaggtttctatttcatactcaggccagtctacgaaaaagtttgaaatagaaggaagcttggggatttggcctcattatttaaaaatgaacataaaggatttgctgaacactgacaataaaatatccaggataacagacttattatgtagctttccatggtttatgttgaagacgtaaataagtcacatcttgtttgctagagaactaacctttcattaacttgtatttccacaccttcacaatacacctctagcagaaatgcaactcttgctggaattcctctccaagtatgaaaatttgagaacattctctgtgttttacttttgctttctgaaaaaaaaaaagaaaagtaaaaaagagaagcattggattgtgctccatttttacacataatatggagaagattga

SEQ ID NO: 5630 - DNA, 1126 bp, mus musculus
caattttcagtctacttcagcctagaatctgggcctcagcccgtagccacaggtttctctctggctctctgctgcagaggaggatggcacccaaccaattctgtgcagaaagccaggagagtgcagaaaatgtcatgctcatgagcaaagttctgggtacaaaggacttgtggagtctggaaatacctgaattttccttggagaggaaagattaggcctgagaagttgttcaaaattggacccctccttccaaagtgtgtctgaaaagtgtgtttgggataggcttgttatgtatggcctttatcatgttgatgtatgttacttctaatccagtttgttgagagtttttatcatgaaggggtgctgaattttattgaatgctttttcagcatctgttgaaattatcatatggattttgtccttgattctgttgatcatatatcatgtttattgatttgcatgtattgaaccattactgcatggatgtgctttgagaagtgctgcatgttcaacaatagccagtcagattaaaaggtgcgcctataggcccagagctgcccatgtgccatgggagaaggaccaatagcactatgagcttcctgctagggcacaccaaaatgaaagtgtttggtgtgagatgtgtaccacatcctccaagccaaaattctggctttcttctgggctgccagctttttcatttcacaaaaatttcagcctttcacttcccttgctcagattctttttaccctgggatttaccctgagattttttatcctgtaaaaaaactaccctgtaattttttttaccctgaaatattactctgtaatatttttaccctgggatttaccctgtcacaatccataacttggttttagctcctgttcttctggtttcatttagtcctcagtgccctgaagcacgtgccatcagtgtcccctttctccctttctgtcatcatccagtgggcttttccctgacttccaactcccagtattttcatctcagtatctcatttctttttcagcagaagcacagaaaacagctttgcctatgatccatgatcagtgagccagaagtgcctgggaattaacaaaccctgggagcagctttcaacaatgacctcagg

SEQ ID NO: 5631 - DNA, 266 bp, mus musculus
aaataagttatttcattttagagggtagtcacacatatggaccctacacacacatacacacacacacttttacactccctggtcttaacactcttcacactccagcttattgttcacagtgtagatcccagctgaaggctggtgtggaagaagccaggcaacaaaagatgtgcatatgggtttaagaattttcactgtatttttaggatggatgttgacaaatgactttaaagtagctcaaagagacaggcatcatttcttgaaaa

SEQ ID NO: 5632 - DNA, 882 bp, mus musculus
atacatatttttgttttcatgtttagcagggaagaaaggaatttggaattaagtgaatgaaatgtcagcacatcaatgctgtactattaggaggagagagactctatgaaattaagaccaaaaaatcaatagatgctatctgtcctttgaaggcaaggtctaatattctttgtaatattgaacagcatattctatgcaaatacttaataagttattacagcaatgtaaatatcaggcagatattttcattcacgtttatataaggcaaatgcattagttagtgtaaagggaggtaatacataataataaaggtaacagtctatcaagaagacagaacaattttagacatgtatatacaacaccctttatataaaattaggaaaaattagaattacaatgaaaaaattagcagacccaacttcatagttgagtatttagcaaaatgctttcaaaaattaataatctttaaaaaatggaaataaaagctatagaaaacaaaatttacaagcttgaagatcaaattttcaattccacaaatacttgattgattagagagtgggtaacaaaactgtttaccaaattgtccaccaataaaatgggaatggacagattttatctctactcagtagaaattattgtaattaaagggccatgttgtacagagacaactggctataatagaattttgtccacttctatcttcatcacctaaaacagtgcctggcttatagtgggtgctcacttaacaattgctgattgaataacgaatgcatgataagtttggtaccgttttcatgatcatagagtagccagtttatatatatgattaagaaacttgatgtaacttcattatcatggcccaaataggcttaaaaaattgtt

SEQ ID NO: 5633 - DNA, 522 bp, mus musculus
gaaataacttttgaaatcagattgcatgggtttgaaacccagctccactacatagaagcaagttacttaactgattggaacatcaggttctttatttatcaagtgggagcaatagtataattaggttgggtgcagtggctcaggcctgtaatactagcattttgggaagccgaggtgggcagattgcttgagctcaggagtttgagacaagcctgggcaacattgtgagactttgtcgctacaaaaaaaaaaaaaattacaaaaataagtcgggagtggtggcatgtgcctgtagtcccagctacttaggtggctgagtagaaggatgcttgagcccaggaggcggaggtggcagtgaatcaatatcttgccactgcactgcagcatgggtgacagagtgaccctgtctcaaaaaaaaaaaaaaaaaaaagaaaaagaaaagaaaaaaagtacaaatggttcataaggaatattgtaaggattatcttttctgttaacgccacaaaagaccaccagaataaa

SEQ ID NO: 5634 - DNA, 1342 bp, mus musculus
acaaggtccttttggtacacaactgggtaaaccactgagataagaatcctaatttgttcagaatattagacttttttctggttcaattttttgaataatatctaagcagaagttattataatcagagtaacttttcaaatataccatctccaattattaatataatttttaaattgttaaattatttctctataaaaaaatatacatgtatgcctgttaaaataggcctgatatggctggcagtttctggtaaagtgccaggccccacataacaggtattccaagttagaggcaaggtttaaattgaaatgcttagttaataatttgtaaaatggaatatagtgatgcaggctcatgttagttcaatatgaagagacattgtaataccacaccaagtaaacttaaaatgtggtcttactgattacagagtaatatatgttcactgtagaaacctttctaaaaagtacttatgaatgataattgctttattggtaaattatgatgaggaaggaacaggattaagtgaagcttttagctatatttcaaatattttattttttaaaaagacagaaaactctgaagctaatatgttaaaataattgactttgttacatctagatcatgggtatatagtttaatttctccatttttgaaatgttttaaaatttaaaataaaatattttaaaacccataagcataccacatagtgataattattaacattttagtgcttagcatttcagcttttgttgtatgaatatttaaatgtacattttgttataaatatggaattataattgttaaatatttttgagcaatgtattttacatttttccataggccatatacagtaaatattaattgcccaagtcaaaataaaaatataaacacaaatctaaatttaacattcttttgggaagaaagaattgcaattttatgcatacataaagaccaggtggtctttatgtctgaagaacaagagaaaattgggggtattataaaaaagaatgttgtcggtggttggagagaaagctcatttatattagtaaagctttggggaactggcaagcttaactggtgggtgatggcagcaagcaaaattagttcctagacttgcagcaagttatctcagtagttatagataaaactggtctcaggttataacaggcagtttcagcagccagacttgcagagaatttcttttctagagcaatgctgtgtgccctgagtaccttgtccccctggcctctagactctgatttagttgagtatgataaaaataatccaatttgcatgatcaactttcacataatatatttttaacagcacactattccattag

SEQ ID NO: 5635 - DNA, 594 bp, mus musculus
tataattatatacttaatttatataatttcttttttatatggaatatgtaactactatatgaactgttcagttctttgcttttttaacttttgatacattgaaaattactagaaattgttttctagaaagcaaacaaaaataagctcatttattattgctcttattttattatatttatacaaagcaggtacatttacaatatatattattcttttcatcttagtaattgtcttcaaaatcttctcacacattaagctgtctttccatcccaccctcaaaaggtagcttttccactatcgttagtgcccatgtatgagaaatagcttgctttactgaaatagtcattctacctatctttcaacaactgatatcatattactctcttttgagaactaactggagtcattaaagtttaagcaagaatctttaaaaaaattctataaaagtagtattaattaatcaaggcaagaaaaaattagcattgctctgttaaacattagcatctgagaaaattgcttaataactctacatcaaaaattttaatttatataatcaaaatatgacaacattccatgcactattcatttacattt

SEQ ID NO: 5636 - DNA, 1342 bp, mus musculus
tgtgtatgtaatttttgataggtatgaaaacactgactcttttattgccaaaattaccttccttaggacagagcattttgctattaaaaatatcaaacatgtattgaacatttagtgtaccagacattgtaataagtgttttacataaactttctaatttaacctctttcttttatctaattagactatcctgttctgacaatccattttacagatttatgaaaccaaggtttagaaaagtaaaataacttctttaagtcacatattttggtagttctagaatttgaacccacatacgtatgattttagagcctatcattttagtcatgatgatacatatactgccactatttttagtctcagctatttctcattaacagaagaaattgactgctgacagggatcatacttgtgtaaatatttgttaatgaccaagatttgcgagtatggttttcaaggctgacattgttagcagccacatgtttcttgcttttcaatgttaaattaaatatcttgaatgtgcaaattttaggactctggagtcagaacacatttttatgccagcctaaacagaaaacgcttaattcattttcaaaaagggatgaaagggaataaatgtaatgggcacctactgtctcccacaggttcccatggcagcatagcaggctcaagagccatcagacagtgagaaaaaaagagacacagaatgggaggtgctggatctcttacatggaatcacatcagagagaaagcaggagctgaggcagtgtgatgtctgggaatcgaagcagagggacagatcaggagagagttgggtaggcttccacagcacattccagcctcctcatttctcatctccctgacttgactttaatgatctcgggacacacttgccctctgtcttacacttgctaccctctttcatcaatttatttcattgtctcttttctgactttcttccctactaacttcatacatatggagacactcttgaaagaccctacgcacacaagtgcacacattcttccatttaatctcagcacaccttctcattgtattctgttacacaaactgaggaaatccccagcacagtgttaacatatcactatttaaaaaagaataaaatagttcagatattttagaggccatagatttatagcgattatatgtagacaaagctaaataaacctcatgttgcaaattatttgtattgataaacaatgaatatgtttctatagatcagtaagcaaatatacacacacatacacacatggttctaaacaggtcctgtaattgataaactgatcttttaaatgccgatcaaaatatgtaatctacagtt

SEQ ID NO: 5637 - DNA, 1034 bp, mus musculus
aatattatatttgctccccaatggaactgttcaaacacatcattaattaaacatatacaaaatatacttgatgtggctttttctttgggaaaaatacaaatctgaaagtgaatgtttcatatatttatattcttcaggtattacagcatataatctataagtttaaatattatgatctcttgtatttaattttttatttctcctttcagcaaatctgggtatatttgaaagtattttccagtacatatttttaaacgatataaaattcacctgaattagaacatatcccttttttcactttctctaaatctgaaaacttcatgtaaacattaacttttcaattattcactcataaaatatttattgaacagtaactctaaacacaatacacagcagacattggagataaagtggtaagcaacccagacattgctttgccctcacaatgcccccagtccagcaaagacagatattagtcaaataatcccacaatctcttttgcactcactattcaaggtgaaccctaccaaagaatgtagagagcagaaggaataatcaaagtactcaggtttactagactcctgcaatttccggccaactagtagagtccttgagtgagactttccctaggtcctctattaccaccctgaagctgataattggaacatatgaatcaatgtggagttacaacaacatgatttagaatgatacattttggagacagtgggaaaaccagtaggcctataatattcagaaatcacctatatacatgcttgattttgtatatttgtttacaacctgccagcgttctctgttttctcttttgtctttggtgaggatccccgttagtactattctcagtgatctgttttttttttgttgttgtttgtttttcctgccagtttccgaaataccactttttaaaatgcctaaatttgacttgaatgttcatattattatattattatgggaatggtttattgttttaagcttccatgtcttgcaatggataggttttctgtagtgcagttgat

SEQ ID NO: 5638 - DNA, 339 bp, mus musculus
ctgctctctaaatagatggtaataaatgaagacatgcttggctctctttctgagttttcactctacaccttagaacaccaaagcccgtaccttactttggatagacccatctggccctgccttgacaatctatatcaaacatatttcttagagtttgctaaagctgaagtttgaattttgtgtactagagcagaaaagaaaatgaatttagatttataatttaggcattaggaaacaatgaaaagtttaagtttaattttaattttaaaataacagatttgcatattggcatcatcactctgataacagtgtgaaaaactgattagataaggaagacaa

SEQ ID NO: 5639 - DNA, 769 bp, mus musculus
tatctattcagaattctgcaatttaccacagtctctgaccctccctattgtttagactgagtactttgcacatctacagttatcaggccactcaaagaatttccttatgaatcttaccattaaggaaaggggacacagactaaagtcataataacctgggtttctatctcagttcaacacttactgcatgtgtaatcttgaacaaagtattcaaattacctgagtctttctttaactgaacattgaattgatctctgccttgcacagaaataatgcctgtgaaatgtccagcttgataactggcctgccctttcttttctttttttttctttatttcttttctccttcctttcactttttttaaaagataatgcaatatgtaattattattatctaaacatcttagatatagattaaaacactttctcaactcgaatatgaacctattattagcacagtctcaagaggttaaagttgaaataatctgtcaaacggatcaaataagtgggcaccatccggcccctatttccccttcttccaccactatagaaaagtcttcttatgtaacattttcctctttttcaaatttccagtgatgactggaaaaaattcttcctggttagattagaaaacccaattttctaatgtgctattgcccacttcaagtattaagtgaagctccaaataatgatagcattatattaaagtaatagacaaaatagtctatatcatacaaaacaaaaataagaattaattttcaaagaaaaat

SEQ ID NO: 5640 - DNA, 331 bp, mus musculus
atgtacagtcaacttgatgtacagtcatcaggagctaaatcatcatccaagacctcttgaatgaccttcagctgtgccatctctgcccagctggtgctccatttgcccacaggcataagcttgcttgttcattttcacatcaaaattgctatatattgctttgtccatgaatttcttatcctctctgtcaatcatgcttgcttagctaagctccattcaagaactactatgataatatccaaataatctgtgtatccatgtcccaatgtatgaacacacacatctcccacaatttgttttgttatactgagaagcaggtcataagtactat

SEQ ID NO: 5641 - DNA, 331 bp, mus musculus
atagtacttatgacctgcttctcagtataacaaaacaaattgtgggagatgtgtgtgttcatacattgggacatggatacacagattatttggatattatcatagtagttcttgaatggagcttagctaagcaagcatgattgacagagaggataagaaattcatggacaaagcaatatatagcaattttgatgtgaaaatgaacaagcaagcttatgcctgtgggcaaatggagcaccagctgggcagagatggcacagctgaaggtcattcaagaggtcttggatgatgatttagctcctgatgactgtacatcaagttgactgtacat

SEQ ID NO: 5642 - DNA, 2015 bp, mus musculus
gaaagaggttaataacatggagctttagaggacagattagtcatgtagtttgagagaagttggggaaaattttatttaggagatatgacaaattctccttaaacaaagaaaagaaaaaagaaaagaaaagagcagtggagtctgtggaaaggacaccccagaaggagggacttgtaagcatatggttccacacgttagaatggttatatgatcctctgcctttttataaattagcatttttaagagattaaaaatttttatgtagatatatagaaatataaaattagataattattcaaagaaaaatatataggactattaaatgttgtaatacatttttctatgggctgaaatttggattgttgagcatacttgattcactttattgtgagaataatattccttgtctgcatgattatagaatgttgttatggtgagttgcacctcaagtatttgaatataaggtagttagtgttccttgagagaattgaacttttaagtcagtacttaacacgtaatatgaaatattgttttaaagagaccaaatgactccaagcctaaaatagcttaataaagtcattttgagtgttaacgttgctaatgaaagactcttcaatcaggtagaggaaatgtcagcagctaggacagcatggataaaggcaggtcacaggggcaaatgatggcagtatttatcaagtccaatgtagggcattgagcactcgatctaaaaacctccaatgacttatctagatatagatggtagatttttaccttatataatcagatgtttaaattttaactaactcgtccaagttcgatgctacatttgctaaagcaattttcattacaatttgactttccatggtgctgtactggagaggagttagcagccttagcagccatgtatcgtaaattgacaaatcttggtgagcaaaaaaaaaaattgtattgtttttaacaatgtaaaaaggcagttatttattttcaggttgcttaaattgaaacaataaacagtgtttcacggatgattgccatgttcccttttattctaaaggcagatgaaagagtgattctctcagaactggagaaaaaggcaagttcgagtgtatcactttaaattctgttatgatttttacaccttagatggcccctaaattacaaaacttctttacgatttcaaaactttaaagggaaagggagcatcttggttgtttgctggcagtattgttctatacagtttgggtaaaccctgggacaaatgcattggtcaggaattccagaactactgtttattttaaataatttaaactttttagatattaacttaaaacaaatcttatcccagctttcactcaaacaaaaatatcctcaaaaatgacagaataaaagtgatggttaaaagtatggatctgaaatttcaggtttaaactgttgtctacttcctagaaacctgtgggccaactgtgctcataacaagatctcatccagcaaagatttgcagcatttttccttttttgctatatctggcttttatttttttcagttctattgagtttaattaacaaataaatgaaaaatcaaagtttgtaccatttgaccaacatctcctcattttccccacccttcagcctctggcaaccagcattctactctctgtctctacaaattcgacttttttttttttttttttttttaagattccacatataagtgatatgtacagtatttgtctttctttgtttggctcatttcacttaccaaaatgcccttcaggttcatccatgttgtctcaaatggcagtatttccttcttttttatggctaaaaaatatcctattgtctgtatataccacattttctctatccattcgtacatccatggatgcttaggttgtttccatataatggccattatgaataatgctgtaataaacatgggagtgcagatatcaaaattgtgtttcttagggtgcaagtttaagagaaatactcaaaacttggcacattcacaaaagt

SEQ ID NO: 5643 - DNA, 210 bp, mus musculus
acactttataggggtcatctgctttagtggcataggtatcaaacaaggaaataattgatcttaattaaacacatatatagcagaaatatccttttaagaaaatagaacctgtattttgaaacttagaatttttaagaaagacttttaaaaatgcacttaagtttagccagttcaccactcagtaatccacaccacttgtgaggattaagt

SEQ ID NO: 5644 - DNA, 210 bp, mus musculus; identical to SEQ ID NO: 5643

SEQ ID NO: 5645 - DNA, 186 bp, mus musculus
aatggtagaaattagttgaatattggtattgtttatctcttttccattagcactctccttctgcaagaaacttgagggaaaagtacttatatgaggctgtacagctggaatggtcaccttgcctgggactgctcgcccaatcctatcacaagaaattacaaatctttacccccttcttttatggaa

SEQ ID NO: 5646 - DNA, 770 bp, mus musculus
taaccttgcatttttataaataagacatttagcaaaaatatcagtaaaagagatacactcttcgagggttataaattcctcaagttgttacacttaccccatctgaaaaattgtcacattttaatgactgcattaaaacttatatacattttatagcagtgatttgtactgccagtctaagtgcttctaactgtagcaagatgattctttaaaagcttatatttttattttctgatttccagcaaggttatagtatggctcacaaatgcactattcgcttttaggagatggatgttaatgtcactcattctttcaagcataatgaagaccataatcaaaactttacactaatcaacttgtttcaatctaaattagaacatttgtttcaatccaaatattttcatgatggttgtttatggccaaaattcaaaacgaaaagagaaaccaggattaaagaacatgtaagtgatcctaaaaaataatactaaaatcttcacttttatctcatctatcgggatctttcaggccaaagtttatgaatgaattttgtagttacttaaatagtaacaaataatatgtttatatactattaaacattcaaataatagtgaaacaaataatgactaattagcagatgaaaaagcctattcttctaagtccatattcttccaccatcaacaaacaccacagatcattacttaatctttgaaaaatgaacttatgtagtatatacaatgtattgcatatgctataaaacaccatgtattata

SEQ ID NO: 5647 - DNA, 666 bp, mus musculus
agtcagtagtggttcatttcatctgggcctagagttcacatgaattaacctagggagcctagtgttactgggaataggaagttagggatggcagctcttggttagatgacattgacaagtggtgcttttgtgcactgaagagaaaactttaaaaataattggcaaacttctcttccttggccttcctgttgacattacttatctcattatcttaataaggtttcgtgttagttttcacatctctctttcaatacatttgtcatcaaaggtaccattcttcttgccttgaatatatacagactaaatatctgtctctccattattccctccctcccttttcctgaagaacttggatcctccaataatctattactgctcttttggaaactcttttgcctactttaaaatccactggctccagtttattgtattgttggctgcaaagcaaagtactactttgactgtagtttctaactctattcctgtggcttagtttgccctttacctctagcaacatgatgcttctcacatcctctctgtcctgtctgcttatcccctcttattttcccatgcagcctgaggctggaaatgacttcttattttgtacttgctaggttgttgttacagtctccgtggccaaaaggttaaggaaaaccaggaaatatt

SEQ ID NO: 5648 - DNA, 393 bp, mus musculus
atttggtacttatggcctcagcaaagagtctgagcataaaataaataatgacaaaaattctgtcttttcatcttctggagttgacttaaacaggatgaggatatctacctatctacactttgcactttgaagatctagcatttaggtttgtttgcaatttgttctttctctatgtgtactaaaaaatattagctttctaaacataaacctcattagagtatccatttacatacaaaattccctaacaataatgatgatcactttttgagctcttattatacatcaatttacaatttacaattactttactcagtgcttatcactattctctgaagtagatggttatatcaccattctctgaagtagtctctgagtgaagtaattgtaaattat

SEQ ID NO: 5649 - DNA, 938 bp, mus musculus
acaaaccatattggaaaatattgatgaattaaactaaattaaatgcaaactgggaaacaagctgcagacagggagaagatattatatttgcaatatatataaatgatcaaaaatattaaactgtgtgtatgtatgtgtgtgtacacacacacacttatttattagtgctggtagtataaatcatccaaaccctttggaaaaaatctggcaatatctaatatggttgaagttgagcatacctataacacagcaattcctagtctaggtgtatataataaagagacatttgttcatgtgtacaaggagtcctgtttaaggctattcactgcagtattgaaatggtaaaaaattggaaacaacataaatgtctgtcaagtatgaaacagaaatataaattgtaaaatcataaaatgaaacaatactatacagtggttaaaatgaatgaattagatctacatgtatttccatggatacatttcagaaacatgtagttgattaaaaaagaaaatttgcaaaagcatatatacactatatgcactttaaaataattaataatttttaaaaatcactagacatttctattttgttgtggatacgtgtatatgctgaaaagtataatgataaagtgatgaagaatatattacatctttccgatagttgtttcctccgaggaacaagcagcaggaatagttaaatctacatagatttcttttatttttttaataaaagatctgaagcaaataaggcaaaatgctaacttttgttaaatctgcatagtattactgtcatagtattttctgtgctttttagtatgtttgaaatattattaaaagagaaaaaggatcataaatattagctcttttagatctttgctctccaaaattgtccacattctaagaccatctgttggaaacaagaaatataagaatttctatttg

SEQ ID NO: 5650 - DNA, 1956 bp, mus musculus
agaagtcattgatatttgtcttcataaaagtatatgaaaagttaactttttttcctctgtaaatccttaggaactaagctcttgatctcttaaatatagaaagataatattcacattctacctgtctagcttcttactgtattaaatttgtatcacttttttttttctttttaaaacagagatgtgctccggcatctattcgcctcatggacaacaagcagtttcagtttggtaagtaaggagtggtaattttaaaatgtcatttagccacagaaatttatgaaacatcagtaggaagagtacggagtgcagaggtagaaagaacgtcagtcttgcctttcaggaagatgtcagtctaatgaagatagacaattacataaatgagtgagggtagcagtgttggagggcctgtgaaagaagactgcactggataccatgggctgcaaatgaaggaattgattcttcttgattttgcttgaggataaagagtcagaaaaggcttttataagagagatgcttgagctaaatcttcaaaggtgaatataagtttgcctagatgtctcttcttcttctcaaccagacttcttcacttggcagcaaaaatgtgaaggtgtgaaactcaatgatgtgtgttaggggacttcaaattgttctatgtggctcaaatagagggtggggttagagttgttacatgagataaagttggttgggtgggctagggctttgcaggatagatttggattttgtcttgtcagcagtgggatttctttgaagaataaaatcaatcaactttacatcttagctcattctggcagcattgtgcaggatagattagaagggtacatgcatggaggagagacactaggagatgaaacagctcaagaagcaaagtttgagggctttgagcatggcagcagcaatggagatagagaacggatgatagattttcagaaaatcagtttgctaactggatgtggaaggctaaataaaaggaggagttgaagacaacacctagactgatttgattgggtagattaaataacatagaagaatgggtggtggtcttgggaaaaagatatgataatgggttgtagttatattgtgaaatttactttgggatttaagtttatagaatttaaataccctcaaaacaattcctaaaatcatgagagtgatcgttcagtaataaatactaaaggcaaagataggcaggcttttgtcatgtctaaaagtaagctgagattttaatttagggaagcatggttatagttacatagaaacttaactaaagtcaggttcgtaacatattaagagttttaaaattacattcttctaagttagtcataattgtttatttctttaagtaaattactttcaaaatactatactactgacaaaagtttaagataaatatgttctataagtaatgaaatacttaaatcaagtgaaaaaccacttgtgtgttttggcctgcatttaaagatctaggtcttaaagagagccatgcatctaattaataagactgtgttattcgtttatatgttattgttgttgtaaacaatgttagacctaggcatttgtaaaattagttatgatttggccatacttatttataattggagtccataacaatttaaagtgaaggtttaaagaaagtcttcctgtcatccctcttccatgttctcattactatacctgaaaacatacttacttgctcccctctagcttgctcctgtctgtggtattataggttctaccttctctagtctttactgtgtctcccctctctctgccctttacttagccaccaaagtgatccttttgaaatacagatctgatcatgctttttggctgtctatataaccttttttatttctcaattttaattgaagcctttacattaatatatcctgccatggcttcatgatcaagcaaaagaggaaataatgcttagca

SEQ ID NO: 5651 - DNA, 1830 bp, mus musculus
cgcataaattaataattttataagtatttagaaatggtataattctcttaacttcctctttcagtttttgtactaatgtttgtttttgttcgggaagaggagatttgcttttaatccttccaaaaaatgatgaaccaccgttccattcagtagtttgacaagctgttataatgtgtattttttcctcaattattcttgaaatatttagagcctctcctgcttctaacatgaaggcctttagatgccagtctgccagaaatctggaaacagaggaaccggtgaagtgaagatgtaatggagatttagctaatgatgtacttcacaatccaccttggatctcctgcatgtccaaatctcagtagttaatcaagtgtctgctgccattaacagaacagaagtaatggataacagaatggaaataagagatgccagaactacttccataactaactcaccaaatcaaatcatcagtcctcatattcttgttttatttaatacaaggagaagaggccatgcactttccaaaaggtcaaagccacatagaataggaaggcaatctctagtttaaagctttctcttggagtgttttctccccctgtcttcaaagggtctacttgagagatagtggtgtttactgctgcagcatgtatcacaagataagaaatgaaaaatcaatctttcttaccaccctgttctctttcccttttttatcttttcccttttgtcaattatagaattatagggacatttttctctgatagctggaagttgaacctcaaccaggtataaaagatgcataacaaccttttagcagtaagtgtcaagtgagtgagcactatgattatcaaggtgactttggaaaccttttaaaaatgcatttttgcaaaacaagataacatatattgataaaaagtgactctcagattggtaatgccagaaaaaattttaagaggactcaccaaaagtactagatctatgtaagttgtagaatagagtgaagtttttttatatatttgtggtagcctccatcttttaaactttttgaactcagtagaaaaacagactgaaattttaaagacatgcagtatttgtatcattttaaattctgtaacactgggaattaaatatactcaactttagaggacacttgccttactgtaatctataatcattttatattgaaaaatagggccagacattagccaaacggtaattaatttactagccataggtatagtgtttaatattctcttggggagtgagtctttactaagtgattactctatacttgataccactattaattgaggttcttttggttgtttaattaaatcagctcctttggatttgggccaagattgatccaccacatactgaaatccgttctacaacatcataatgtgtatttactagaaaaggacttgcttcataaggaaaaattattagaatatagagacttataagtacatttctagtgtgaaaaataagcatttgttagtttaagtgagacctgccaataacttgattgcaaatattaatatcatgtgaacatataaaatgggcccaaatccttgttcaaaagtgaaatttgcacgtttgtgaaataaaacacatcaatatcaatgactgaataccttaattcaaaacagcaaatggctaaaattatactatgcaagcaggaccctagtaagttatgtgggaaagcatttattgctgctaatattttattttcaattatttcattaggagagtcaaatgcttaagatagaggacacatgactaaaagtttcaccagcactcatggcatctgctataaaacatgtgtccaca

SEQ ID NO: 5652 - DNA, 2084 bp, mus musculus
aaataatgactgcaatttatggaaacacatcaaacttattaacatctgttagtgcataatgatagcaaaaagttttaaaaaagaaaataagctttctgttacccttgaaggatatgagggtataaattcattctgtaaactgatgagtaaagggaaagaaaacatttatgctgtcgttcctgtacaaactgtaattcagtttgttaaccaaatagttgatacgtaaaatgtctgctctacagaagaattccagccaatacatggagaaggaaaaaaagacctaaaccatcactcttttgtcacggtttctcaactaatgaatctaggaaatgatcatcaattactgcccatacaattaaatgaaaggttgatggagaatttttataagatgaattaggatgagaagaacaaaacctactaattagcaaaagaaagacagcagaaattactcaccttctgatgtgatatagaagtacaaccccactcatgaaatatacttgccaaaaaataggacatgtatctgttcaaacctctaggtctacccattttcaagaaactcagaagaaagaggaagatgtcacatgacaccatggaaaccaatcagcaaaatccaaaatgtaagacattctacaggacaaatgactgaaataagtggcaaaagataaaaaagggggaggactatcaaaaaattaattaacagattaaaataaattaatacttaaagacatttcatccagatagtctggatcttgatttgaacaaagcaactttgtaaaaaagaactttgagggagtcagagaaggttaaatatggaccaattattagataatattaaagaattactgataattttaacatgcgataatagtattgtgataatggttaaaatgagcttatctcttagaaatacaaactgatgtatttacaaataaaatgatataatgtctgagatttgcttgaaaataatccagctggggagaaggaaaaaaacatgtttgaaaagtacaatgaaataaggttggccatatgttgataaatattaaatctcgataacagaggcatgaggatttctattattgtaactacttttagataactaaaatatctaagtttgtttcatggtaggcaaagagacatagaaagtaaatgtgggaagcaaatgctgaaatatactctacctacactttcttgctactatttgtttttggaaaaaaaaaacttgatcaatagaaacacccaattttgacatttgtaaaatattaaatacaaatattataggcagtagtgtgctagtaaatagctctctgaagaaaaaagccctgatttgtagtatttaccagtttgcaacatgtgaatactcccaccaaggctgatttcaagctattgatgggacctcgtggaatgtggagttgagaagagatgtgtactctgagcagccagctccagcccacatctggagagatgacagataagcattagtttctggaatcacattatggatcttgggtaagatcccagctctaaagtgaaccctctgtttcctcttgttcagctaagtttttctgagcattagtttccccctcttaaaatgaggataattcctactacatcaagacaaggattaaatcagatcatccatgttatggacctagtatggttccagttgcaatgagtgatccttcatgctaatatcgtttcttctcttcaggttaaaatagaagggagaagaactcttggtctggggcagtttcaaagtttcaaatgaagggaatgaagctgatcatcttttcagaaggcttcctgcccagaatttctataattagttaaaattacaggtttcaggcacagtgtcacaaacctgccagaaactcaccaagctctaatttggttggatattaattggtaggctaagaagtgaatgtgatatgattgcagctagaatagaactatttgttaaaggtaggggtttctgtccaatgtgatctggaattgcaagtacacagtaacaattaagtattatcttagacttgacatggtgaaaagattataactttcctaatcttcttctggggaatgttgaggcc

SEQ ID NO: 5653 - DNA, 2084 bp, mus musculus; identical to SEQ ID NO: 5652

SEQ ID NO: 5654 - DNA, 1020 bp, mus musculus
atcattcagttgtatataattatttcttttccgtggaaatgtagctttttggtcaaagagggtgatacttctatcagacagttcaattctgtggctttctattatttcaaaataaaattagtgagcaccttccatgtgtcctccagaaatttgcttttgcatgtggggaaaagatgagggtgagacagctttgcaagctgcagagtaacctggagcagtgtctaatactcactgatattagctgggcttttgtcgttcacagatcaggaaaagaagacctacaccagcatcacttgtgattctcaatgagcataaccccccaggtaaagaagcatgatgtgtttcacactgatggaacagaatggaattgtttaaagaacatcaaagtacatgtcgtactgaaaagtttcaatttaggatttcacagttagcaatactctagaaagctaatctataaaatggatcgtaaacagaatcagaaataaatattacaggaataatctcaagccacagcctgtatttcctctagaatatcataagtgatgatatgctatgaaatattttgctagcactggctgtcatatgttcaggtgtttgtatggaacctggattactgcttattaatgaggctggtggaaagctgtttaattaggtttaaaagctcaaattacagccctagagatgcttatatctttacagagtaagttttttatatggaaaaggttgacatggggtgggcaatgacccagcgttggcttcagctttgctgatgacgtcatctctgaataatgcaattgacaagtaaccagatcaattttcagcactgcctatttgagagccattctgaatggctgaatccatttgttgaggttttattttccatttcctgtaaaaatgaaaaccgcattattattccggataaaagactatgatctgtaatccacaaacattatttacttattgaagcggggtgatttttagtctcacatttaagtgctgcttctggatatacaagtagga

SEQ ID NO: 5655 - DNA, 1020 bp, mus musculus; identical to SEQ ID NO: 5654

SEQ ID NO: 5656 - DNA, 1020 bp, mus musculus; identical to SEQ ID NO: 5654

SEQ ID NO: 5657 - DNA, 1211 bp, mus musculus
cttttggaatatactttgtcatggaactcagactgtttttctctcaaatgaaaaggattggtgtctctttttctctttctttttaaaataaattaatgttattaggtgggaaagtaaaatgatttcaaggctgccatgaatgaagaattttatgattaagtagaccctacaactccatgtatctcttaagtctgtgatatcactaacatgtatataatttctcattaattagattctatttcatgacagggagaaatcagaaagcttttcataacatggcacagtatttatttccctcacaggtctgatggcatcgtactttgtatccaaatctaaggcttttacttttttctctttctccacagttacagaatgcatcccctaagcaaaggaagcagagtgtgtacacaccacccaccataaaaggtactgttcaggtactgtttcgggttgtcatgagtggtgaatcatggctggtcggccgtctgttctctaggaccacatatctgatgataagctagatctagtctcagctctacaacttaacagtgttatgttcagtaagatatcttatctacttaaaacttagtttcatcaagagtaaaatatggggttgaaaaagaaatagctagtgatctcagaatttcagtctagaaattcagtttccaaaataatgacaaagatttttttttaccgttattcgcatacttccttaaagagattttcccagaagccctaattactcttgccagtgttggcagatgattactgtttttctcttggctaaagcaaagcagaataacttgaatttcagggagactgaggatgaagtgttgcctcattgtattgtgtcaggagcagctctaagaaactcaatcaaaccagctattcactgtacatgtaactactgttgaaacaacaactaagaatctagttcagattctgaaattttccccagaattggaactgctaaaagaagacctgtcagtatcttgaccaacatcagttccagggaaagcatctcttatttctcacactgaaatgttcttgatttgaggtagagtctgtccagtctactctctcatgttttttccagtctggtgcttgggctgtgggcccagtggctgatcatactcaatttgtccagctcagtttcaactgcatgagaggccagctgagcagcttcctctggagtttggagagagggctaa

SEQ ID NO: 5658 - DNA, 1211 bp, mus musculus; identical to SEQ ID NO: 5657

SEQ ID NO: 5659 - DNA, 1211 bp, mus musculus; identical to SEQ ID NO: 5657

SEQ ID NO: 5660 - DNA, 988 bp, mus musculus
cacaaaaactataaccctagctctcccagaatatattggtaataacaaactattaaagtaataatgagaatggtaaagcatatagtctggctgtggattccagccctttggagctgcttggaatataaatcacttctcagtttgcaaatttattcccctcagtgagatactgtatataaaacacaatgtctgatttgaagagtttgggcagaggaatggggagaccctcaatttcttcacttttcttaacctgtcttgcctccattagtggggctatcaacactgtatcacctgatggccttagtctgcacctgttgctgctgtcccagatggcactcatcttggtcttttttcctgaggtctcatcttgacagtgctgatgtggaagacatcccattcctgaagtccattgttgccatgcttgttgaagtagtggaaggctctaacttcttacttggctcctgaaagtgtctaagcttttactttactttttcaagaaggtatagacaagtccttgagatgagagaaaaagctatctaaagagaaacacagagagctacctctaaaagtgctgtgacaagggataccccagaatgatgtcaagccacactgactcttttctctcagacatgatccatttcccatttagagagagactgtggcagtgtttatcttctcttttgtgaggagttttaatttctgtatgtcttagcccagttttctacataaattctatttttctgttggaattctatgttgtctttgtgtaagtagagctttacagcatcagcttgggcagttgagtgttcttggtcatcgtcttctccttaatctttttggaaagagtaagccagggagttttattagggtttatgtatatataattgtcctcatattctatcttttttctgtattattgaggaaaagcagtaacctgatagaacttgtatatatcatcaagaggactgacctaataagcacctactat

SEQ ID NO: 5661 - DNA, 988 bp, mus musculus; identical to SEQ ID NO: 5660

SEQ ID NO: 5662 - DNA, 988 bp, mus musculus; identical to SEQ ID NO: 5660

SEQ ID NO: 5663 - DNA, 179 bp, mus musculus
taatgttaagagcaaatagattatgcagaagaataaactaaaggaatgatattctacatcaaatttttttcttcacatagtaaggctgagcagaccaaaataaacagccagagaagttggtcatttttacttcaccattcacctatcctagcctcattctcccatctcatagtaccttt

SEQ ID NO: 5664 - DNA, 12882 bp, mus musculus
atggggtatattaaatgtgatcatttactacgccatcaatgaactgtatattgtctttatacagtgaattgattaatctgatgttatccttagcatacctaaggaagatgaaataaagacttcagatactattaatggtaactggaataagaggaacagaaaccaatgttctaagtagttcaaaagtttgtttttccactaaaataactataaactagtaatataaatataaacatattaataagcaaatacaacaggtatcattaaaatatcatttgcctattaatgttgacactttaggtatatgtgtttgtgtttgagtgtacatacctctgtgtgtgatgtttaaataagctatactgcaatgggttggcattagcagaatgaaatttcaattcatatcaatcaaaattcaattcatatcagtcaaaattgaatgtgatgtagcagctaaaatgtgaatataaagaaactaggagaagctgtgtcgttacccagatgttgagtctgatccaagtactaaatgactgtgtgatttttaccagattatcaagcctctttgaatttccagatctgtctcttcaactaggaacaaaggtttttgaatttaattttcattgagttcctgtttaaatataaagatttaaaatttgtgtggttccttttgtactgcccaaattgaaatcttataaatcccaacattcagcattacattgttttatttatatgcaggttttaaccaggcacattgactagagttatttcaaaattttagaatacacttgtttaacaacccatggtggttgtttattcattatttctccatcatacttaactccattagaagtgatatgatattactaaacatttgcttatctttacagaaaatctaatgatttacacaaataacaaagaagttcccagatggtattatacatggatgttcaaatgaagagactaaaacttttatactttatgaatattagtgagataaataaataaagattagggtttttttgaaataaagattaggggtttttgacatcaataattgggtcaatttgtagagaatagattttcactgtgtttttttttgtactcatcaaaacattatacttgtgttatttcatatttaagtatctaccaagatctacttttgtaggactcagtgctcttgattaaggataataaatactattgtattctgctttgtattttgcattatacaaatccacacacttttttaggcaaaacaagaaaaacacctgtaaagcccacatagttctaaagcatttggaaaaactacaaaacaatctttcttaagtttttgtagtattggaaataactgtcaattaaatacatattaaatataaacataaaataaaatatacatgtataaatgtaaacatatatatacaactgtcccagattatacagcagttgtataatgtagcatttttagatattttgggttatactaataaggatttgagcaaaatattgagcaaagccctaattgttttgtatagaattcaacaggaaaaagcttactgagaaataaaagatgtataaatttgacctaggcatatatatgtacttaaaaacaaattgaaaattaatctttctaagcccccaagaactccagagataatgataggaaatttgtaccttcaagtggccaagcttcattgtactataatgtctagttctcagtccttcagatactttccatgattaagccaccacttgcagacttagatccattccagcctatgaaaattttttgttttttcagagtaaatttcgttcaatagctctatagcttcctattaaattcacaaaactaatggacatttttcatcattaaatggtgtggtgatcccatggccacctttctgcattttggtaagttttagtaaccaaaccaccttcttaatttctattatcttacgttaatagacaaattgttgctctcttcatgcaatcttctttttaaaaatcagtcatcacctgatgtccaatcaagctgcttcccacccttgcaagacatatatcactacaattctctcatgctgagaacctactgctttagatatatgactgtacctggcttaagagttccaaaatgcttcatctgtttgctatgattccctactcttccctaataaggaaagttttactattggctttctctgcattgtgatcatttaatttccagctcttccttaattttccttctctacccaaaaaactccttgttctaaatctacttagatgggaagaagaaaggagaagtttctactttctccatgtttagggttggtttttcccacttaaatcagaagaaaccatttttccacttattggtgagtaaacacaaaagagacaaagcaagaataagctctgactctaatttctactcttccagatgtaatgtgactgtattacagatttgagacagatctaattaattcctgttatcctcttttcactcacaaaaatgtccctatttgagaaataaaatatatggtaaccttagccagaggtgtggaagtcagttaatacaaacaaaaaacttccgaggctatgactagaaaggaagcagattaaaatgaaggtaaacctcataaaataagaagtgcaattgaaaatggttagactcccacacattaataatgggagactttaacatcccactgtcaacattagacagatcaacgagacagaaagttaaaaaggatatccaggaactgaactcagctctgcaccaagcggacctaatagacatctacagaactctccaccccaaatcaacagaatatacattcttctcagcaccacaccgcacttattccaaaattgaccacatagttggaagtaaagcactcctcagcaaatgtaaaagaacagaaattataacaaactgtctctcagaccacagtgcaatcaaaatagaaatcaggattaagaaactcactcaaaactgctcaactacatggaaactgaacaacctgctcctgaatgactactggatacataacgaaatgaagtcagaaataaagatgttctttgaaaccaacgagaacaaagacacaacataccagaatctctgggacacattcaaagcagtgtgtagagggaaatttatagcactaaatgcccatgagagaaagcaggacagatctaaaattgacaccctaacatcacaattaaaagaaataaagaagcaagaacaaacacatttacaagctagcagaaggcaagaaataactaagatcagagcagaactgaaagagatagagacacaaaaaacccttcaaaaaatcgatgaatccaggagctgtttttttgaaaagatcaacaaaattgatagaccgctagcaagactaataaaaaagaaaagagagaagaatcaaatagatgcaataaaaaatgataaaggagatatcaccaccgatcccacagaaatataaactaccatcagagaatactataaacacctctatgcaaataaactagaaaatctagaagaaatggataaattcctcgaaacatacaccctcccaacactaaaccaggaagaagttgaatctctgaatagaccaataacaggctctgaaattgaggcaataattatagcttaccaaacaaaaaaagttcaggaccagatggattcacagctgaactctaccagaggtacaaggaggagctggtaccattccttctgaaactattccaatcaatggaaaaagagggaatcctccctaactcattttatgaggccagcatcatcctgataccaaagcctggcagagacacaacaaaaaaagagaattttagaccaatatccctgatgaacatcgatgcaaaaatcctcaattaaatactggtaaactgaatccagcagcacatccagaagcttatccaccatgatccagtgggcttcatccctgggatgcaaggctggttcaacatacgcaaatcaataaacataatccagcatataaacagaaacaatgacaaaaaccatatgattatctcaacagatgcagaaaaggcctttgacaaaattcaacaaccccttcatgctaaaaactgtcaataaattaggtattgatgggacatatctcaaaataatgagagctatctatgacaaacccacagccaatatcatactaaatgggcaaaaactggaagcattccctttgaaaactggcacaagacagggttgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatttccttaaactcatagacaacttcagcaaggtctcaggatacaaactcaatgtgcaaaaatcacaaacattcttatacaccaataacagacaaacagagagccaaatcgtgagtgaactcccattcacaattgcttcaaagagaataaaatacctaggaatccaacttacaaggaatgtgaaggaccacttcaaggagaactacaaaccactgctcaataagataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactgctttaaagttcatacggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataatgccgcatatctacaaccatctgatctttgacaaacctgacaaaaacaagaaatggggaaaggattccctatttaataaatggtgctaggaaaactggctagccatatgtagaaagctgaaactggatcccttccttacaccttatacaaaaattaattcaagatggattaaagacttacatgttagccctaaaaccataaaaatcctagaagaaaacctaggcaataccattcaggacacaggcatgggcaaggacttcatgtctaaaacaacaaaagcaatggcaacataagccaaaattgacaaatgggatctaattaaacttaagagcttctgcacaggaaaagaaactaccatcagagtgaacagacaacctacagaatggcagaaaatttttgcaatctactcatctgacaaagggctaatatccagaatctacaataaactccaacaaatttataagaaaaaaacaaccccatcaaaaagtgggtgaaggatatgaacagacacttctcaaaagaagacatttatgcagccaaaagacacatgaaaaaatgctcatcatcactgtccatcagagaaatgcaaatcaaaaccacaatgagataccatctcaccccagttagaatggtgatcattaaaaagtcaggaaacaacaggtgctggagaggatgtggagaaataggaacatttttacactgttggtgggaccgtacactagttcaaccattgtggaagtcagtgcggcaattcctcagggatctagaactagaaataccatttgacccagccatcccattactgggtatatacccaaaggattataaatcatgctgctataaagacacatgcagacgtatgtttattgtggcactattcacaagagcaaagacttggaaccaacccaaatgtccaacaatgatagactagattaagaaaatgtggcacatatacaccatggaatactatgaagccataaaaaatgatgagttcatgtcctttgttgggacatggatgaagctggaaaccatccttctcagcaaactattgcaaggacaagaaaccaaacaccgcatgttctcactcataggtgggaattgaacaatgagaacacatggacacaggaaggggaacatcacacaccggggcctgttgtggggtggggggaggggtaagggatagcatttggagatatacctaatgttaactgacgagttaatgggtgcagcacaccaacatggcacatgtatacatatgtaactaacctgcacgttgtgcacatgtaccctaaaacttttttaactttttttatcctaaaacttttttttaaccctaaagtattaaaaaaaaagaaagaaagaaaatggctaaccatagagagaaaattcctaggatccaagtaatttcattgaaatgaaatgaaacaggtaaagtgaaagaaaaacatcacattatggtaataaaatgaaataatatagctattaaaggaaataaagactaagagaaggaggataaaagaggaatatgatccaggatattaggagaatagagacgcaactaatgaggaaaagaaagtaaaaataaagggattgtttgcaggaaaggatggattgtcttttagaaattgtagaaatcattcaaaatgcagttaaaagggcagaaaagtgaaaaccagaaagacattgaaaaagttggaggcattttattagcaaaggaaattttagtgggaagaggaatatatttaagataactctacaaaaataagatgatactcaatctgagcttttaatttttatattgttatgctgcttcattttgatttaaatatctcaccaataaaatgtacttaaattttatttttaatagtaattttcacgtataaacatgattttaaatgtttataagaaatatgaccaaaggcaagaaatctttaaaaagatatgcagtatcaccttaaagagttacattcaattgtcagtgtttcagaagacaagaaacaatctctgcaacaaaacaaaccaaaagaaaacaacatttaataattaggtaagtgacttccaggaaaatccacatgttatttaggacaacaacatatattaatagagtactattaagtattactaaaaagggaagaagaaaacaattaagattattgaaaaatgttttcatagaggtaaaagaatgggtgggaggaacttctgacaattaaaatttttactttgatagacttaatgaaaaatgtaattagaagggagtaaagtagttatgaaaaaaataatgaagaataatgtaacgtgacttttatatagctttataagaaatttgtttttaaacttttagaataaaaatgtacttctcatatatatgtatacatacaaaaaatgtgaagcaatttattgtgtgaaaactcactaaaaattgcctggtgtcatgtccaatcgtatcaaatttatcacatcatcatctgaaaatatcttataagaaataaactgtaaatcatggttttattgaacttgagttcagcggtgtctctcatggtgtcttatggtaattactgaatttatgaagatactaaaaaaggctatgtcatttattttctgatgaagtttatagaaaatcaatccaattgatagtttgtaattatgcagaatgctaatgctaaatgggtatatagaaaattaactgtttcttcctaagatactcaagtgttaatttttttcccctagactgtcaggcctatgagtaaatactaaatctattagctgtctccactcataaaccaaaccaaaccaatacaaagatattaaatgaggagaggaaatgtagtaaaaatactgtctgggtcttatggttgggatgagtgattttataacatattatggtgataattttattctaggattttatttttggcctaatataggaatgtttaaaaaaggcttttctatgaaaattataaatttatacttgagattaaagtctagaagggggaggaccttaaagctaagttaccagtaagacaatgaataattcagaagagaacactactcttttactgactgagtgcccaagatgccaatttccatgaagtcttgatttatatagtaaacgttatgcacatatatgtgtgtgttttctaacagttattttttaagctttagagataattttagactttcagaagagttgtaaaaatagtagagttcttgtatactctgcacccaccttgcccttatgttgacatcttacataacaatagaacatttgtcaaaattaagaaattaaccttgatataatactaactaaagtagaaagtttaaaaagtagagattttagtcttttcactaacgtccttttactattcgaagacccagctttgcatttagctgtcatgtctatgttgtgtcttccagcctgtgatgtgtatcataacaggggatacctgatgttgtaatgtatttctggtgttgttaactttgatcactgtgctaaggtggtgtctgctaggattcgctactgtaaacttactgtgttttccttgtaattattgaatatttgctggagataccctgagactatgcaaatgtcccatttctgcttaaacttttgctcattttactatccattggcagatcttgcttgtggcaattactactgtggtgttctaatggtgatattctgtttctctcaatccttctacatttattattggaattcttctgtaaggaagagttgtcacgtctggatttatatttttaactataataagatattcaggataagtatagatttagaacttaaagatgttaaatcatgttaaaattattccaaataccatatcaaagaaaactaagttggtaatctatctcagaaaatatatgtacttaagaagggaaatagtttttatgatttgtagaattgattcaactttttacttaatattgactttggactgaattcaaagttttcttgaaattctacatctggactttttaaagtgtctagatttatattactttggggatcattttgtcaaagtcttgaataaagttacccagtcctggcatgataaatttaaaaaaaaagaaaaataatttaataaaaaagaatgagacatgattgtgtgtaattatagttgcccattgaacatttaaagtttaaaatgattatcaagagagggctaattcaggagtcaacaaagattggtctaatatagaagtgcagaaaggaataagcttcataaagttctataacggatgtgctgtaatggatgctatttacctagtatactagcatacctttgtactacctggtcatctctattattgattctgaagcatcattattgttactagagtgtgatcccctccaggaaaatttatataagtggccataggagtagaaatgaaatcttatccaaaagaactaaaattcaatgcagaaaatagatatttattagcatctaacttctgttttttcatggatttatcagccatcagcttgatgctttatacttagaaacaattacttaataaaaagcatgtcaagaagggagtcactcctgctttttgtttggtatgaatgttatatgtgactacttctgcatgttcacttcatatctcttattttgtatttaaaaatttctgtttgaggttttagaagcagattttagaggcaatgagaaatgagaaaacaaagtgaagcctcctcttatctctgtccccttccactctgtccagtcccatccatggcatgcatcctaatttatgctaaagaaaaagtgttagttttaagtacacgcttctgaaataactgaggtcctcagtttaccttggtgaaaataattctacatgctcaggagataagagatattatatgctctctaaaacattttcagtagtaagatgtagaatgagagaagtaaaataattccatttgaaaatactcgtttcaagttatagtctttaagacagtgtccgcattaatagtatcttggcatttcctgttgcctatttcctcagccaaaaaattaatgttgagagtttaaaaaaagacatggttaaagtataaaaatacacagaacaaatttatgtatttataggttatcacaaattttataaagaaaaattaggtaaagctgaaaaatatgcttaccatttgaggagaaaatattacttcatcatgtaggcactgtgatggccactgaagaaacattttctggtacatgttatacatcccaaataagagttcatttttctcatagtaaacaaaatatctgcatttataaacacaaggacatgatatttataccttgtatataataatagagcagtttccacaaaaaataggataaatatttgtttggtttgtttttatgtttattaggtaaactttcttttaacaaatctttgtctttatctcatcaagatcagaaatctttctaaacgtgatctgtagattttatttatgtatataaattaccctccatactttgaactaatgtgatcaatgaaaaacttaaaaaattaaaagtttgaaataataaccataaatatattaaatatactgaaaaattgattcagtgttaagagttaaaagcataatgtttaaaatttaattattgaaagaatctacagaattggtttttcaaattgcaggctttttaaagacaggatcattatcaaaattctagaaattatcaaaaaccaacagcaaaaagtaaattaaatagtccttctcgcttagacttaattggcttacaggtgtctttcatatgatctacatgtctgactttgccttatttacttgtaagctctttatatactgatagggctctctgtcttagaaagcttgataaatgcagagaccttatctatcctataacttgctttacttccaacatccagaaaaatatcagtgttatttcctccacagtctatggtctgaacaactacacaaattatacaaaacccttcaatggcttgctatctcatttaggatataaactctaacccttagcaccacctccatggccttacctgtttttgcttctacctttcttttaatcttaccctctccagttccccacaggcacactgagccaagacacaccagcactgtactcagcagaaatgcactgagtgtaacattcttaagttcttgctgtttccactcttcctggagtgctgtactccagacatccccatgactagaacttctctttgactcaggcctccacaccaacaccatcttatcagaggggcattacctaccacctcatctaaaagcacaattccccctgctcactgtgcaatgtttcctcaccctgtcttattgtacttcttgatggttatgtccaacagacatttacatgtttagttaattgttcttttatttttggaccctatcttctgtttgagattttattcatttcaaactctgtaggtcatgagagagcatatcacaggcattcaaataaatgtttgttaaaagaagaaataaatgactggataattatcagaagagctcctcaaagaaacacactagtagtcccgagagttctccaggtgtcttctcaagagaatattctattatcttctgcttggctaactgctgcttcagactatgagattagtaacacattaatatcagaaagcagactcccatccaaaagtgaggcaataacaaatgctctcaaggatatgggggaaagggaaccctcatacactgctggtaggaatgtaaattagtgcaaccactacagtgaacagtttggaggctcctcaaaaatctttaaaaaaagaactataatatgatccagcaatcccattgctgggtatgtatctcccaaagaaaggaaatcagtagattgaagagatatctgccctcttatgtttgttgcagcactgttcacaataactaagattgggaagcaacctaagtgtccattaacaggtgaatggaaaaagaaaatgtatttatacacaatggattactattcagccaaagggggaaaaaaaaagaagaacgagattttttcatttgcaaaaacatggatggaactgaaggtcattatttaagtggaataagccaggcatgaaatgacaaccattgaatgttcttgcttatttgtgggatctaaaaaccaagacaattgaactcatggagatagagaatagaaggatgactaccagagtctgggaagggtcgtggggcatgggggagggaggtgggatggttaattaatacaaaaaatagttatgaagaatgaataagtcctagtatttgacagcacaacaggcagattatagtcaatactaatttaattgtacatttaaaactaagatagtataactggattgtttctaacaaaaagaataaacacttgaggggatggatacccgattgtcagtaatgtgattatgcattgtggttacatacctgtagcaaaatatctcatgtacctcataaatatatacacctattatgtgcccactaaaatttaaaaaaaatgagaagaagaaagaggactcccattgctacttcaatcactcctacctctttttaagcatggcaatagaacagaggttagattttggcatttgacattagtttactgaaggttgaataaaatcaacaggacataaaatacacaggagactgctgaatttgactatagttagaatatgaattagttgaatatggttgtttgtttgtttgttttgagatggagtctcttgctctgtcacccatgctggagtgcagtggcgcaatctcggctcagtgcaaccctctgcctcctgggttcaagtgatactggcacctcatcctcccaagtagctgggataatattgtttttattattatacattcttttactattatccctgagactatctgttatatttacc

SEQ ID NO: 5665 - DNA, 123 bp, mus musculus
ggaagcttgcttgtctaagtgtgccaaggctgcaatcaagcccttcacccattctttcaagctgccacctttgtgacagctgcagatgcagaagagctggctgctgtgccaaggtaaaaaggg

SEQ ID NO: 5666 - DNA, 352 bp, mus musculus
tataataaatcataataccaaaattttgatatttcacataattttcatgtcttacatttgctctagtggaaatataatttgaaaaattacagaaaactagctcttcatttattaaagttatttatttttaacaacacttgggaattactattcgttaatctcacactttaagaaacctgccagtactaaccacaaaatctgtgagttgaagcagatattaaaaaacagtagcacagaggttagaggtacaaagacttctcacttgttgcattgcaggggttcaataatatgatataaattaatccagccggcctaacaagagatgatacctgggttctctggccctcaggag

SEQ ID NO: 5667 - DNA, 206 bp, mus musculus
ccaatgggctgcctgtggttcccataatcggtcctaaaaaacaaaaagagtctgagggcaaagagttgtcccagcgtggactccacgcaccaactatgttttcaggattctatttgttgatgttaaatgtcaaaaactaaaaaaagattatgtctatagttgactattatagaccataaaatattaacaaaaacacagatatataa

SEQ ID NO: 5668 - DNA, 1075 bp, mus musculus
caatatgattacaaatttacttaacagtataaattagagctttcacaactctgaagttcttttcctactaaacaaaccttggaacatatggaaaaattctctggctggcttaatcacttaacttgacctcttttcattatttgcttggtctgtcctcaaaattaaaaggaaactattatatttcatgatgtaacatgcagttcaattatcagtaaataatttaacaagatctgaaagagattaaaaatgatttgcttaacagctttggttaactagcatcaattgtattttagtgaagatatatttagaaaaagctaaatatatagagagaagtacttgctgaatcagccaattagaggcagtatgcagagaaccagtgagctgaaaccaaggattacagttaaacatacttctcctgagaacaatgtcatcatttcatctcccagtatgagagtctatctaagttgactttcagctatatttgcaatggcattatgcacatgccttgccatgattcatctattatggaatttgagacctcttggtgaaagggatgattcctccataactacctctcaccacgtgtctgctggcaaggaaactttgataggtcctttgcaaagtagatgactcaagtgaattgcactaccaaatgatttggtcattgctagatctcatggagtgtacaggtgcccattatgtgtttgaatggctgctaacctaaacttgctgctctatctttgacaaacccaggggccatacacctgcccccttgattaggaatacacaagtttacacagtgaaaaataccaccttattcctagtagcacaattttcagatcattagggaatagggtaaagaaggaaagctataaaagtggaattatttgcattaataaatattttgtgagttgaatactttttaattattgatgtcaggatgatttagttaccactaagagatatttcactaagatactttttggaactctgattttgaagcctattagataagcaacaaaaataatggtaatgttggatgaaatgtgtttcaaatatgtggggtttggaaaac

SEQ ID NO: 5669 - DNA, 445 bp, mus musculus
tattttaaggcaagaaacatgaggtcaaaatagccaccaggttttcagtcctccagttcgttaattcaagttgaaagggattgtttctttgtagttttttaaaaagggtgctgattgtattttctttattttaacttattccacattcccactcataagtgaataattactattaggatcatggtactgccattgaccagtcctggaactacagctagggtcacccttagccaaacataactaccaggaaagaggaaaaaaaaaaaaagtctgcaaaggaaattcagggtgctattaccagaatattttggtggaggggagggtgttgggtggtgacaggaaagcatagtgtatgtataaacaagttaaatgcagggtgcagggtgaaatgcacactgttatgtgaaaatgctactgagcaaaagagcaacagtttaaatggtaa

SEQ ID NO: 5670 - DNA, 445 bp, mus musculus; identical to SEQ ID NO: 5669

SEQ ID NO: 5671 - DNA, 220 bp, mus musculus
tgtgaaagagatgcatacagtgtggttcactgagtatgaaagaagataaaagctgtgtgttattaaaatattctgcattgacttttatttcctgtagatgtaatcagtgtgtattagttttttacggaggctgaaacaaaacaccacaaactgggtggcttaaacagcagaaaatattttctcacagttgtggaggctggagttccaagatcaagatgcc

SEQ ID NO: 5672 - DNA, 220 bp, mus musculus; identical to SEQ ID NO: 5671

SEQ ID NO: 5673 - DNA, 173 bp, mus musculus
tatttcatgattgctgcaactaaaagtttcataacaatgtacacacacatttacaccttctgtacatttatgcttccaaagaaaatctatggtagttttcatttggcggcaagtaacagaaaacccaagctaaaagtagcttattacaatctaacaattaattgattctatac

SEQ ID NO: 5674 - DNA, 224 bp, mus musculus
catgtacctggatttcaatgacagatactgttggaaaagcactatttgtttttgaattatgaactatgagtgttaaggcctttagttgctaattgttggctttcatgttatcaaaattatatccttcatataagacttcatataagacttttttattatcactgaaatttgattaaatctatctggttgaagacagtaatttttctgtttcaagtagacaatca

SEQ ID NO: 5675 - DNA, 1294 bp, mus musculus
tccagtaaaatatgctttaaattcctttatattagcaaatccctaactgtattagagtgaatgtgttcatttgcttgggttaccacaaagtaccacggtctgggtggcttaaaaaacagaagtttatggccgggcgtggtggctcacgcctataatcccagcactttgggaggccgaggcaggtggatcactttaggtttggagttcaagaccagcctggccaacatagtgaaaccccatctctactaaaaatacaaaaattagccgggcctggtagcatgcacctgtaatctcagctacttgggaggctgaggcagaagaatcgcttgaatccgggaggcggtggttacagcaaaccaagatcatgccattgcaaaaaacaaacaaaaaaactcggaagtttatttcttcacagttctggaggcaaaaagtccgagatcaattgtccgtagggttggttacttccaagggcctctctctttggcttaggttttcttccagagtttttatttcttcccttgtgcctgcttgtgtcctaatctcttggaaaaacaccagttatattggattaggacctatccatatgacatcattttacctaattacctcttctaaggctatatttccaaatacaatcacattttgaggtactgggggtcagaacttaagacttcagcacatgaactgggggaacacatggttcagtcataacagtgcatactatggcagtttaaatatcctattctgatactgaagtacttttcagtgactattcagtaaatatacgtgtacttctttgccttttcatagatccaaatgctgtctttctttctgctcacaattttacccttgctgatttcttgaagccactggcttcctcaaaatggttggtgaggaaggaatgcgaatgctcttgtcttttggaattctgggataaaagttttgtcagaaaccaaagagtatttacttggatacttttccttaagatgatgatgatgatgatgaatcatttattgagtgcttattttgggcaagtcattgtgtcgtcattttcacaacaaacctacagaatacatgtttttatccccacttgatatatgaggaaactgaggctcagagagatgaaataaccttgacctggatacttcttattttgtgttttcttttttagggtacctgtttgctcctaaaggactatcaattgtgaaagtagaaatgtgggaaagaagggaaggctatatcaaattcatagccactcagcttgttgatggcaatctgagacctaagggtccca

SEQ ID NO: 5676 - DNA, 1067 bp, mus musculus
ctttcaaaaataagtaacagcattaacaaaaaccaacaaaatttggccctagcccatctgaagtatcagccagatttgcatttagttccccagaccaaagtaggagaagcagttagctggttacaagcccttcacagtgctaaagaacaatgaatggagggcttcaaaatcaaaaccatacgtttggtaggaaacagctccaactggtgcttgattactaactaggcgttctgcttctaacatgattaggacaaacacagaaaaccctgtagggtttgaactgatggactgatgtttccctcccaggaagaaaaagagcagtatccaatggcattgaatcactgtgattctggataccttcaaaagccagggctttgagggggttctcatttctatgccacacagtgagcccttctctttctcaggaatcctctccagagagagaggctttgtgtagaattttcctgaatgcaatgaatgtcagcacattcccagctagaatgtgcattctattcttatcaagtgaaactgacctccctgccccagcatgctctccttgttcaacatgatgattaatttcaatgatgcaggtttctagatgaattgcactagaatttgcatccactccagatggcaaatatgtacctctggaatctcctcacccttaggaaagaggtcatgtgctagcttgcaagaatgaggatttttaaaatagttggcttacaatcaaatctgtgtcccacaaaatgctctgtccagactagcctctctccttttagttggcagcgatcctctccttcctactcattttccatctgataccatgtgactcaagtaggagtcacaaccaaaatgaattttttttactgcaaaattcaagattttacagtattttttcagccaatggaagcaaccaggattcataagagtctgcaagttgatgttcaataggcccctgaatcatgcttattcacagatttccaagttaattgccctgatacatgctactgagcttcttctagtgaacaaaaatcttactccattagtcatcactgtcaaaaggaata

SEQ ID NO: 5677 - DNA, 1196 bp, mus musculus
attaaagattagatttcagaattgtgttagtagttccatacaacttttactattcatagttacccattgtacattaagcattgtcagaaacaaaaaatatattcataaatggaaatagtaaaaaagatatttaataagatatctggattttaaagtttttccttttctgaaataaaagaaaaaataaataaaacacaatagaaaacaatctaaatactagaatatgagtgaggcaacagaatgatatgaattcatttttaaatagaaaaaaattaagtgcaaagtactttatttaaaaagcatgaacacaccattttatatactatcccctgatttattttcacaatgtcttatgtgtatatatgtatattacacatgcacacacacttacacacacacaagtcccatgggagcacatttgaatgggtatgcataatgagtcatggaggttaattggccaaaaatttgggtaagtagtcctatttccacaacggccgaaaaagatgagcatcactcattctaacatacacggaaccctcaaatgtgatcagaaaaatcaacagctcttaacttaaatactgataatcgatagattcacagtactgatacataggtgagaataatagcttcatttcaggtaagtataagggatttgggaatatctggttatgaagagtctaagattgaaaataagtgctgatagaaactgttcatgaaatgtggccaccatccattctatattctgagaaacaatgtggtaataatctggtgattttggtcttttttgtctgtttgtcccaagtacagaagttgatggacatacacaaaataaacttctgctaaaaaccttgatgagtgataaaggccatctgccagcagctggagaagtgtactttgacaggctgtatattgcagagagagagggagagagagagactattagaagatattttcagaaatagttgtggattttttgtaaatgaaattaaaacataaaacacagaaggcatatagtagggaaataaaagtcaaaattgcattcctaaagtactgtcatctctgaggaaattgtattagctttatccatctcaaagtatttttctgaagcatgtgattaaataacaataatattgacttctatttaaagatatgttactttattattatgttactttgctgaattcgttattaaagat

SEQ ID NO: 5678 - DNA, 937 bp, mus musculus
tcttggaatagttcctaccattttgcaatacataaacaggtcatattcaatccacctgtaaggtacaagggaaataaaagtaattttttcccttcttccattgctactacccaagttgaagactgggacattgtctttctcccacaccactgtactggtctcctgtttgctctccctgcttcctctgtgtccccttaatgatcaatttttagtaacagacagatgtgctggaaactacccaaatgctttcccattgatctttaaactaggtcaggcacagtggttcatgcctgtaatcccaaccctttgggaggccgaggtgggcagatcacctgaggtcaggagttcaagaccagcatggacaacatggtgaaactccatctctacaaaaatacaaaaaaaaaaaaaaaaaaaaaaaaaaagctgggcatgatggtgggtgcctgtaatcccagctattcgggaggctgaggcaggagaatcacttgaatccgggaggcggaggttgcagtgagccaagattgcaccactgcactccagcctgggcaacagagtgagactcggtctaaaaaaaaaaaaaaacaaaaaaacactaacgcaatacttcttagcttggtgtatagtaaggatcttactgacctctccaacttcattttatccctctctccaccatagctggcacattctccattctagccacaaggctgtttcctggaacacctctttcctgcatttgtctttctctctgtgttcactcagtcagaagctcttccggggctatctctgaccagctctttctcatccttcctttcctcaatatgacttttatcacctctctagtatcccacgctactattctgtatctgagcaccctattttttcctgtgacatttctaatttagatgttgatttttgtttttatctattgcctatctca

SEQ ID NO: 5679 - DNA, 1745 bp, mus musculus
tagaattcttgctaattagcatgcttatttcttatgtagttttttaaaaaaggaaatctaatatttaaaatatgttgtctatttattcttctcattaccaattgaaaatgattgctttgttgggtttgcctttcataaagatacatatattttccccaatatgctatgacctaggtaacttgtaaagactttactattttgataaccaatgtattaatttattttctaactcagtataaatctgggactttttaatcccatggcttactgtgcctgtctggggctggttttctcccagattcattgccggtacttcctctcctctgatctgtattgcagaaggctgagccctgcaaactaatgtctcataatcccttaccacgtcgttttcatttgagtttgggcaacgagaagaattgaagggagatagacaggaggaagaaggggagaagccccctctcttcttgcttttggcacttgtctctgagagtagcttagtttctgctgtaaagtgagcttttgtccagcagtctttcctgctgaggtgccagctcccaccaggaagaacgtgttgtggttccaagtcttgcctggtggccccaactcctagcacatacttaaaccactgcttctcgtggttcctgaggttggtagtagcttcctgctgctctttatatctgatttgccttgctattctgatttgccttgctattccatttgccttttagctcaaccaatatctttttaacaaatttcattgcatggacatgggattgctcttcaagagaacatgctgtggggagtattaattgactgacaagttcaagttgctgcatctttggacacactatagcgttcataccgtggctatacttatctcaagctgctctcagtcaatggagttattagaatcaggctatttttgcataatacagaattcctctaatggtcaaactttgctttttgggctctttactgacctatcccagacttttccagaagtttgctgtaatctgacatttcctacccaagcctccttttctccttctctcctctcatagttgtaggccggctttatgttctctccccctacttcttctgttcttttctctttttccttcacaggcattttccccaatcaaccttttgcagatcaaatcccacattggcatctgtttcttggaggaccccaaatggcacaaccttcagaagaattcttctttattgaacaacttagcttggattctgtttccctggctggactttaaagtatcacatatccagaaaatgtaatgctaacatatgttgtaggtcctttgttaaaaatgttatgttatacaaaagaatttccttttggcccatcatttcatcttcagacaatatcaatctctgtcatttttgtagccatctgaggaaacaggatgaatcctccactcaaaatttggtttcgatgtcgaaactgataatgctacataaacttcaagagactaggagctatctgaggagagcagcgaaggcctgccaggcaggtccaaagtggctttaagagagtaagaaaaagagagcagctaggggtttttattgtgattaggggctgggtctgaggcaagcgttccatgcatagacaggaacttgtgtaggatttgaatctcccgccagcatcaaaggaaagagcacatgggctttttatcagcccacatgtgggcgacaaggcgaagaaggagggataaggcttaaaagctctc

SEQ ID NO: 5680 - DNA, 178 bp, mus musculus
ttagcttctagaagcaataagaatagaaagacctccaagtttaccaaactctacataatcagaaagtagttatctaaaaattgtctgcaaataactaaaaaatgttgataaagaaaatcatattgactaatctgatgtttagcccgtattagtacaatttttattttttttaattttt

SEQ ID NO: 5681 - DNA, 551 bp, mus musculus
taaagactgtatgcccacatgcgtaacattttgttagaaaaccaggatgagaacatagcgcattttcgtgcagaggtgggagtgggcagtgtctaaaaaaaataactttatgaacaaaacctgttcactttagatgtgattaacctcccagtgccatctgcattattaatgtgatgggattattatactatcctaatgtatttgaatttctattaatgttttctccattaaataaacaaataaaagtggttgagaaagagatgacatttgctttaactgttcattgtggaattttttttctaaagcagtggtggtttgttaaatacaaactattaaatgaatgatatttcatgagaggttttgaacctaattataacaaatgtcatcatgttctttattaaaaggatttgaaaaatttctcagcagaaaaaaattgatacctaaatccttatgatatttaaatcattccattaatttaaaaattataagttgaattgacagtacacttaatttaaatttataatcaaattgagttattaattgaataactt

SEQ ID NO: 5682 - DNA, 169 bp, mus musculus
ggtcaacatatctgatactatacataataaaattttagtaaagagaaagggtaaaacaactaataaaatgagaattttagcttagttatttattttataattgcaggtctttttttttctttttctgagactaggcgagatcgagtgaattcagggtggatggtcatgg

SEQ ID NO: 5683 - DNA, 3469 bp, mus musculus
ttatgttatatgttgtacatatattatagatataacatatctagatataatatacagatatctaatatagacagacataaagatatacagatatatctatatatagacacatatatagatacatagataagttatacatatataggtatataatgtatcctataggtatataaggtatccataggtatatggatacatatataggtatataaatgttatatctatatatggatacatatataggtatataaatgttatatctatatatggatacatatataggtatataaatgttatacctatatatgaacacatatatagatacaaatatatgtcatatctatatagagacacatatatcctacatagagatatatactctacagcaagtactcaatgagtagtatctctgtaggtatttgttaataaaatatcatatatgttatatatctatatatagatacatacatctgtatacatacatatgtgtatatataatgtatatataatgtacctatctatataatgtgtatatatacataaacacatatgtatacatatccttatttacatatgtacataactttatatacttaagtatatatatctaaataaataatgtatacatatatacctgatttgtataatatattttatgaatatatagtatatataatgtacatataatctattatatgtatttttaatttcatgaaatcatagacatgtatttctcttattaataaaccaaaatagcatcatagtgataatattttagtgatctagggagtgatgagtaagaagcaatggctagactcaaaacaaagaactcaacacaaagggttttgtgactaatgaaattgagccattatgaattttgcctatacttgtaattcttaatatgattaacaatcaaaacaattcttattatattagcataattataattcttaatatatttgccttggtaagtagctcaatatattttattacaaaaccgtaccttagttctggtataaatacagttatgatatctttggtgaagtattagaaattgttctattaggaaaggtacttaataatcaaaaagttatcaattgtattatacttatttgttgttgaaaaaatgcttaattttctaaaattagagtttttatatgtgaaaagttatttgtccccagtcatttgaaagacattaagttagagctaggcagcttaagtttctgtattattgattaaattaaagtataatattactagaatagatggcattgccttgacacaatttatatgtatatatacacacacacacacacacatacatatataataaaacataaataaatagaaataactaaatttagaatatttaatttttggtattattaaccatatctaatgaactaaggagaaaatgaattgcacagacacatacaaagaaacatatatttaagttattatttatgcctagtatataccatatattattggtgtatttccttttattttccatgggagagctaaaaaatattagtgaaataacaagaaacaagcacctgtgtatttatatatgtacaatgatttttttcagttacctttaatttaaatcaaagagttatatgtacaatgatattttttcagttacctttaatttaaatcaaagagttagttttttaaagcacctcacccttcacatttaaacttttaaaatgcctttttagaagagatgacagcttttactattcttttgcaagtgtccattaaaatgtatattacaaacattaaaatatattcaatgccaaatctgcagaatattaatattcatattttattatatatgtattcattgaaagcattgaaataagaatgttaataatattttatgtttatatgtacacaaatacatatgtctattccaaatacatatgagccatttgtacttgcaattttatatttttatattttatattttattttaaattccattttctcattctatcttttgtctcttaataggtgtagatattatatgactggtaagattgattaagtgaaaggaatattagatacatgcaggcatgcataaaaaatacatttggaaatgatataatttatttcaggtttaaagcctctccagaactgaaaatagtcataatagtactgctgatagctaccttccatttatctgatgtaatttaaatcaaaaagcacacaaggaattttttaaaaaacagaccataggacagaaacgttatacactagggtgttctccatgaagaaaaaaggtgctattcttttacttatagtacatctttattagtttagcctaaaaatagccattgacttgttttttattatgttcaatgtcaaagtgaactttcgattttgcaggtgaaatgaatggctgctttgctcaaaaatactctggcaatcagccacacattctgccaaaccagcatgctgaccacctacttggcttgagtcagatggctatttggaaagcttttagtagttatcgttttatgtgatatagctgcccacttttcagcatgactcatttatcattttattccaaagaactgaattatcttgtattttttcttattatctttctggagagtctgacaagactttaatgtcagtatattttttactagaaaagaacatatgcgatattttgaaaaccgactgaacttgacagcttgagaattgacacgcagaatatgtacatttctcacattgctttgtaggatatacgggtgtttacttttagggtctggaaacttaaagctttctgtataacacctcctgagaccgtgtttaagatttttcaaattaaaaaatacctataagggccaggcgcggtgactcacgcctgtaatcccagcactttgggaggcctagacaggtggatcacgaagtcaggagttcaaggccaccctggccaacatggtgaaaccccatctctactaaaaatacaaaaattagccaggcatgatcttggcgcatgtaatcccagctacttgggaagctgaggcagaagaattgcttgaatctggggaagtgaagatttcagtgagctgagatcacgccactgcactccagcatgggcgacagagcaagactctgtctcaaaaaaaaaaaaaaaaaaaaaaaatatatatatatatatatacacacacacacacatatatacatatatacacacacacacacacacacatatatatatagtccatctggagcggttgaatatagaaaaaccttggtaaataaagttgctttggtaaatatagttactataagtattatataggcattcatttgtaatatataaaatgttaaataaaccccaataactcattaatgtctcatggaaatttggaaactgaaaatgcaagtattaacactaaggaaactgtagtaagaaaaggaatggggtaaaattatggaaacgcacatagtacct

SEQ ID NO: 5684 - DNA, 994 bp, mus musculus
ttaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaag

SEQ ID NO: 5685 - DNA, 994 bp, mus musculus; identical to SEQ ID NO: 5684

SEQ ID NO: 5686 - DNA, 174 bp, mus musculus
gagcagagctgtcccaggtaacttgtaggtagtatatgagaataaatgtttatttgtgtgtgacactgagttttagagtggtttcgttaggcagtattactgaggcaatataagaattacagaatgttctataagaatgtaatacagggcattatagaatgttcatttaggttg

SEQ ID NO: 5687 - DNA, 1037 bp, mus musculus
aacactttagtgttatctgggaccaaaattacaatgtagaaccctagaaagctagacctgaccatgttgtaggcacttttccctaaggcccaaacgacttcaaacaaaagcaagccaaataacctgtatacttaaagcccacaccccacctcccagatctgacagccgatgatgagggtgcgcacaccttctagggtgtaatcaggggcacacgcattagggctagacaataaggagtcagagacatggtcagcagggggagagtatgtttcccctctaagcctcccttggctcaggctgggttaaggcctggttcaggaaaagggtaatggcatcagaagagtgatggccctgctcccctacaggtcagccctgattgttgggttggggaggagagagagaagaccatgctatgtgcactctgacctctctctcctttgaaagcttcctccccatataacataccccatcaatgtccttgaacttgcagtttcttaatcattgatggtgactaatgtttggaagtgggagtggggatggaggtgagggagttggagcctcatgctccccctagaggcgtatataaaagatgcaaagtcatcttcagcatttagtaaactccagctttgaaatattttggaagtattgatttcatatcataattaaatattatatatttagaaatgttattaatagtaagtagctttatttttatgtttaatctaatatataaaacacctagtaacatcttgaattggttttcctactgagcaattttctttataataatagcaaatactaatataatttgtatgatgagtctagcattgttttgagcattaacgtgtgtcaaataatttaattctcacaataaccatatgatatgcatattattattatctcgatttttacagatggagagatgttaagtgacttgcctaaggtcacatagctaataaacgcagagccaagaagtaggtccaaataatctagctccagaggttgcttttaatctttatgctatatgttcttatcct

SEQ ID NO: 5688 - DNA, 750 bp, mus musculus
tggaagcttagatcagtgaattcttcttgaatttacctttttataaatctttaaaaacaaatttgactttaaaaaagcacaaatataaatcggaaatgctaattagcacgttaagttagatgaaacatatcagtggaatcaaagctcacgcgtcaaatgatgtattttaatattttaaaaatcacagtttaagctggacatagtggctcacacctgtaatcccagcactttgggaggccaaggtaggtagatcacttgagctcaggagttcaagaccagcctggacaacatggtgaaaccctgtctgtacaaaaaatacaaaaattagctgggtatggtggtgcctgcctgtagtcccagctactcaggaggctgaggcgggagcatagcttgagagaaggttaaaggctgcataagccatgattgcaccactgcactccagcctggataacagagtgagaacctatctccaaaaaaaaaaaaaaaaaaaaaaaaaaatatatatatatatatacacacacacacacactatatatatatatatatataaactatatatatatataaactatatatatatataaactatatatatatataaactatatatatatataaactatatatatatataaactatatatatatataaactatatatatatatatagttagtttaagaaatgagcaaaaatgaatagctaggcagaaatttatgatagcttttcttagattaaacaccaaaaatat

SEQ ID NO: 5689 - DNA, 467 bp, mus musculus
acagtcagtgctggcataagctccgccaggattcctgggccctgctgtgcaggggtctcctgaggaaggacagaatcgtatctcggtctccaagcccacttggttcttggcacttctgctaagagttgcgcaggctacctattaattttaaatgtattgtttttgaggatgaggcagacatctgtcttagagggacaggactgatagccgcaagtcgttcctcagaggctgctgaataaatcgtcagatgacctttattgttgtcaccctcattttgttcaaattgacgcagctaaagcacagtattaacaaaactacgcattgcatgcagcagtgggattagtgaaaaggaccatgttgttgactagagaaatggaagttcacgtatctcataactgcgtacgaagcagtggactgggaaggatacaagaggagaatgacaagattaaaataagagacaaggcctt

SEQ ID NO: 5690 - DNA, 1543 bp, mus musculus
aatgaatcaccttttataaataaaatttaatggtaaattcagacatagaacttaatttggctagagaaacttgcatgcatacacttagcattgcctttaattaattctgttgacttagaagatggtgtagacaataaatgctttttttattgatcataaaataactgttcagatccttaccaataagggacccactagggaaggccagtggtttacttgggttatgcttcagctacttctcaatagtggccattaggacctccactcccactgcatcacagtgaccctgggtaagtcacatggtattaaccataaataagtgcatcacctgtttgtgtctctgcattaagtaactggagttgaccatgggaataaaacttgggaaaatttaacgtgaaattaatggtataattctatagttgcagacttcccttttctgaaacttgaaggcaacagatacagtgatgatcccatctctcccaccatcttgaattttgtgtgaactgttaggccttgtgtatgggtaagggttttctccagaacacttaactgccaaacatggatgtgattttgagcataggcccattggaaaggcaaaatgtatgcatcagaactgaattccattctgtgatcacaatccaggttagtggagccaacatttttgaggatagccctctcctggatttattactctctgcctctgcctgttattcggtctcatttggggccactttatctcacttagtatatggtagtagccatcctggctgtctttcccactgaaggacttttgttccttccctggaaccctttactctcagtcttgtcatggcagcagtttgggtctcatttcgttctctatcctaggcatcttaaaaggaacaccatcatggcacatgtatacatatgtaacaaacctgcacgttgtgcacatgtaccctaaaacttaaagtataataataaaaaataataataatttaaaaaaaaaggaacataagacattctcttgcccaagttagcagtaactgcttaactgctgaattcagtaagcttatcttcagatcttaatttccaacacgctttccttttagtcttggcttctgtggaagctcattctcctggttttcttacccctcagctcttcttttcttttaggtcttctctcctgcccagcctctaaatactggtgttcctctgggtttagctcatctctaactgcttttatttaataggtgactgtactatgctcaaggttctatttatccctttacgggtataacttccaacactgaaactgcagcccagacttctccctggaggtttgactcatatatccaactttccattgggcaacttcacctagatggcccatagtcatgtaaaatccaccatggcccaaagtaaacttagtttccacttcaacttcacttcccctgatatttcatacctcatttagtaatatttccactcacttctcactcaaaccaaaaacctagaagtcatcctttactcagtcaagaagttgttttacctcatgtttctt

SEQ ID NO: 5691 - DNA, 1062 bp, mus musculus
gattcaaagagaaacaaaagacacattcctatccttaaataacttacaaggacttgggggaatacaaaacaaaacaaaacaaaacaaaacacagaattataacataatatgacaattgctgtaaaaataattttcaggtataccttatacctgtgggttttgtctcctcatcttaattttgaacttcttaactatgtgtctgccctttgaagaatgctcaggccagagacagcagtcgataatattgtgaactgaagaaacgagacagatgctaagccctcagctaaatataacatgtccaaattcacatcagaggtttgagcccagccatattctgtgtgtgaaaacatctggaccaaaagaggtgcaagaagcttatttactggtgtcagtgaaaatactaaaagtgattttcctagcatttttggaacctcgttgaagagggggtagagtagataaaatctcagaaacatgggatttacaaagccttaatttctgtctcttaccaaatgttatgttaaactctatggggacaactcaatccttacaaatgttgtacaacaatacactgaataatgtgatgtttggaaagtgtctcctgatggggtcaaaatatcccagaagacaattgggccagtgttagactttctgcctttggaggcatgttgtggttggctgggcagggaaggaggacaagtggaaccagtgggcctccagctccttcactggaaactcctgtgctgaccagcactgtggcctgggactcagagcaagcttccccacccatctttgcactgcagctcagtatgaaacactaaaaggataacatagagattaccagttgaggccgttcccaaagcagtattatgtaattcatgcattggatcattggatccttcccatggagcaggatccaattaggcagcctaggaattttattccagtttcatccatggaaaaaatgaggtatagagaaattaagtaacaaatgtttataaacacacggctggcaaattctaccaccagtatctcatagaggttgagagaggcctatgccattcc

SEQ ID NO: 5692 - DNA, 1028 bp, mus musculus
cctacttcactctcttaaatatcactcttaaatgagcaaaaatttttgagagggtgtctggtctgacctcgtatcttccttgattcttgggttagagcacctgacactttcacatgatccatttaaacccatttaccaggctaccagggataccagagacttgtgggtcaagtgccagttccagagtctgctaatcctatggatttatatttatttatgtatcatttttaacctctgaggatttctttcttttcctgccaactctggtattataaaatattttttgtatttgcagcattttagctttgctgtgcctgattgtgtttttcttagtatccaactcagaataatggagaaatgaatacatagttgggtatttttttgcataagcatgaatttctgcttattcaatgacacttcttacctgtaacacctttgcaagatgattgaccagatgttaaaaggaaaatttgtgtctgtggaacagagctgttttctataagaagtcaatttatgttctcagacccatagatggagcctgatacaattttgacctcctacaatgttgctttaaccaattcaattaatcagtcttttaaatttaaatgacaaaccaaaaatattccatattatcataatatattattacttaatttattgcaggacacattatccagaccctaaaacatagaatttatttctaatgtaagcaattagaattccttcaataattagtgctaattctttgtggctgattagaacttctcttaggaccacaatgaaaggaaaaggaaagactcggttgctagggcaggtgaagcagaatcacagaaggtaaacatcttggggactattttcagaaggtgatacattcttacagtgacaccaagactgtgactgagtattcaacaactgattccttggcacactgtttgagattttcaatgcattcttatttttgctgcaaatatattaaggagatataagacaagttgcatgctgagcttttgacgatggctcaattcaat

SEQ ID NO: 5693 - DNA, 408 bp, mus musculus
ttttctctttacctagatacccatgctgtgaacaatctacataatcagatgatgtggtcccaaatatgaacttggggaaatctttgatttctccagaaggatgtatttgtctgtgtgaagaaattgtattcagtttaatttttaatgacttgctactaaaattcctatactctccaaatgtagctttctgggtaatttgaggttgtcacctttttctcatttagaagtacaggattaattcagtagttatgagtagacatcagagatgatgctgagcctcctactggccagggcaagaaagggaaactcaagaaattcagttgttctcactatcagataaagaaagtagcatacccaaattccactggggaaacaatgatcatcttttttactttaaaatcaaaagga

SEQ ID NO: 5694 - DNA, 1162 bp, mus musculus
attagcatttcataacattatttgtcttggtatttgaatacattagaattctatttgtcctgtaattaatttctaactcactttgataaaataccaaaacaaaggaaacaaagtcaacaaaacttaatttgtatccttcatccttttgaacagcagctatgtgaacatttggaaagaaccttagtaaggcggcttttctatcacctataaaaagttgccaacagacatcaaaggagttgacaaaaaaaaaaaaaaaaaaatgcaggaagctggaaggcaggcctggatggaattggaactgtgctgctgtgactcctttccccagtgctaaaaaatagatgtagtcaggaggaactaacatagattggcagtcacccacacatctctggtgttaccttagtcttgtttcaagcatacaagccacaagtttttgggtgtcttaaatatacctaagttgtagtctctatttatttttttattatacttttaagttctagggtacatgtgcacaacgtgcaggtttgttacatatgtatacatgtgccatgttggtgtgctgcacccgttaactcgtcatttacattaggtatatctcctaatgctatcccttccccctcccccaaccccacgatgtagtctctttctaagttccattaaacagaatactaaaatgaccttttttggtgactcttgcctgtctctaccactaactggcttaaaagctgctgggtctcttcctttgtaaagagcaacatgagtttacagatgaggtctgtctatatctcctcttatgtttttctcttaagaacttcaagtgaaataaaacaaaatagctcttttatgaatactaccttttgtattttacctcataagatttaatgtattaaacatttctataccaacatgctgggactttgtattgtctgtcctatatcctcattgcctagaccctccttgaccttggtggttacttagatagtacatgaatgaaatgaaaaatagattacaccataccctaaccaagtcttgtaagaagctaaaggactacaaatccctgagatgattagcacagaaaagagaaaaggatgaacttgttagaggttttgttctctatgaaatccaataaaagaagtggatatagtgcaaatttttatggagcaat

SEQ ID NO: 5695 - DNA, 1136 bp, mus musculus
aacagagaagtaatttggctaagttaacgtagctggtaaacagcagagctgggatttgaacccatgcagtgtgccattccaccgttcatactcttcacccccaggctgggttacatctaagagcaagggtattatattacctcttcagaaatggactcagagagagacatccagtctatcacctggtggtcacgctgggcagcctttgaagtttctttcaacgctgagagttcatgactctgaaaatccccacttctcatgatttgttggagactgattccacttcagagctctttccaagtctatgctgcgtcctccactgagggtcagaatccctcacttgccacatatgctgccttgtaatgttagctcttaaggatcataaaccatagaccatgaagataaatttgtccaacccatttgtctgacaccataggaactgaggccctagcactggtttgctagtggttgtataggcaagtgggagagcctggacaggagcccaagccaccacagtgctggtgcaccttccacagcatcaccccacagccttctctggactgtaaaccatgtgaaggcaggagtttgtctttcatctctttgtatcctcaccataccaaaaatagagtgaaggatgagagaagtgacatttgtgaagccattactattttttctttcacttagcaacagggtaatagacccaaacaccactctagatgcctggggtatggccctgaacatgtagatgaagttcctgctcccatggagctcacattttagggcagggaagcagagaataaacacaagaatatctaaatgaacacagttgttccaggcggtgataacaactgtggagaaaacagcagggcggtgtgatgaaggcaaggggaggtggctcctctgtgtggagtggtcagggaagccctttggaggaggtgacatttgattgagataaagatggggaaagaaacaaccatacaaagatctgaggacagagaattccagacagagagaaaagcaaagcagatgcctaaggttgactaagttgaatgtgtttgatgagcaggtggtcagtgtggtccaggtgtggtagacaaaggtgattggtgatgggagatgaagtccaagaataccac

SEQ ID NO: 5696 - DNA, 1136 bp, mus musculus; identical to SEQ ID NO: 5695

SEQ ID NO: 5697 - DNA, 1136 bp, mus musculus; identical to SEQ ID NO: 5695

SEQ ID NO: 5698 - DNA, 1143 bp, mus musculus
atgcacaagcccttatcctagagtcactgaacacaaacctctactatacccagttggaactccagaaagaggtgagtccctactggagtggggatgggggttgggggaagaacccaggtctccatccagctctgccatatagctctgccctggatggctctgggttggggaagatggctattaaaatgtatgtctttcagaaagctatagtgggaaatctggagaaaatgcttcaaaccaagtttgctgaaactgaagaaaagtataagcacaccatacagatcctgacggaagagaacattcatctgaagtgcggctgctgctgaaaaagacatagctgagttctctttaggagtgggaaggagtttgagtgaggaatgggttaggaagatagaccaactgctccctagttatgtcaaggcacaggtgttttcgggagggaggtatgtcactctaggccagtgacacaaagccagatagttcacttgaggtggagtggagatgtgtctatacttctcccattcacctgtgtccttgtttctatgcaaaacaacacaggacatttgtcttccagtttctgagtttgctcagttctatgactgagggtggtttttaaatccatctcccctgggagtctgatggtcttgccattacatgcagctgcttctggttcctatggaaatcacctttggatcagaaggtgtactgttacctgaagctgcatcttaaatcattaaaataaattttggtcaatactttaatagaagaaagttatttattgcattgatttagtagaaaattcctcgtataggactttagtcacctgaacaccatacctcactaaattcaaaaccactgcaagtaatgagtgagagactgctgtggtgaaggaacgaaggcacatttctctccctgcactccaaatatcctataccctttctagcttttgagttgacattgatacatctttcctttctttttacaggcaaaagataatttctaagaatgaagaaatttgtgaaggatgttctgggagattggcctctattactgtttctaaggatgattctgacactgtgcaagatggtagcaagaaaggacaagaatcataaacaaaaagttgctctgcattgttgaagatgg

SEQ ID NO: 5699 - DNA, 693 bp, mus musculus
gaagtatggaacaatgatggtgcattggagagtttctcttacttctttatgtccctcccttccctggaagctggaaaagaagctgccagggatgaacacctttgcttctcctcatccttggaaaccattaaaactgcgtctgaatctttgctgcactcctagagtatggactggaaaatagcccaggggagtcaaaatcctgactttgattcacaaacatgcttgaaagaaaaaagaaaggaaggaaggaaaagagaaattgtggctgtgacctaaccatagctaaaaaaatctctttgacttccagtggtttggtattaatggaagccttttatcttcagcactttgtccttgtgctgccaagtggaggaagggaaagtgcagaaagctctgtctgcataatcatgtgcctgctggccctccccaaatccagagccatgtgaaggctcaccctcctggttctgggaggccccaggctagcatgagaaatcagtgggaaaatgttccttcagatgtcaaatcccaccttctctcagaaaagaaagacataaataaagccgcaggcaaggacaggcaggcccttaggttgcttatgcgagcattctaaaaatctcctcatcaatgcttagcctagatttcacagaccaaatgccaatatgttttgccctaaaacacagtttataaaattaagag

SEQ ID NO: 5700 - DNA, 2048 bp, mus musculus
gtttgtaattgggatgttgaggcagattgtgattgctttaattttcttttttttttttttgagacggagtctcactctgttgcccgggctggagtgccgtggcaccatctcagctcactgcaacctccgcctcctgggttcaagcaattctcctgcctcagcctccagagtagctgggtctacaggtgcacgccgccatgcctggctaattttttgtattttagtagagacggggtttcactgtgttgcccaggctggtctgaaactccaaagctcaggcaatccgcccaccttggcctcccaaaatgctaggattacaggtgtgagccactgtgcccggctaattttctttttaaataaagagataaaaccacatgctgagaacgaaggaagaaaaatatgaacttcagcagagaattaaaattttggattaactgcttaggagaatgggggaggttgctgatcaaggcagttaaaataattgtcgactggcacaaggacaaagctgagtttgttgaacatgaacattaagtggcaaaattctgcagggttgtgtgattgatttctggaagttagcaccccccggtcgtgggcagaggaaatcggttgtagaaatgaccccgggtgggagtttggtgctcgtgtgcaaagtagttagaggtacaaatgggcaagggagtgaggtatccaggtaacatggtagagcaggtgatccgccatagactgtaggcctggaggctgatggaggcagaagcgatgccggcaaggggttgatctactctgctaagttggagaagttaaggaagagcatgtgtaactggagtgggtatatgagagaaccggatggaaaggagaatcctggctattggtgctcaagatttcagagatgaagcagttaattagctagactgagatgtaggataagaaggtcctgggtgaggctatcggagtgagtgacttaggcagaatggaagttgcagattagcatcgaggaactcatggaaattggatgccaaggttggtttggttttacatattgtagttaaaggataacaaggcttgacgaaaagaggaaacctgataacaccatataaaaccctctccttatttaagacatgggccctatggacatggaatccactccacatttctccacgttttctttctttcttttctttttgaaatggagttttgctcttgttgcccaggctggagtgcaatggtgtgatcttggctctctgcaacctccacctcctgagttcaagcgattctcctgcctcagcctcccaagtagctgggattacaggtatgcgccaccatgcctggctaattttgtatttttagtagagatggggtttctccatgttggtcaggctggtctcaaactcccgacctcaggtgatccgcctgccttggcctcctaaagtgctggattaagtgtgagccactgcgcccggccccacattttctttttacttttatttgttttgagatgaaattttgctcttgttgcctaggctggagagcaatggtgcgatctcggctcactgcaacctctgcctcctgggttcaagcaactctcctgcctcagcctccgaagtagctgcgattacaggtgtccatcaccgtgcccagctaactttgtattttttttagtagagacagggtttcaccatgttggtcaggctggtctcgaactcctggtctcagatgatccacctgcctcagcctcccaaaatgctgggattacaggcgtgagccctcgcacccagccccacattttcgtttttatcacttacaagctcctgatcagttcatcaaggactttaaaaactctcatactaaggcacagaagtaataggttgaaatcaacatggatatgagggaaatgcagatctagcttttaagtagaggggtatgaacagcctcccttgagagagtatctcagggagagccagatcctccaaggaggactaggtctcagttaaggcctgaaaaggaagggagtgctgcatgagaaaccggaaagaccttattgcccttgaaga

SEQ ID NO: 5701 - DNA, 694 bp, mus musculus
aatgagaactaaaatctaaatctctgtagtgaaaaatgtatagattccattacactgatgttattttgtacctgctgtcttcagggtcacctagccaccaataagaatgaaccaactgagagcctgtgccaagtgccagactctgaatctgggccaaatagactgaaacccttcctccacatctgtttaatgtttttgacattccttgtatcctccttgctgaatctacataaactaaaaccaaaaactgctgctgtcctaaagcacctgcaactcctcctcaccccattccctccaatcagacccctcagatgtagacaacaacatcaatcagactcaatgggacatgatgatcagttaatttcccctattgctagctcactccttcttccctgctgggagcttacagcatgctgagtggccaaggtcaggctacttatgatagcgttgattaaccaaattaaccaagtgccttgcttgtgcatatttacttcctactgtttactctttggccattttagtacttgtaaatatataccaaaggcagcaatagcaaccagccctgagcctttgacatggcatcatacatcaaggggcacaaaatacatacatgtatatgtattaaaaagaatcttcaagaaatcacattaagcagttaatagtggctaattctgggaggaagaaagggaaggaa

SEQ ID NO: 5702 - DNA, 344 bp, mus musculus
aggaaccagctttgttattttacatttgaccacctcttataaatccaaacatttactatttgatgctctgttttttaaccctgccttattctatgtgcagactgctccaagaaaaatatcagcaactaaatttgctgttttcactctaagtgggaacattttctatgatagtaatagtctgacttagaaaaggctacttcttaaggcaatgagtgtggacagtttgtcggattaacaccgagctgggatgctatagtggtaagactttgaaatttgggagtcagagaatacaagggctacttctgattttaccttttactaattgcatggactacttaacagaa

SEQ ID NO: 5703 - DNA, 1235 bp, mus musculus
caggttaaattgctaagatgatcagtcaacaaatatttttggcagatctgcgatgcatgatgcgatattttgagaggtttgtgcaagatttttatttccctcctcctttgtaggaaaagatccactactcatacctactgacatcccctggcacttctagaaccagcttacaccccatcctctgctcacccttctcccaccttccacctgtattaacacctgacaggcacttatttccctatcaggagtctctgtagttgttttgccattgaccaagatatgtttagaacatttttaatctcttgtgcaattttggcaaacagcagcctgagctctgcttttcctaacaaataacttgcagattgtcatgtttctcttgggagaaggagaaaggttcaatcagagcagaattgaaatgatataaattaggcttattgtttagcaaatcgctggtgttaggtaagaattgtagataagaatagcctagaccctcttaaagatcagagcaggcatgtgtgcatgcatgaggaaaccaggcctttgttagtatcctttctgaaatggctattaaagtaattacagtaatttatagatttttttttcttcttccatttcaaaatgggttccattttttgccttttgtcttgagttcctcagttggagtgtgtatgtgtgtaagcatgtcttgggtagcactgccatagatagtatctatgaattatctgcacccaagctgatgaggtgtggtgaccacaggcactcacagatggatttgccagctttgctttcagggagccttggtcctttgagaataagagaattgtactgagaacactatgttttaatggttagttatagtttgtcatagcaccatttaaaattgctgtgttttatggacataaagatggcaacaatagacactaaggagtactagggcagggaaggaggggggcaagggttgaaaaactacctgtagggtactatgctcaccacctgggtgatgggatcaatagaagcccaaacatcagcatcatgcaatacccatataacaaacctgcacatataccccctgaatctaaaataaaaattaaaattaaaaagttgctgttttttatttaaagagacactttttcccatgtctttaaaaacacatccattcatacctatggattttattattatactttgttgcttttttatatcattgatgcttgtgtataagaatggcaatactt

SEQ ID NO: 5704 - DNA, 1086 bp, mus musculus
ctattgcatttatcaagggagatataacttgtggattcattctataatgttttacaggagaattttttttatctcagaaataagaattttacatctctacaagtaaatcagaaatataattagatacataaattcataaacatacaaaataggtaaaatgattatatggatttctaaaagtacctttaaattggctgggcatggtggctcaggcttgtaatcctagcactttgggaggccaaggcacgtgaattgccagagctcaggagtttgagaccaccctgggcaacatggcaaaaccccgtctctactaaaaatacaaaaattagctgggtgtggtggttcatgcctgtaatcccagctattcaggaggctgaggcagcagaatcgcttgaacccaggaggcggaagttggtgcgccaagatcgtgccactgcactccagcctaggtgacagagtgagactccatctccgaaaaaataataatgataaaataaaatacctttcgattatactatagagcaaaaaaaatcgtgtaggtgtggataagtgagtatgtatgtgagtgtgcatgtggatttgcttgtatgaagacatgaagaaaatacaaagggaaactcttatttctgagaggtaggattgtgggtgagttttttcctttatggttgtttttattttagatattttctacagtgatcatgtattttattataaaagtgttataaaaatgagtttttacatgctatatagaactaaaaacacttacaaatgcaaaaacattatgtcttttgaaatgcaaggcctctacagaaacagtatccctcctgtttttaaaatcacacttttgatacccaatgagatagttcaccttcggtaacatgaggcgtttaattaacatccagtggggtatgattggaccccctgatgtgtcatactttcacgtgaattattatcttgcaacatacattctagtaataacaatgacgttatctagtaagttttcataaatactaagactatataaaaatcttagcttttcctctttatctcttagacagtacgtagttcaaagtatactttttacaa

SEQ ID NO: 5705 - DNA, 1405 bp, mus musculus
tgatgcctcctcccacactgccagggcctccactggtcgctacaatattgtggccaaccagccagaagctctgtgcgcaaaacaaacagcctgcttctggctgtgagatgaataaagatccttcaaggtctgactcacacagctcccatcctgcttagagacttcctgtaatctggttccctttcttgtagaagctcatgtcctttctaaacatctttcttcatggtcttatgaggctctagccaggagcacccaacattcctaaatgcttgcttcttccacccccaacaaaccccaacctgttctctcagaatggaaagggcatttctgggatggggagagaaggtgaatgctttaacatgcctcacatggcccgggctgcctgtgcagcatgatgcttcagaatgcagctgtcgaaagcatagtcacaaacggaagcggttccagctgactggcccctgagtgctagattcagaatctccgccctggcgtggcagcagccctttcctgcttggacattagtgcaggcccatcatttccacaccatggtgttttttgcacagtagtgacaagtttgcccctggagccaggagaagctccaagctctgtaatctgaagctccaagtaaatgaactctaaaagggaggcccatcacacctgccacctactcccaaactgtcccctacttggatttctgcatggcacgtttttcagatgagttttgcatcttccaagttttgttagggaggctggatgccagcaaagaggaatagaaaaatgatatggagcctaaatccctggaaaaacaaaaaggacttttctgttgctgtggtggattccctggtgcccagtacacttccgttcccagcaggctcccgttttttggacagacggggaagttatgatttgccctcacaattggatcccctgggagccagaattagtgtgaacacctattccggagggaactgttcaccctgccgagtaaaggggcactgccagcacaccaggggccccagacgctgtgctctgattgcccttcagtgaccacccatgcaggcagccccaccgggcacaaaggcatgattcctgttcccttttgtcaaatgaggccaactgaggcacacaagcatgattgatccaggccagcgtaggaaaatttagtaagtcctggccctgctgggattcacctttacacctgctagtgctgctgctgccgctgagaaaaacagaaatggaaagaaattgtggactactcttcctttgcactctggtatcattccagaatgctaccaaggggccctttaagttgactgcagagggtgaggattttatagacacagagcagaccaacgaaagacccaacactcatgctgaaagcagcctgcccccaaagccttaaact

SEQ ID NO: 5706 - DNA, 1405 bp, mus musculus; identical to SEQ ID NO: 5705

SEQ ID NO: 5707 - DNA, 1405 bp, mus musculus; identical to SEQ ID NO: 5705

SEQ ID NO: 5708 - DNA, 732 bp, mus musculus
attgataaagaagttgtgctacctacatacaatggaataccaagcgaaacgacagggcatgaactattaccatccttgcaacatggatgaatgtcaaaaccataatgttgagcaaaagaagccagacatgcgagaaacatgatgtatagtttcatttctaaacattttcattaatctgtgatgttggaattcgggatagttgtcaccttttgaagggagaagtagtgaacaggaggtggcccgaggggtcttctggggtcctgatgtcttctatttcttcatgtttagactgcttacacagtctagtctcacttttggaaaattcatctagttatacacttatgatacatgcactttctatatgttaactatacttcaataagaagctacttaaaaaataaaaataagctagcagcagtggctcatgtctggaattccagctactcaggaggctgagatgggaggactgcttgagcccaggagtttgaggctgcagttgactatgatcgtgctactctaaaaaagaaaataaaataaaaatttaaaaagatcactaagatagtgagctcccccccaaagcatggttagcctaaagtgctatgcagggtttgaactctccccatgccctatgcaagggagcagagctcccagaagttttcagacagtcaaaggaatagggactcgagatcgtaagaaaaaccctcatcttctcagaccattgcagtaaacaaa

SEQ ID NO: 5709 - DNA, 857 bp, mus musculus
agatccatgcgcagcaaccacagtaatctacattttacactgtctaaattttacaatgacaattccatgccacaacctaccaagttcatctgttctttggttggacaaattctggaagagactcatttgcttttttccatccttctttctgtggaccgagtagacagtctcccacaggctgcggctgtacgagagggaagaccacaaaggcctcatgatggagctgagtgaagactgccccagcatccaggaccgcttccacctcagcgagatccgttccctccacgtgctggagggctgctgggtcctctacgagctgcccaactaccgggggcggcaatacctgctgaggccccaagagtacaggcggtgccaggactggggggccatggatgctaaggcaggctctttgcggagagtggtggatttgtattaaaatagcttaacactaccaatttcccattttggaacctaataaatatttagtctgcattgctggcaattgctgacttctgtcattctttcattgtgcaaatcagttcacctttaaatgctccttgtcaaaagttaagaagtgaatggggtgggggacggggtctattggagaagagcttcaaggtagagtgagtttgaacaagcctcagacgttggggtggaggcagggtgtagcctgcccgagaaagaaaacgcagggcaatgccagagacctgggagaggctgactggtgagaagggaggcattcaactaagcaccttgaggaacaatagttgggaagtttccttctaaccaaaaatgggttagacaaaaggcaaagtcagatgagtggagagggcaaacttaacttggccaacagcctg

SEQ ID NO: 5710 - DNA, 857 bp, mus musculus
caggctgttggccaagttaagtttgccctctccactcatctgactttgccttttgtctaacccatttttggttagaaggaaacttcccaactattgttcctcaaggtgcttagttgaatgcctcccttctcaccagtcagcctctcccaggtctctggcattgccctgcgttttctttctcgggcaggctacaccctgcctccaccccaacgtctgaggcttgttcaaactcactctaccttgaagctcttctccaatagaccccgtcccccaccccattcacttcttaacttttgacaaggagcatttaaaggtgaactgatttgcacaatgaaagaatgacagaagtcagcaattgccagcaatgcagactaaatatttattaggttccaaaatgggaaattggtagtgttaagctattttaatacaaatccaccactctccgcaaagagcctgccttagcatccatggccccccagtcctggcaccgcctgtactcttggggcctcagcaggtattgccgcccccggtagttgggcagctcgtagaggacccagcagccctccagcacgtggagggaacggatctcgctgaggtggaagcggtcctggatgctggggcagtcttcactcagctccatcatgaggcctttgtggtcttccctctcgtacagccgcagcctgtgggagactgtctactcggtccacagaaagaaggatggaaaaaagcaaatgagtctcttccagaatttgtccaaccaaagaacagatgaacttggtaggttgtggcatggaattgtcattgtaaaatttagacagtgtaaaatgtagattactgtggttgctgcgcatggatct

SEQ ID NO: 5711 - DNA, 938 bp, mus musculus
tgattgcttacaaagaacacacttttattccctgtattttaatgtttgtttcttccacaacatctccagttcattgatcaggtcagattcgttttaatattttccctaatttgttagaataacaacattgaaagtgggttcaggggagaaacactttatcaactggtttaaaaaaccatgtttcaaaccaggtgcaatcccaacatttgtaatcccaacattttgggaggccaaggtgagagaatcacttgaacccagggattcaagaccagcctgggcaatatagtgagactccctctctacaaaaaaatttttaaaaataaattagccgggtgtcacagtgcacacctgtgatcccagctacttggggggctgaggtgggaggattacttaagcccaggaggtgaaagttgcagtgagcagtgatcctgccactgtactccagcctgggcaacacagcaagacctttatctcaaaaataaaataaaagccatgcttcatgaagatgcagactgattgtgtcactttcgttgacacccaaggatgcatgctgtttatttttgttcttttgtttattgccatgacagaccagctcgcacaagttaaggctgtacgagagagatgactaccgaggccttatgtctgagctcactgatgactgcgcctgtgttccagaactgttccgtctccctgagatctattccctccacgtactggagggctgctgggtcctctatgaaatgcccaactaccgggggcggcagtatctgctgaggcctggggactacagaaggtaccacgactgggggggtgcagatgccaaagtcggctctttgagacgggtcaccgatttgtactaagctgtgcctgccttgttgtgatccccatagaaacataataaatatacaagttgtgttccctgcactaagtggctcttg

SEQ ID NO: 5712 - DNA, 1261 bp, mus musculus
gggcaccagtatactcgcagagccaacgctgagccctgtggtcactccatccatcatgattatcaccagtatttctcctataaccagatggtggcgtctttcaggtaagaaatcctaggaatcttgtgcatgatctcagatctcataatcccttaagaatttttttaacattttcaccattactagattgaattaatttgtgggattccccatttatacccttataaatgcagaggaccagactgtattaagaactttcagtattattttatttactctttaccctacaaaatagttcttattatcctcacttacagagcttacgatcattcacttacagagctctcaagtggtggagtaatgatttgaaccttggtcgatctactaccagcctcactctttttttaaaaaaagttttaatatagaaattttagaaaaatatgagacaggatctcactgttacccaggctggtcttgaagtgtgctcaagtgattctcctgcctcggcctttcaaagtgtggggattagaagtgtgagccatcatgtcgggccctggcctaactcttaaccattgttttggcatctgatggcatctgaaagtctgtcagaatttttgccaagatattaaccatcagaaggataatcacataattctgatagagctaaaagtctgtgttcaaagaattgatagttgccattgtggtattaaataatttgagacagccttcaggttctgccttcaaaatatatcaagagtctgagcactttttaccaactctaccactaccactttgggctgagcctctgttatctttcacctggattattgtagtagccttagcagtctccctttggccttgtccctttagcctcttctcaacacagcagtcagagtggttctgttaaggggcaatcagctaaggccactcctctgctctagacactccaaagggtgtctgtttcacctggagtgaaagccaaagtccatttactggcctttaatctacctgcactggctgcccaggacctctctgctcttacctcctactgctctctcttcactcatcctgctgctgccccactggcctcctgactgggcctcaggtatgtcaggtaggttgctgcctgggagccttgtacttgttcttccctctctgaattgctcattccccagatatctgcttgttgcttccttgtgtcttacaagtctttgctcacatttcacctgccctgacactcccccatcctagcactctgctt

SEQ ID NO: 5713 - DNA, 323 bp, mus musculus
cagctttttttcaatgtctcaggtgctgggaacttagtgctggagacatcaagtggatttatcaagcaccgatcttagcagctattggggtaagtttaaaagtttgtatagttaaaaaagggatgaaaaattaacctgctgctaaaacccagagaaagtgtgtctgtcactgcattctacaacagatctgagaaactgacaagtacagcaacatctattgggagagtctgggacagagatcagacccttattgtgactgacactgagatccatgcagaaagccttcctttaatcagctagcacttggggtcaattccgagact

SEQ ID NO: 5714 - DNA, 323 bp, mus musculus; identical to SEQ ID NO: 5713

SEQ ID NO: 5715 - DNA, 337 bp, mus musculus
atgttttttgaaataaactaaaaactctacataaattttcttaaattcaagaagaaagtaggtattattttaaaaatattattgacacatccttgttcattgggaaataattatttaaccaggaatatcaggtagagttaaagatttaaaataataatccacttaaaagatagacacattatttttggagatcttactgactaaaacttgggtttactttttataaaaccaatttattgtgattgtagctataattatttatagcataagatattattttagttgttgtagtggttttaaactttaaaataacatgtattttttctttaaatctgaa

SEQ ID NO: 5716 - DNA, 799 bp, mus musculus
acgcatttaggactccaaatcagtaggttccaatgcttaatcccaagaccagtggcatcaccatcatgagggaactagttagaaatgcaattcttaggccctatcccagccccactgaatcaggatctctgagggtaagtttcagaaatctgtttcatctaactctctaggggattctaatgcaccctgaagggtgagaatgcctgacctagacactatcaccacaaaagagtatgagccaagggcagaagaaaataccttccaggcctgccatagaggggtgtgtgtgtgtgtatgtgtgcgtctatgtgtgtacacatatctcaggaaaaattttccccagtgatttaacacttctgaagcaattctgaaagattatttctaaacatcacccatttcatttggccaacattgttaattttccaattaagggaaaatatggattcattaagaccctattagctcatctatatttaacctatccaactctaataaccatatctatttaatattttctctcccctttaaaatttattaatccttttatccttcttaatcacctatcactttagaaaaaaggttgtttgtttgtttgtttgttttgttttttagccaatgatacccagttgctgtctggaagataaacctccttccattttcagacacaaaaagaagttgctctaggtctattcatagttgtacgctcatatatgactgagtagttctagtttctacactattattttctcctgtaattgtaatttgagaagttcactggctttcacattttgggttcatt

SEQ ID NO: 5717 - DNA, 2341 bp, mus musculus
aacttagtaataacagaagcataggaattgattaagatagaaaggaagatctaatttccatttctatatttgccacaacttgtactgagagcttggaatgttatttaatatcttcaatttttttgcctgtaagttgctacatctttctgaatgtctcctatgaaagcaacctgaatcccaaggacatctgaaggtctaaagaaataaaaacctgaatagatatttacaaagagcttccagagctagaaaagttttaaaggagcttataataattttaaaatatgtgtaaaccagtcttccaaataagcccttgctcaggatgaccttttctgaggcactgctgcataaggctttgtagcctttacagagccctctacacaaaggcccttgacgaaggaagccagtgaggattgaaatccagtccaacctctgctttcggaaccactcaccaaaggattactaccattcagagggttcatcttcttctaattctccacctagaggggtgccttttctaatttgcataaaggtgctccagaggaaagcagcgccccacacataaaaataattaattttatcattattttaattaataattatttttgctattattaataataataattagtttttctattattatatgcctttcatgttttgactctaattctcacaactctatgaaatagatattatgattccaattttgtaaggcacaggtaggttaagtagtttgtccaaggttatatagttagtaaatgttgaagctaaaatcggaattcaaactaaaaatccaaaaatctgaaatctaaaatgctccaagatctgaaactttttgagctccaacatgaagccacaagtagaaaattccatacctgacctcatgtgacaagtcacagataaaatgcagtcaaaactttatttcatgcacaaaattattaaattatataaaattatcttcagcttgtgtatataaggcctatgtgaagcatacatgaattttgtgtttagacttgggtcctattcccatctcattatatatatgcaaatattcgaaaatctgaaaaaatctgaaatccaaaatacttctagtccaagcattttgaataaggatagtcaacctatatacatacagttctgttgataagtttgagtcttctgtttgcaaccttctgagctgtcttaagtaggggtccctggaaacaggctccaatatgaagatatgcgtgcaggcaatttactggagtgtcttctcagcattaacctctgttaggtatgaagaagcagcatggggcatagggagaaattgaactgcagtgtagttgtaatagaggcctaagctaatcacagagggctttgaagctgggatggctctttaagtagtccccaggtgaggcaaagagacctttttagcaaacacaccccaggtccctttatggccctgtccagtcattagaggtagactgcctccaggaggagagtataatgttgggtgaggcagctctctagctgtggccttcagaggcactcatctgagggcagtgagccatcagcacttggaatagctcagagaatgaatgctgcagtgccaaggggaatatctggagttcagcaccacctccactacaagagcttacagataagaaaagggggaccaactcgataacattaggggaggagaaagtcaaccttatcatagtaaggcccatgctaatgtatagataagcccctattccttccataccatgcgcacatttgagtacttatatctggttccaaagtttatgcgtcaacccaatcatgtggctatggaaaagtcccttacaatttgcagaacaattctcatccattatttaatttgctctgcatagtaaacctatgaagtaggaagggcagctattagaatcctaaattcacaggtaaggaaacaaaaacacaaagagattagttaacttatctaacatcatatgtggttaaggaacagacactggaatcccaggtttgtggtgtgtgtgctgatggtggaatgtggtagaaggactgagacaggctgcagcttcccaaagaaagtgactcttccacactgggctctgcatcattccttagcaactgcttccttatgcttctttggaaataattcaaggaagttccttttttggaagccatgttttccactaacaacaaagattaaattgggcaaaagataggatgatatcaattctcatgattcatctcagggggccttcctatttagccttaagggaagaatcaagctgaacgtgtttataaagttctgtatattctcaccttgtttgtgcatatgtattataatacagtgaaa

SEQ ID NO: 5718 - DNA, 1029 bp, mus musculus
aaaacagatcattttggtaaatttgaggtgttgtaggaccgcttaacccagcctggagaatttgagaccttttggccaatctgatgtctaaaccacccaggatgagtacaattcattgcagcagagttgggaaagggcctttcccaagtagcagaaacaagattttcaaagactcataggtcaggaagacctcgcaacgtgatggacagcaagtagtttagtagagctgactgaagaagaggaaattggggaaagtgggacaagcaataagccaggtaaggagaggtaagctagtgccagtttgtgataagttttctatttcctgctaaaggttttgaatttatcctgaagcctattaggagctattcaaaaatttttaagtgtgaaggtgatatgatcagattgcatttagaaaaatctctttgacatcatgatgaatgatacagctgtagagagatcagttgtaggaacttaagaaatgatgagggctggaaataaggtaattacaatagacttgaaaggaagtgaataaattccaaaagtattaagatgggttagaaaaaactagatgctgaattgaatatgaagcaggatgataatgtaatttattgaagcattcattgagatagggaaataggttgataatcaggattggataggagtaggggtgggaaggaatatgtcctgcccatgagtcatcaggtggaactatccagaagcaagtacttattcaggtccaggtcctatcaagaaatgtggcttaccaggagtttgaggctgcaaagagctatggtcacaccactgcactccagcctgggtgagagagaccctgtctctaaaaaaaagaaaagaaacatggcttaaataaagatttggagacatcagcatgtagagggtgactcaagccgtgaaaatgattgagatgaaccaggaaagatgcagaatgagaagataattattaatatttgctctgagtatactgttttctgtatcaatatcatctgataatccctctcatttggcttgtca

SEQ ID NO: 5719 - DNA, 1313 bp, mus musculus
tctgtacacgttagatgtaagagtggggatggggttatcacacacttttaagaataactattttattggacttttactacatatagacacattttaggacggatttcatctatggcaaactacatttttgaaatattaattgtgttcagtcccaaatgagctgttgcagaattagtttgcctgatggacaactttacatacttttggcatgcaatacttctctaattgggagatggcctttcttttgaacattttaattttttccattttttatatccccaattttctaaaatatagattcatttattagtcaccaacaacgccttgacattatgagcttcttgacataaaactcttgaaaaaactatagtttaaatgtcctagactaggttaagtgagtgaggtacctgagatgcaaaatttaaggaggctgtcactgttagtgtcatggtgtatctctttgagagttaggccctaagcacatcactcagtaccctagtcccagctttgggtcagaagctaagcattctggctgtagaactgcccaagggactagtactaatcttgacctgtgctttcctctccctcattccaatttgctcatgtctagccagactttctgacgatctagaggtgacattaggtcttattgctatggaaatggagactattcctctgcctttacatctgtattagactttcttcatatttccaacctgttccaaaaattgaggggtgctgtagaaagttttcagtatctcttaggcaatgggcatgctagaattcacttcaagccttcaggaggagtttggtatgctacgctgactgcccttgatgggatttgtatttcctggggcatttgcaatgacggaggcccgaaaaaagctgcgcgggccaaggtcaaagtttgtgttaggctccttagccctagggatctttagcttccatttgattttcttcatgtgatctaaatgagttgaacttataaaaatattttcaaggctactctgtttgctttttatttttttcaacttgttaaatgctatacattgatcttttaaatttcatagggaggtaactgactaatttgaagttctcataaatgaatcaatagggttgctacattatgaaagaattttactaagtttcttctataatgcagactgaaatataagaccattttaatttatcaccaccatacagtaaaaattagcttatgatatgtaggttcctccaggattctgaacaacttgccacatagcagatgctcagtaaggcatattaataaacctacactttatgaacatactttg

SEQ ID NO: 5720 - DNA, 1313 bp, mus musculus; identical to SEQ ID NO: 5719

SEQ ID NO: 5721 - DNA, 742 bp, mus musculus
gaagagaaaaaatagtaagggaactgattttgaaatacattcctataaaagtgaaaacactgttaaatttaggttaataaaggttgtgctgctgtaacaaataacctccatattgcagtagcttacataaataagtttaagttctttttttttcatgtaaagtacatagttgttttttgcttttttcttttttcttttttttttttttttttttttgagactcactctgtcgcccagactgtagtgcagtggcgtgatctcagctcacggcaacctctgcttcctgggcacaaacgagtctcatgcctcagcctcctgagtagctgggtttacagacatgtgtcaccatgcctggctaatttttatattttttgtagagatggggtttcaccatgttgcccaggttggtcttgaactgctggcctcaagtgatctgcccacctaggcctcccaaagtgctgggattaaagatgtgagccaccacacccatccatcttgtaaagtacactggaaatctgggaaatgttctaaggcagcgagcctccctgttatggtctaccattcagggatgcttttaatttatggcacttccacttctacatggggtctgtgagtcatggcaccagagagagaaggctggagacttaagcactagttatctcatagtcacctctagttatattccattgtgcaaattaagccatatcttatctctggtgggaggagaattataatgttctca

SEQ ID NO: 5722 - DNA, 426 bp, mus musculus
agaccaccagaagcttagatttgatagtcctgctgcagtactagtttttgagggttaaaaggtaaataataccttatccatgtcttcaagagagtcatagtctagtgggagaggcagagggttatatagctttgtgataaatcctgtaacagcagtctcaggatgctccacgagcaacaaggaggcacttaacactgtcttgggcaatccatggtcaaaaaacgaggctggaaaaacatgttggggctgcatcttgaagagcattccaaagctggtaaaatttgccctgttaacaagaattgattgaggattttaaaacggaagttatggaaacaataggaagattattctggcttatgagggataggtgaattagaatacagatatggctcaaggaaggagagtatttctttagacaagagatgt

SEQ ID NO: 5723 - DNA, 1329 bp, mus musculus
tggctggaagttaaagatccaactattgggaggagcagggcctaagaattgaggctggacacttggccggagacatcactgatatccttgaaagccatatgaaggattttaggctttgtcctgtaagtcaggggatagcccctgtagaatgttaaataagggagtgaaatgccaaatttatatttgataaatatccttctggttattctctggaagaaagcttggaaaagaacaagccaagaagcagagagagacaataaagtactcccacaatagtcccaggacttgacaatagaaacctgtacctgtctcgtggaagtgaggatggaaaatgaggaagatacctagaacatttgtgaggaagaattcacaagtctgatgggctgtgaagggtgagaaatagggagagagaaaaacctggaatccctcagatgactgcttttcttgcttaagcagtacattcatcaagactaacagatgtgtcttaaaaagatgactctgggccgggcgcggtggctcacgcctgtaatcccagcactttgggaggccgaggcaggcggatcacgaggtcaggagatcgagaccatcccggctaaaacggtgaaaccccgtctctactaaaaatacaaaaaattagcccggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaaaaaaaaaaaaaaagatgactctggctacagaactaataatagattggtgtgggaccaaaagggggtgaaagaataaagggttgcttaacagggtgttttctgtaaataccaaagcctccctaggcacctgctgtagttctgtaaatgctgccaaggaactggcccaataactcttccatctgagcaaaactgcagcatcacagagcccaaaccctctctcttttcattttcccaaaatctgtgtggctgcaatgaagggaaggtttcctctgaggtcctttcagctcactcatctacaattttcccacatagcccatggcatacactcaatgtattatccacagtagctttactagcttggttcataaaactacttggaaaatgcatgattgagaaacttttaagagcttcagggaaaattaaactcaaggaagaagatcatcagggaaatgatgaaagttgttatcaatgtttttactgtaatttaaatgaaataatatggaaggatatttaaattcaatataatatctaa

SEQ ID NO: 5724 - DNA, 1792 bp, mus musculus
cttcaaatttcttaaaaataaaaaaaaaaaattaccatgtggcttggatcaagatggagctcatctttgaccatattgtttaaagaaacaacataatgttagttgctctagttttaaatctcatagaaatagtctcttaatttgtcatgagagtagtgtaccctcaaacgcattgttgtctcttactaaggaatttattatcacaatcacatcgtttctttaaattgacaactgatcagtgatttcataagctaaagtattttctaatgtactgtagcatttgtcatcacttactctcttttataatacaccagtttctattttgttttatttaaattatcttcccttcttcttttgagtgttgtggtctgctctttcttgtctttcttataattctttttccctcaatccttcatccatttgcttccatattacttcactttttttttttgtaatgacttccagaaaaaaagtacataaataacttcttcagtgtatgtatcatgcaaaatgttttgtataagatgggatagctgcaagttatacacctttggatattaatagtagtgatagttttgtggaatgattgaggacaaaaatttctgaaaattaggtacttggccagaagattatgataatcggttgttttcctatttacattattttaaaaccagaccagctggacacggtggctcacgcctgtagtctcagcactttgggaggccgagacgggcagatcacgaggccaggagatcgagaccatcctggctaacacggtgaaaccccgtctctactcaaaatacaaaaaaattagctgggcgtggtggcaggcccctgtagttccagctacgggaggctgaggcaggagaacggcgtgcatctgggaggcggagcttgtagtgaacagagatcctgccactgcactccagcctgggtgacagagtgagactctgtctcaaaaaagaaaagaaaagaaaagaaaacaaaacaaaacagaccaccatgactttttttttttttttaaggatagaaacattgaattaaattatgctggtttagaaattgaatccagtgcagctcattcataatagtgatggtgcattaaatgtagtataatttgtcttgcaggcttctcatgagaaggaactattttaaactgattgtagacctggcacctggcccactttctgggtgatctcccaagtgtgaactttccctacccttagcccctcctttccttcctggaggtggctgatagaggtggattatactgataattacacaagcagtgtcagttgcacacatgatttgcataactgtgctgtgctgatttcatccatcaaattctgatactgatgcctttggtgcctcactgtatgctttgcaataaacactgaagaaaggagatgggattaatattttcattcttgactcttaaaacacacacttgaggtcctactcattgaaatttacctagaaggtaaaagccactttcagtcaggccggctgtaagacagcccatttgatttccaccaggtagaacgcctctttccccctaccccagaccaataaccattatgtatctactcttcgttattgtttctaataaaagaaagtaaaacttttaatagcatatacaatcacatcttttatgaattgtagtagtcatgcttctttcagaccctatttctagaaggaattaataagcctttcttttataattctatgcagctcttttcactttggtgcaagtcatttagaagatcaatttattgtaggaagctttccttcc

SEQ ID NO: 5725 - DNA, 1792 bp, mus musculus; identical to SEQ ID NO: 5724

SEQ ID NO: 5726 - DNA, 1070 bp, mus musculus
tgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttattttta

SEQ ID NO: 5727 - DNA, 1070 bp, mus musculus; identical to SEQ ID NO: 5726

SEQ ID NO: 5728 - DNA, 1241 bp, mus musculus
aatttactttctaaatgtttccctttagttagttaagtttaaaatgtgatttcctccaggaaataatgataatctctctcttttgtggctgaaatgtatgccccactctacatagcatacttagagtcagtgatgtggatcccaccctcatacacccttactctttttttatttgaagtaataaaataaaaacctttatcaaatgaaatgagttaatactgacagcgtatatttgaaaatgaaaaattgtaaatttataagcataaaagtatctccacactaataagaggaattattcaaagaaagaaaaaatattttacatgggttttagtgtgtgaatcatttcctttgtgatgaaaatgatcgtgtttaatgatatgaatcatatcttttaacagttatgataaatcttctaaattcaaactgaaaattatatatcagagtcttccaaattaaaaacaaaagaaaaaccctcccagggtgagttagtaatttttagagctgtattatctctcagtttatgcacttgaataccacttggtaaatgtacctgctgcaccaaagtatactttagtttcatgcagagtaaagataactcattatatcctttttatcatttgaacatcaatggctatggaaaaagtaattttcatcctgggtaaatttgctcatattctcaaggtgtacatggacctgactttgagctgtgtgtatagggttcttggtatattatttagtataggtctagcacattccagagcagattaatcatcctctaaatgctcacttctcacaaacagaaaccaatgtatcgacctccatgtgccctaacctgctgagctgtgttgatttgatttatgggaagttgatcattcacactaataatcttttatcaccttatgtatggggagcacaaggcattgggttatttttttggcttttgcaggagtctatccttagaatacaacagtgatttataattatttttctgaagtatcatttagatattctaagcaaaaagtctcatacagtgtaatataattagtactctatttctgaatggactttccctttcttgctttttttgaagcagattatctaagctcatttctattgagagagatctgctaacaaagcattcaagttagggttatcactgtcaaaatgaagtggaaaatggcaacaactccttttttcattaaaagctaaataaacaaaaattcatttagtattaaaaaaat

SEQ ID NO: 5729 - DNA, 994 bp, mus musculus
ttccctttcctttagaattagatttttttctcactaatctcttgagttgacacagataattataacatatgttccatcactgactagtccagtttaaagaataatagaaaatgtgagttcaaatattcttgagctatttgtaagttactccttggatcacattttggggctcagtaaaaccatttctttgcaatttagataaagccagacctatgaaattcagaaggaaaattcaagctgaaggttcctatataaaataatccaaaaggacaaattttaatgcatatattgccaagtatcaactctccaaacctcacaataaggcacagatagttgcatgaacttagtctatttgaggacttagtatcttcaaattgatcccaaacagtttaagagcgtgggcttaaatgaatctatcttcactttatatatgtcaaattattctttttaaatatttattttcagcctacccctcttgtattcccatggaaggagctgagtatatttaatattaggagcacatccagaagtctttgaagagggggatggctcttcatattcatgaagcttgcatacttctgttggtcatccctggattggtcacctctgctgctatcagtcatgaagactatcctgctgatgaaggtgaccagatctccagtaatgacaatctgatctttgatgactatcgagggaaagggtgtgtcgatgacagcggctttgtatacaagttgggagaacgatttttccctgggcattccaactgtccatgtgtctgtgctctagatggacctgtttgcgaccaaccagaatgccctaaaattcacccaaagtgtactaaagtggaacacaatggatgctgtcctgagtgcaaagaagtaaaaaacttctgtgaatatcacgggaaaaattacaaaatcttggaggaatttaaggtatgcgttaccctccatatttattgaaatatcaacttttcataccacgtgcttagtac

SEQ ID NO: 5730 - DNA, 916 bp, mus musculus
accacagtctctaattatcttaagcttttagtctagtgaatatcttccctcttacttttaaggtgccaagtgtcagaacttgttgctgtttgttgaattccaagaggcaatggagaaaatgtaggaataaactacattttcttctacatttaagatgtaaagggaacattttcttagtagaaaatccttacttttcagaaaataacttcttaggtaaagcacatcattttaaccctttttgcagaaaaaaaaaatacaatgcttctggttcaaggtggcaatttgagcacatatgtttgaatcctcctctttcccaaataaccatgaaaatgcaggagacactttttagcattgctgaaaccacaacagggtgacatccacatgttcaaactgagtggaattcatggaggatatatgcagatagaagaagttgagtgatgggcaagacgaccaatggttttctgcacaagaagaagccagtcagagaagtaggtggaagcaccttctaccccagagagggagctggaggaaagggtgggctttgggggggtctttgaggtgcaaatttctgtgacactggtcatagctcacatagagagcgattgctgccacggctcttaaattatttgaactcacacattacgtagctggtcattcctaggcaaaaagccagggcttcctttgctgaatcctaacgaggcagttatgccaggtaggaaagggaagtgctgccccagctagctagatgccgcaacagaggaggcaaggaattcctccaaagagagaggcacacttgggtgtgatggcctttggtttgaagctggagttccttcttactccccaagttcatgggccaccagcctgagaaagcagtgaaaatgctttcctttgtctgttttcttgtttttgtttttat

SEQ ID NO: 5731 - DNA, 1658 bp, mus musculus
ttcactgttttcagaacattaaatgaagtgttaccatgaagaaggcacaaattacttaatcctcacacaagagccagtctcattagctcacactcacacctcttaggtcataccatggccatcaattatacccggctgatgctgcaagggacaatctcactgctctgtgacatatttttctgtcttacagattctaggtctcaaaatataaggaatgacctcacgagtcacagcccagttgttcctatatgtagttagaaggagatatctgaaggttggtacactgttaatattattcaatcatttcagctctcttctcaacctctctattctcaacactcaatttcaagtttatggcaccactgcgattctagcccttccatttcccactcggaatttctgtgctatcgtccctcaggagctccttggatctggcatcctctctaccgtcaacctcacaccccaggcaagaaggggaaatcccagaggccataatcctccagccatctgggaggcacccagaagacaaccattagcagacactctgggacttcaggcagttctgctccttgaaacaactgtcactggagaggcgattttacagcagccactgttgtcaagtggaaatacatttttagtaataagaataacagcaatggacggataagctggctcttctggaacaaccatccagggatattccagccttacagttctatcaggtcaagcaaaagttgatgtttctacctcaccagggagcactttagcccttaatctcttttacaagcagcagaggacttgaagaccaaatgacagccagggacctggccattgccgggtagcctaggaatgtgcgaccactaaggaattgaagcccttctctgtgtctctgtttttctcacttgtcttctttccagctgtcctataggtgtggtaaatctgaatgcacaattctcaaaaaccataactcccactttttctaggtgccaaagagaatgttaaaatatcttcaattatccattctctcatttcaacttcagcttctagtattgattaagaagtggagaccacctcatctgtcctcctcaatcttattcatgcactactgagacgcacctacaggaggagaaacacttccaagcacacgatgtgaatttgtatctttacacacctaacataccgactattcctgaatccttatccagtttgaaagagaatacaatgcaagtaaaacctgaattgattttagcctgatgttttcccgtggaacagggactcataaatcactccatatgtcaaactctgcccttcttccccgattcagtaatcactctcttagtaacttgggagatataaactagacatttgtatctaccaggggttctatctggcttatttatttaattcagctgagaatttggggtgttatgtttcattaattcaccaatgacctattttaaatcaacgattctgagccaacttctttttgagatattggacttgatataaatacaatgcagaaagaagtaattctccattctgggttaacttcattattgtgctaagtattcccataagaaaaaaaaattatcatatgctctcaagcttcacagacatatttttgtctgtatgtttactcagaaaggagataaagtcta

SEQ ID NO: 5732 - DNA, 294 bp, mus musculus
aatgaagtaaagcatcttaagtgtttaccatagagtctggcacataatgtgttcaagaaatgggaggcaccttcatcaaatgtatcatggttagtatactttttacttgcttagaaaatagggagaagaggttggcagagattggaaggagagagagagaataacctgcaaatccatcattttaactactaggcttctcaagaaggctaggtcctaaaaacaggtatgagtagatgttctttaggctcacagagcactgggtgtgatcaaagcatgtggtacccgggcacaaca

SEQ ID NO: 5733 - DNA, 977 bp, mus musculus
tctgacatgctggctctaggagaacataaattccactactagaaggtgggcagggacttggttcactgtgtgcctgtcccatcaaggtgctcaaggacaatgtttgtggaaggaaggggtaaactgagtgaggcttggactcaggaactaaacagaattaagaataagtagagagggtgtaagggacagtgagtagctaggagttgggatgttcttggcaaaacagttcagcctagtcagaataatgcagcaaaactactggcatatggaaggactagactctcacatcttgattcccaggccttggctaattcaggatgaccacaggaatctcacttctctgtttttctcttcaattaaataagattgaattagttggtccctgagaacctttgagttagttatgtgattagatagagttgaggaaaacccagaaaagaccagtacccaatatggatgttgccagtggcttgaggaggtgagaaggagggcgtggtacctttgctgggctcccatctatcaactccatcctgcccatgctcttcccttgctctctgccctcaagggcatgggctctttctctgctttctgctttccccgtctttctgaaccagctctgctcagtgcccacatttcctggcagcatagttggcaggcacccttaggagcacctctgagcagagcagatgaggacaaaggggcatggacctcaacatgaggcagtgctgtgccaggccagagtcagagggcaatttatgccccagccagagcaaggaggtggcacaggcaagcagaatgcactccctgggtccctctggatgccaaacagcactggaaattttcacgaatgctaaattcacttgccactttacaggaagcgctgagccttgagccatctttccttcagcagttccaattttttccagttgcctttttccttagccatcaggaccatctgcccttgggcatgtgggtct

SEQ ID NO: 5734 - DNA, 1545 bp, mus musculus
ttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaacagcttgtctttgttgctacatgagtgaaaacagcagagaactttctcacagttttcccatctcagttccaggcctgctaacttgcagttaggcacttcaagagttttgatcagaaatgatgcccaaaggctgggcgcagtggctcacacctataatcccagctctttaggaggctgaggcgggtggatcacaaggtcaggagttcgagaccagtctggccaacatagtgaaacctcatctgtactacaaatacaaaaaattagccagacatagtggcaggagcctataatcccagctactcaggaggctgaggcaggagaatcacgtgaacccaggaggcggaggttgcagtgagccgagatcgcaccactgcactccagcctgggcgacagaatgagactctgtctcaaaaaaaaaaaaaatttttttaaaaagagagagagaaatgatgcctaaaatatgttcttcccaaggcccatgggcatttgttcagggtttacgatttgcttatctcaatgtttcccaaagcttgagatacacaagtgtaccactggccaaagtagggtggctgtacatggccacagcacagcaatcaattggacttcaaggacacggtcttggcactagtctgtctttaatgtctt

SEQ ID NO: 5735 - DNA, 1545 bp, mus musculus; identical to SEQ ID NO: 5734

SEQ ID NO: 5736 - DNA, 991 bp, mus musculus
cctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgc

SEQ ID NO: 5737 - DNA, 991 bp, mus musculus; identical to SEQ ID NO: 5736

SEQ ID NO: 5738 - DNA, 773 bp, mus musculus
ataagatcttgtttaattctgaggttaatacagttattacacccactggaacagaagctctcagacaggccttggactgtttttcattgttctactctcaacaccccagtgttgcccggcatattagatgattaacacttgttggatgaacttgttcaatgaacacctattttatagatgtggagactgagactcaaagactcgcccaaggtggtaaatggaggagttgggattcaaacccaggttagcctgcaccaaatcatatgttgctcccccacctttttcttaggtgccctcacttcctgctcacagtggttccaggcagccctccagacaccacctcttctcagcctgccaggtcccgagtgcccagacagtgactcaggtgcctcaggggcagggagtgggtgacgcttcacaatgccctgcccaggctctgggaaggagggcatcgatgtagaggggagagtcccagcttctgggtctgaatgggggtagaggcttctttggggccagattttggggctatcagtgccctttggaaaacatcccccaacatctcctaggaggtggtgagggcctgggagaggccaggattgggggtggggagggaggtgagctcttcacctgccaagacggctagggatcgagagaggcagctcgtctcccttcctgtctgctgaaccagccagcccaccctgggcagctatatagccatctccctgaggtcttcctgctagtaatactctgctggcaggccctggcaggcctgg

SEQ ID NO: 5739 - DNA, 1036 bp, mus musculus
tttctagggcccccttactcctccacccccgctttgctgcttctggctccaaccagtgcgtgcatgaccatcacttggataggggctcagggctcctctttccagaaaccctcatgttgagagcagcataaaccagtggttaaaagcaggggctctagagtccacccagccaggttccagcctagattctgtgccccagtagctgtgtgacattggccaagttgttcaacctgtctgagccccggctctgaaaagaggggatagtgcttttcttataggcctgttgtgacaagtaaatgctgtaaatagggtccctggtaattgatattattagggtgccaccaaggtggggtgctaggctaggattatgaggaactgactaaaaggagtggcagggagctggcatcttgtcctttgggccatcggtgtggtcgatacatagtaggtcctcacagaaggtctgttaaatgactggggacgagggcctgcatcctgaggaggggatgaaaaggagagagaagaaaagactcagcccagctcactgccttaccgtgccccttagagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgaggttaggtcctgatgaggatgagatactctgtgtcccgtgcctgtactcccaaccaggattccagcagccttgcctctccacctagggacagaccagtgggatggagcaaggggccagcctccaaccccaccagactccatggcctccttcttccccaccagagacagagctgctgttcctacggcggttgcaggatgtgcgggc

SEQ ID NO: 5740 - DNA, 1036 bp, mus musculus; identical to SEQ ID NO: 5739

SEQ ID NO: 5741 - DNA, 1460 bp, mus musculus
ggctttcatcttcaaggagactatcctaagttccctctcatggcagcactgagttctcagagggtgataatggaaattgcaacatctcttgaggcctaggtttcaaagtcacaaaacattacctatacccagactcaaggggtcaggtaatagataccagctcctgatgggaggaaaagcaaaatcacattgcaaagggacagcaaatggggataagaggattattgtggtcatgctgctaacaatcagtgttttccacaagggaagacaggaattcatagggtggagaattccccactagagagaagacattcaaaggtgttgggtgggtcaaaggagtgacacatgttcactctaattggctttctcctgagttgactgattgcatctcccattcttatccccagacctctcctgggctactgatctgctagagggaccccttcctgcttccagtctcaaaggtgcatggccagagagggattgaggttggccttgtgacccatgttgccctgagtggatgcagcacagaaactgtacaggactggagtctgatgatgaatttcacttttgaataattaaaatgagagttcttaataaggcattgtttagaagaaacacactgattgtgtaggcatgtactgtttattaacatttaataattcaaaaaacattgtgaatactgactcttagaattggaccaaggcctgagccagtgataaatcttgcttaaattattgactttctggcccgacgcggtggctcacgcctgtaatcccagcactttgggaggctgaggcgggcggattacgaggtcaggagattgagaccatcctggctaacaaggtctcaatctaaaaatagttttttaggttttagtagaaaccccatctctaataaaaatacaaaaaaaaattagctgggcgtggtggtgggcgcctgtagtcccagctattcggaaggctgaggcaggagaatggcgtgaacccgcgaggcggagcttgcagtgagctgagatcgagccactgcactccagcctgggcgacagagcgagactccgtctcaaaaaaaaaaaaaaattattgacttttttcacacgggagtatgataattagacaggaagaggaaggaaaatgaggaggggaagctaatgcttctgggggctgatgttgtggcaggcgctagcctgggcactggctcatgcttgcattgctatctccttgccttgcctgtgagatgggaaaaccaagcctcagaaagtttacacatcttgaccaaggtcaagactaactaagactacatgacacagtgaatcaagattcacatttgtctgactccaaaacctttggtttctgcacctactgttctaccaggagataaaatttcagtgccttccagaggtttctctaaagagctcaatcatctactggtgtgtttgctgtttaagagcttgtgctcta

SEQ ID NO: 5742 - DNA, 947 bp, mus musculus
tctttcttgctcagagatgggaagacagagagaatgaagtgatagattcctttacctcaggctctgtgagtgagctcgtcagcctcccaggctccacatgtgaatacaggaagcacctgcacagcccaaaacatcctggccatacctagtatgtcctggattgatgcatcaaatctttagattattcattcttatgtgaaatgaacatcttccaaatagctttcttcatttcatcgcttgatcagcagtaagtagcaagtgcttctgatgttctggtgggaagagaaaaggtatttattttaaaactattcaacttaggaaagtctgacctttagagacagattcaaagcataaataactatctgagaggaacttctcttctccatctctggtttccatgaagaggaattttccctaagccctttaagcttctggaccaaaacttctgtctccctggaaatatattaggttacctgtaggtgagcaatgccattggtcttgggtggaattaatctatcaaaagctatacacatggcatttcatcttcctcctcctccctagatcagtgtgaggcaatgatttttttacagattaaagcttgccctgaactgagccccagacgctaaattgggtgtgcagaggaagtaacagcacttttatttcatcactaagctacattgccgttaactttatcagtaataaagataaatttttttcctgcaaatgctggctcctttgtttacattctcagtttcattttttaaaattcacacaggagggaagggttctatttattggactttcctcaaaaactccaccaggaagagcacacactgtattcaagtattcaaatagggggaaagtggtttagaacacaagccgactatgctgggcagaattttaggatggcccccacatgtggtagccccttggtgttcctgcagtgt

SEQ ID NO: 5743 - DNA, 1589 bp, mus musculus
agaaaacacctgcaaagcagcacagtgacatttgctaaaggtgagatgtaagacaacagttttccatgtaatcgcacaggattggacagaaagaaggctccctcatttacaggccaaagcgaatttgtcagtttcctcaccaggttacatgaacattttctcagatattttcctccaaaagtgttttgtgtagataaaaataacttagatgtgaccgggtgtggtggctcacacctgtaatcccagcactttgggaggcccaggcaggtggatcacttgaggtcaggagtttgagaccagactggccaacgtgatgaaaccttgtctccactaaaaatacaaaaaaaaaaaaaaaaattagctgggggtggtggtgggcctctgtaatcccagctactcaggaggctgatgtagaagaactgcttgaacctgggaggcagaggttgcagtgagccgagatcgagccactgcactccagactgggtgacagagaaagactccatctcaaaaaaaaaaaaaaaagcaacttagatgagtctaaatatcccaccccacccgctactggaatccttcaacagttcctcaatacccaaagaaaaaagagccataacctttaacaaaaaatcgaaggctcttcacaatcttccccaaacctacttttctggccactcttaaccttccccccttgaacatatgttaaccctctgtcatgctacctcacacctgttaccagaccatacctttacccccatgtctttgttcatgctgttctctccatcaggtgtaccttttctgctaattgttgtctgtccaaacaatacccatgtgtattgattccctgtggctgctgtaacaccatgccacacaccggatggcataaacaacagaaacgcattgtcccacagttctggaggctggacatctgagatcaagatgtcagcaggattgattccttctgggggcttgagggaaagacctgttccctgcctctcacccagcttctggtggtttgctggtaacctttggcattcgtaggcttctagatgtatccctgattcctgccttcgtgttcacatgaaattctccctgtgtgtgtgtgtctccaaaatttcctttttctttttttttttttttttttttgagatggagtttcactcttgtcgcccaggctagagtgcagtggcgcaatctcggttcactgcaacctccgcctcccaggttcaagcaattctcctgccccagcctcctgagtaactgggataaacaggcacctgccaccacgcccagtgaattttttttttataattttagagagacagggtttcaccatgttggtcaggccagtctcaaactcctgacttcaagtgatctacccgcctcggcctcccaaaatgctgagattacaggcatgagccaccgcacctggcccaaattttcctttttcataaaacaccagtgctattggattaggagcccactctactacagtacgacttcttgaccaattacatctgccaccaccctgtttccaaataggttcacattttgaggtactgagggtcatggcttcagcatatgagttgggaact

SEQ ID NO: 5744 - DNA, 407 bp, mus musculus
taaatatattattgtcagtcctcagttgctaaaagttatttgaaggcagatggggatgggaaatgtagtagctttgtctcgatcccataactcactggacacagccagggagaaagactcccaccactttttccacttcctcctctttctccagcttcttcctcctccccagctctgttaattttctatttttcaaacatcaggatacacccttgagtgcacatacaaggaagacaatgttagtggaaactccaaattatatgatcgccctccacagctaaaccatagtccaataccactgcaaattatttataaaaatgcctttagtcagcaattctatgattagcctttggaaggaatcttgctggagaaaaatacttatcaacagaaagcttgcaaaaggaata

SEQ ID NO: 5745 - DNA, 1264 bp, mus musculus
gataggaaatagtatctgccatttgttgtgccttggccaggtgcaatactaagcatttagttcatattactgtagttaatcctcacaaccttgtgagataggtactataacacttccagatgaagaaaacaaagattaaagaggtctaatcactggcttagagtcaagtggctgaagtggtcaattggcaaccatatttgttgactttgacatccattcccttatctggtgtgcagtactgttccagccttataagtgtgcgtgccatttgacatacacacattcaatgtgctattatgcagcatttaaatggctgaagttaaagaggaaaaagaccacattgttcctagtgtgactgatttccacaaacctgtctctcttatctttcccagcaaatatggaagtaattttagtgttgctataatgtgttgcttgaagatgctaaagccatttttgtctagggattcacaggtaatctactaggaggaaagggatgaaacccaccaccgttattaccaaactatacagttatctgatcagcacaatacacttaactatttcacgatatttgcaaaatgggcacagcccacaagagctcagaatgtttgggtaccttggtgttcctgcactgctggtgctgcatcagtggaaacggcaccctgaagggttgctggagattgtcctggcgcttcctcctccctttcgtctcctgattctctccctgagcctgaggctctctgactacttgcagtgagtttcatccggagggcttgattctctttctccagtttgtggatctctgcccgcatttcctggataagtctcatgagctggatatcagcttccattgtctcttctcatgttgctctagttggcttctttgggagagacaggtggacttttcctcatgagcccaaaacacaatctactcagtgggtctggctgatcctgctcataaacctttccaaacaatagctgtcactcttctctgcgccatctttcagcacctggggggttaggctgtcaagggaggtaaaagatcttccatgaagtattcattctgggttttgtttttcaaaacagagattttctttctatctttcatttcatgtcaatccacagttctagaatattgctttgtgtgggaggagaagagaacactccacaaatttccagtgaagaacagtttcttgtttccatcatgaacttaccatcacaacagccactcagtcttttctctattgccacttctgggatcaaatgt

SEQ ID NO: 5746 - DNA, 1766 bp, mus musculus
caaattacttaactccctcatttcctaatgtaaaaaatgaggataattatacccagatgataagtaaaatgtggaaaacaaatgacatagtaacataaagtaagcactgatgtgtccggaattggtgggttcttggtctcactgacttcaagaatgaagccgcggaccctcgtggtgagtgttacagctcttaaggtggcgcgtctggagtttgttccttctcatattcggatgtgttcggagtctcttccttctgatgggttcgtggtctcgctggctcaggagtgaagctgcagaccttcgtgctgagtgttacagctcttaaggcagcacatctggagttgtttgttccttctggtgggctcgtggtctcgctggcttcaggagtgaagctacagaccttcacggtgagtgttacagctcataaaagcagcgtggacccaaagagtgaccagtagcaagatttattgcaaagagttaaagaacaaagcttccacagtgtggaaggggaccccatcgggttgccactgctggctcagcagcctgcatttattctcttatctggccccacccacatcctgctgattggtagagcccagtggtctgttttgacagggcgctgattggtgcgtttacaatccttgagctagacacaaaggttctccacgtccccactagattaactacatacagagtgttgacacaaaggttctgcaaggccccaccagagtagctagatacagagtgtggattggtgcactcacaaaccctgagctagacacagagtgccgattggtgcatttacaatccctgagctagacataaaggttctccaaggccccaccagagcagctagatacagagtacccactggtgcatttacaatccctgaggtagacataagattctccacgtccccaccagactcaggagcccagctggcttcacccagtggatcccgcatcggggctgcaggtggagctgcctgccagtcccgcgccatgcgctcgcactcctcagcccttgggtggtagatgggactgggcgccgtggagcagggggcgggcgctcgtcggggaggctcgggctgcacaggaacccacggaggcgggggaaggctcaggcatggcggcctgcagtcctgagccctgccccgaggggaggcagctaaggcctggcgagaaatcgagcgcagcgccggtgggccggcactgctgggggacccagtacaccctccgcagccgctggcccgggtgctaagcccctcattgcccggggccggcagggccggcctgctgctccgagtgcggggcccgccaagcccacaccctcccggaactccagctggcctgcaagcgccgcgcgcagccccggttcccgctcgcgcctctccctccacacctccctgcaagctgagggagccggctctggccttggccagcccagaaaggggttcccatagtgcagcggtgggctgaaggactcctcaagtgccgccaaagtgggagcccaggcagaggaggcaccgagagcgagtgagggctgtgaggactgccagcacgctgtcacctctcactggcataaagtaagtcctcaaatgctaatgttcttcacgtagatgtggccatttactttatgtacactaaattgcaataaaagaaagcttaatttgagagagaatgtatctgaagaaaaccttcaaaaaagctcagaaagggaatatagtctcagtgcttttagaaacagcacatttgactggcttaaaa

SEQ ID NO: 5747 - DNA, 1232 bp, mus musculus
atggttttacactggagttctaaactggagttaatggatagaattaaaggagtctgtgaacttgggaggaaaaatggatctttcccatgaggaatatttaattagaagtcagcatttccttctattgtgaatataagcaatgcacccacccccacctcagcattgtaatgctagcagtatttctgaacttttactgacaacaaaaaatcagggatattttcaaatcacattacatttttcagatattttgaaatatcattcatgtttaccactgtttcaaaattactgggctcatgcctggatatttttattttctgcattcataagctcatgtattaaggtatcacgtatttgattttaattactttaataatcatatttcaatatattcagtttccttagtagtctcatgcatcttattttatgatttgaacagagctggaactagggtcttgcaaggcacaaactggaaggtgaatgtttccttcaggatcaggtgccaagggtactacatgaaagagagaactggctctcaggtctttggaagtgcaggatcagtgagggtagaactagcatttctacagatccaagagtgatttcttaagttttgcaaattcaatatcttcttttcctcaccctagtccaggctctgtctttcaaaacactatcctgagtgtgattcccttttcaattgtaattcttgaacatgtcctcatccctcagggaagtctagcatacccatgaagtgtgcttgggaggcgtgaagaaaaggaatccagagaagggtggtttttctcacattccagtttctcttctttccttggaagacagagcaacagcagcccattgaaggcactgtggccaagaattctgggacatggcatgaccgactgcaaaggaaatggagatactaagcactgatatgagtggggtggtcactgagataacgacacaaacttgaaaaaaaaaaaaaacctctcataagggatgcaagatgggcccaacactttctgaatatccattggaagtagctgtgtcctaccctaatgctcagagtctgtgaccatgtccctgggagatttcttagatgggcttaatccttaaggggctatgagaatcctgtaaaaaaggcaactttctcaggctagtagcataaaaggaagtcagaataatttaaagcataataggtttttgaagaacttttgttggcttggagatggaggatagacaca

SEQ ID NO: 5748 - DNA, 927 bp, mus musculus
aaaatagccacacgtgccattaacaggtacttagagccttggtttttgatatttgaaaacaccatacttccacactgtttgctaacgaagttcattgaaagattccaaagtatttttgtggcaggaaataatcatttcatctattcctgctctcattcacccgacaattactgagcacctatggaaagctagatccctgtcgagggtattgaaaagaaagatgaatgagatgttgtgcaagacccaggaagctcactttattagtctatcaggtagctatattcatggaagactagaatataacttgtgtcgtaagagatgtcatattacaatgccaagaggcaggttgtctgcaggcattgcatactcatcttcatcagcataaaacaaagttgaaactgtgtgctcatgacataaacaaagctccaagatggtccccttgcctgcccccactatccttcccttgcaaatggattcttcctctgagtctcccatgcagaaattttgagatcacctgaagaagtaacattatatagaaagttattctattcttctctctgagccttgggaggtgagctcatatctaaactgagatttaaaggccaaatgaagatttttctggcaaagaattgggtgtacggcattccacacaggagaaaggacaaaaattttaagccaggcaacaccgccaatcatcataatgtgcttggagagtttccttctcctcagttttctttcctacaatatagaaacaatcattcccatgtctttacaatcctgtgcaggttgcatgcttgaaaaattaagtgtgctcaacaaatgttacttctcatattctttcctgtgctggaagaatggcatatgcaagtgtatgtgtatgtgggcaggaaaagaaatgatgtatgaagagaatggtggcatgtgtga

SEQ ID NO: 5749 - DNA, 953 bp, mus musculus
tgagtcaaaaaaatttaagctccttatgcttatagaagggacctaggagtaaagagtcaagaaaggacaagcctggatcatgggaatatcgtgcctggagacctcacatgaggtcagtacttttgctggattacttttagctgtcatgccacgagccttgtcttatgacattcctatttttttgccactcagatgttgttgagaatatttttcatgataggcacaaaggtctctctgtgagcaaccactggagaatgttttttttttttttttcatttctagctccaacaatagatgtatttctcataagttattagctttgcttttcatcctacaggcgatgtaagttgtgaaattcatcacgtttcctttttttatatttactgctatgaaacccaaccccagacaagtccatgatccatctcttctgaaaacagtctcccagatgcctagagcacagcaatcgaggggccgttctcaggatgcctcgctagcctcagattctgacctcacagcccagcaggtgtgcagcatgattgctaactgaactctcagttcaccttatttttttctcagttcatgatttcctcacttccatgtattattattttgtaggcagttttaatatatctatcttcaatctgaggagtgtaagtagattgtttaaagctatagaaaacccaatgctcatcaaaatttcccagtcaaatttatctgctgtattattaggactttcagagagatcatgagcctacactggtatctgtatcatgttcacagatttgtgcatttataaaattgtttagctaacaaaaaagtgagactgcatattgcaatgtttaaccaagcaggttttagagccagtttaatggagttcaacttccagctctgtcatttaacagctatgagaccaaaggaaaattacttaacctctcttggtttcctcatcacat

SEQ ID NO: 5750 - DNA, 3733 bp, mus musculus
ggtaggggtgggtctccctgacatgcccttgtggagacctgcattttgtcttcatggcacttatcttaactgtgatgaatgatctgtgcacagcctgttcactgcgtgaaagtcacgtgaggtcagtaagtggatgggtcttgtgtgttgctgtatgtccagctccccatgcctcacacagctggtacttcttcaagtatgaataccagtatctgggcctatctgatgcatgtgtgtgagttagaaaaaggtgccccttcctcaattcactacctcatctgtcagagccaattcttgaaaccaaacccttttctgccttctgctggaagattgttgtactaagcaggtaaactgattctgtttctaatatgaattagagcaccccttaaaggtggagtccttgctcagggcacaacccatacaacttcatgcagtggtcctgataaccatataaatgtgtacattacttcacagttggcaaagcactttgatctacattttgccatttaattaccataataagtgagtgttatcagcccattttacagattcaattaaagggcaaaagacttgaatgagctaaaatcaacctatgtgttccaatttcaagccctttttcctttacactaaaaatgtaaatgaacctagaaagcacctactctcaaacactggtggaggcaggagccccggcaaacgttgacagttgtccctcagcatcagtttcttctcccttctgcactgtctgtaacttctcattaaatgcagagtatctgtgctgttgttgcttgtatgatgtgcagtctcgtggcatttctgatgatgtggaaagagcgctagatactgggtctggcatgtgtaaattccagtgccagctccacctcatgtaatatggtgaccaccggcaattctctctccacatctgaccccaagtccctcatctataaaatgaggacagtcattgccttctctttcttacacattgttatgcggatagatgacacagtgcatctgctgctcttactgtttccttgactatcacttttcctcccaccgccccatctccacccccaatcatcccctccccagacccctcatgtatacatcatagagctcccaaatcactccccaggcctgtggtctttccatgcataatttccaccttgtgctccttcctcatgttctgtaggaattcctggagttggtcttctggattatgaattcgttttttaccatgccgctattcctcatctcgattaggcttttcttcttagttttctccaccttgcttttcctttccctgagctctctgttctctaattgcttgcttttcacagcaggctcctcattgtttgctcatgcttcctaatggggacctaaactcaccgctgctgcagctcacctttcaaacaagccagctgccgttagagagccccaagcatcccccaccgggttcctggggctgcagggttccatccttcaaggcctggttggtaagatgagtaggtgaggctgagccagacttagcactattaggaacaggctgccctcaggcataggacagttggctttggaagtcctcgggtctaaaggccccacctcacttgatggcctgcctccactgggtaaggaagggactgatgtttgtcctcacaactctgcacatcagcttgctacccgtggcccccaaagccaccccctgctccctcatctgcttgtgaatgtgtttgggacatttgtgttccctaaagctatattcaccacagggaattagagaagacatttctgtggagacagagaactgtagaagggaaggtccccagagctgtgctaatctccctcaaggtttgcaatagtggtccagagtcacctggagctctgcctttccctcacattaggaacctgcggcagcaaatttcccactcaaatttgataacagtaatgcacgcttaggtaatccttctagtaagttgcagagccaggattacaagcccctcccacccccactcctccctgccccccagtctggctcccaaggccacgctctcatctgctgttccatatttactgagttgagtctagagacaaatggtggagctggccactccatgcaagagggctggctgttgaaacaaagtttttcccaccgtaagttcccacacccccactaccctccacccccatgcctagccttgctgccagcccctgctcctgtgaggccaggcatcctgtagggttctgtcggggggatcacatcctcacttctcagggtccctcctctctcagtctcactctatctgccttgtgtctttccagagaaatgaatggcttcttcgccgctgatactgttccttcacctttccgtcaatgctcttgttttgccatttgttttcctttagctctttcaataactgtttgaggcaagggagagagttggaccaggtgttctcctagattcattttaggtgtaacatcctctgtaactcaacataagacatggacagccccttcatttctccccagagaaacagcccctgctgtctctctttaatgaattcacccatagtgaggttggaggggaaggcagcaggaattgctgagatttattttaaaccctcttgcaactgcttcccctgaatctaaactctggatttctacccaggggttctgagttgccagactgctccatgagcaactgggaaattagttcaaagctctccagggttttcttttattcatcgaggaagaagcagggaagcaataaaatgaaaagaaacagcaaataattaagactgacaccatcccctcagtgccagccacctcactcacccaagtcttcatttaagtcaggaaataagattataaatgaagatttttttttcctctggcaacatgaatgcaaagaaacatttccatcagcacagagagatcagcaggatgcttatagaatagaagactattcagtgacagccaattcacttgcaaattaagacacattcactgaagatgccctatatgttccactaaaatgtttttttttttgatatagtgttggtggcagtggtggtttgttgcaggccactgtgtacacatagcttatctgtcactcgagatgaaagagttcctgcaaactaaccagagaacgttccccaataccctgtacattattggaattcatggaggggagaattcaaaaggaagatggagtgaagactgaataacacaaaactgttctcttctactttaaggaaaacccaaaagtgacactgtggattttcactgttctaagctccccgtgacctgtggtgaggcgaaagggattttatataagaagaaaatgaaacacggtgagttccttggtcttctgctctttggaatccctagatgaaggactcactagaagggaggaaaatacccgtgtgtgtaattgatcaggaaatggaccctgctagctagactgcagaagaaacgcttcttaggaaggaatttccaaactcttccacatcatggtatttctggcaatcagaccctccactcccacctggaagtcacccatgggccctgctgtactgacagccatgtccttgctgcatgtaggcactacacgaatgcacattctgtcccacccctcaccactcagtcaggctttagggctggcttcagtccaagagaagaggcccgcagactcccctgctactccttccacctcacagaggaagtctctcttgacctggaa

SEQ ID NO: 5751 - DNA, 3733 bp, mus musculus; identical to SEQ ID NO: 5750

SEQ ID NO: 5752 - DNA, 3733 bp, mus musculus; identical to SEQ ID NO: 5750

SEQ ID NO: 5753 - DNA, 1788 bp, mus musculus
aattccagtgccagctccacctcatgtaatatggtgaccaccggcaattctctctccacatctgaccccaagtccctcatctataaaatgaggacagtcattgccttctctttcttacacattgttatgcggatagatgacacagtgcatctgctgctcttactgtttccttgactatcacttttcctcccaccgccccatctccacccccaatcatcccctccccagacccctcatgtatacatcatagagctcccaaatcactccccaggcctgtggtctttccatgcataatttccaccttgtgctccttcctcatgttctgtaggaattcctggagttggtcttctggattatgaattcgttttttaccatgccgctattcctcatctcgattaggcttttcttcttagttttctccaccttgcttttcctttccctgagctctctgttctctaattgcttgcttttcacagcaggctcctcattgtttgctcatgcttcctaatggggacctaaactcaccgctgctgcagctcacctttcaaacaagccagctgccgttagagagccccaagcatcccccaccgggttcctggggctgcagggttccatccttcaaggcctggttggtaagatgagtaggtgaggctgagccagacttagcactattaggaacaggctgccctcaggcataggacagttggctttggaagtcctcgggtctaaaggccccacctcacttgatggcctgcctccactgggtaaggaagggactgatgtttgtcctcacaactctgcacatcagcttgctacccgtggcccccaaagccaccccctgctccctcatctgcttgtgaatgtgtttgggacatttgtgttccctaaagctatattcaccacagggaattagagaagacatttctgtggagacagagaactgtagaagggaaggtccccagagctgtgctaatctccctcaaggtttgcaatagtggtccagagtcacctggagctctgcctttccctcacattaggaacctgcggcagcaaatttcccactcaaatttgataacagtaatgcacgcttaggtaatccttctagtaagttgcagagccaggattacaagcccctcccacccccactcctccctgccccccagtctggctcccaaggccacgctctcatctgctgttccatatttactgagttgagtctagagacaaatggtggagctggccactccatgcaagagggctggctgttgaaacaaagtttttcccaccgtaagttcccacacccccactaccctccacccccatgcctagccttgctgccagcccctgctcctgtgaggccaggcatcctgtagggttctgtcggggggatcacatcctcacttctcagggtccctcctctctcagtctcactctatctgccttgtgtctttccagagaaatgaatggcttcttcgccgctgatactgttccttcacctttccgtcaatgctcttgttttgccatttgttttcctttagctctttcaataactgtttgaggcaagggagagagttggaccaggtgttctcctagattcattttaggtgtaacatcctctgtaactcaacataagacatggacagccccttcatttctccccagagaaacagcccctgctgtctctctttaatgaattcacccatagtgaggttggaggggaaggcagcaggaattgctgagatttattttaaaccctcttgcaactgcttcccctgaatctaaactctg

SEQ ID NO: 5754 - DNA, 1788 bp, mus musculus; identical to SEQ ID NO: 5753

SEQ ID NO: 5755 - DNA, 1788 bp, mus musculus; identical to SEQ ID NO: 5753

SEQ ID NO: 5756 - DNA, 860 bp, mus musculus
taaatttaaataagtgatagatggaaacaatgcattcaatatcataaatcaatctttctgttttttcaacagagaatactgaagtctcaaaacaatagctcagttgacccttgtgtaagtacaaattctgaactacgacccccagaatattccactcctttctccaggcatatgttctgtgtcatgactgctgttgcctgaatcatgttcagtctcagctggagtatgtggctgtgtgaattcagttgcatcacccaagccaggtagatgtgcctgggccttggatgtctcattatgaaagcaccctttccatctgtttcagtagaaaccttccaatgtccttatttcccctggaaagtgagtatgggaggctgagctccagaccactgaggtctcttgagacagagcctgaagtggtaatgggtagggctggcctggtgattagggggaaggaacaaatgtgagaggataacagcattttcaagtaagtggtgtggatgaaagggaaagtcctaaaaatgcactccaaggtgcaggtagagttgaagatggtcataagcatcagccagaaggaacagaccaggccaagctattatgttccaggtgttgatcctgtcattagccctgtaaaggagtacatacaaggcaaggggtcctttacagagctcatttggatggtttcagggaagccattagggtgctgagctggttaggactgaaaccatcacgacctagcaaatcctgaggcattttaactcaactgcttatctggtgctcagtactatgcaaactttctgatgccacaggccccatccattctctgcttgctatatgactgcctgctttggattctgccaaaa

SEQ ID NO: 5757 - DNA, 606 bp, mus musculus
ggtagatgtgcttgggccttggatgtcttgcagtgtgaaagcactctttccatctgtttcagtggaaaccctccaatatccttacttccttattcccttgggtagtgagtatgggaggctgagctctagaccactgaggtctcttgaaacagagcttgaagtggtaatggatagggctggcctggtgattaaggggaaggagtaaatgtgagaggataacagcattctcaagtaaggggtatggatgaaagggaaaatcccaaaaatgcactccaaggtgcaggtggagcgaagatggtcttaagcatcagccagaaggaacagaccaggccaagctattatgtttaaggtgtggagcctgtcattagtcctgtaaaggagtacatacaggacaagaggtcctttacagagcccctatcaccagtctcagggaagccattagggtgctgagctggttaggactgaaaccatcacgacctagcaaatcctgaggcattttaactcaactgcttatctggtgctcagtactatgcaaactttctgatcccctgggccccatccattctctgcttgctatatgactgcctgctttgggttctgctgaaa

SEQ ID NO: 5758 - DNA, 1141 bp, mus musculus
tgttcaatgagcaggagcaggaggagagtgttgtctaggagaagcccccttttatttatttcccttctgagacagggtctcgctctgtcacccaggttggggtccagtggcaggatcacagctcattgcagcctcaacctcccgagctcatgcaatcctcccacctcagccccccaagtagctgggatgacaagcacaccaccacacccagttattattattattattattatttttaatagagacaaggtctcactacattgcccaggctggtctcaaactcctgagctcacgcgatcctaccaccttggcctcccaaagtgcttacaggtgtgagtcactgcacccggccgggaagcctctttttaaagtaaaggacatagactgcacagattcagcccagactccatctatttatctatttaattgagctcctacaatttattgagcttctactatgtgtctgacactctgctaagttctgaagatccagagatgaacaagacctagtcccttccctgaagagtttatagttcagagcaggcattagggaaattttttgcaaagggctagattacaagtgttttcagttttacaaaccatacagtctctgtcataactaccgtggtctgctgtagctccaaagcagccactgcagacagtgtgaatggacatgactgtgtccccacaagacttgaagggcagcagcctcctggcacagaggtggagaaaaacacacaaagcctcagagcacctgccaggcccctgctgaaggtagcagctccaggcggccccataggcggcatctcacatggccccatctcctccgccgtggttgactggaccagggaggagcacgtgattcacaggtagcccatcctcaggctgccagtgatggacacgggtggagaggccagcagagatagtggccgccagctgggacaacggtggtaggagacagagaccgaaaggcaggaaggatagagcagagccaatagacttccctggaccctcaagcccttccaaacctgagccgtgttccaggccccatggggacctcccgggaggtcttgctgtgagcctgtcctgggacccgggcaggcttgcacggagctgagagtcctgtcttctttatttccat

SEQ ID NO: 5759 - DNA, 1046 bp, mus musculus
tgctgggctaccttagagtcctccaagcacagaaggggaatcctggctatggagtgtggtaggagggagggaccctaaacagctggggctccagtaaggagttagaggcagttggaatcccagaggacagagatcagggtctgggtctccgtgtctgccccagagaagagctcagagtgtctctgtccccagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctccgcccgccaggaggggtgccaggacatcgctacgcagctcatctccaacatggacattgacgtgcgacccccaggccaagggctggggctgggcagagagtagcagggagggggcactagctcagacccaggcaaccaaaagccttatctgggccagcagggtctggaggtggggttgtgggcgtagaaggtgcagcccaggctgggccattcccacagccttggggaggggagtcaggggctgtgcatgaggagggggcacggggccagccagggccccaaatccacctgccccatcctctgttcccaggtgatcctaggtggaggccgaaagtacatgtttcgcatgggaaccccagaccctgagtacccagatgactacagccaaggtgggaccaggctggacgggaagaatctggtgcaggaatggctggcgaagcgccaggtgatgggggctggcgggtgcagggggcacagcagggggagggcag

SEQ ID NO: 5760 - DNA, 928 bp, mus musculus
ctccagacaacatggcagggaggccctcgcgcacacttccctggacatggtgctcatttatgtgccctgagagcctgcggcgagcctggccctgtgccgggccccatgtgtcactgcagaattgtcttccttcagaacgagtcctcgggagccccaggaagcgtgggatttttaggtcccttggtgcctgggtggccacccagggggctgtggggagaacagcccggagccctgccggtccgtccagcctacagaggaggagggatgcctcacgcatgtgttttctggagtttgcttcctagcaagggcaaggcaccaactttctccacccaaactaacaggttttcccacttgcctttgccccacaaggtgctagaaagaggagctccagtccgactgagactggccagccagcctcagctgtgggcacagtgtctggtcacggtggtcactcagccctgtctgtggcctgaccgagctggaggaaggggccgggacagccggctttggtggcctgatgtgccctccttcttgtcccaggtggtgaaggcatgcaacgagggcgtcaggaaaatgagccgcacggaacagatgatcagcattcagaagaagatggagttcaagatcaaggtgaaccggtgggattggtgtgagcctgtgcccatgcacaggcccctggccccgccccagaggcacagatcaccgcgcctggctggccttgcttaggtccttggtcactggccacacttaggatcccctctgccccctgacctccccagctgaagccaccccgcctgccaccaggcgtcagacaccaccacggtggtccggatctgtctcctgggagacgggagtgcggggctagtgtgcggcccagacccacgcagggtgtggaccctgctctcacctgcccgctgcgtggccttga

SEQ ID NO: 5761 - DNA, 928 bp, mus musculus; identical to SEQ ID NO: 5760

SEQ ID NO: 5762 - DNA, 1590 bp, mus musculus
atatgcaatggaaaaacattactgtagcctgagttgatccccattataaactttgggacatacagaatgtggttaagaatgagtgaagatagagtgaatgacagtttgagtgtctgaatgtaagagaacatgatcagcattacctgtgataaacagctctgataattggccacactgaatggttctcactcttatttctgagcctttggtgagttgagtcttttcctgccctctcacagccttcagcaccagtgagcaagacaaggataactggaatgggcagctgaagcttctgctggagtggaaccagctggacttagccaatgatgagattttcaccaatgaccgccgatgggaggtaagcacgaagctctcctgggttattccagtgttgggtctggacagtggtctgggcaatgtctgatccatttccaacaaggtcttcaataccaaatctcttaaaggattgttctgttccagaatatcaggattgctgaggcttaatttccttgtttgcagcatggaatcataacattgacttagtaggtttgttgtgaagagataataaaaataaatggtataaaataacatcaactccacattgccttcagctgcaaagtgagggtgattctccatctgggtgtagagatgcagatctccttctggatgtgtgtgggcagaagtatgggaaaaatatatgctagatgattgaaagtagctcaactataaatccagacggcagcactctttttgctccctgcccccacctgcctagccaaattctgattagagaaccgtccgtagtgagatacataagagacaaatagaacaacttgactgacgctccccagtgaacgtcttagagcaggggtgccggtccatggcctgttaggaacaacaggaagtgagcagtgggcgagcaagtgaaacttcatctgtatttacaccagctccccattgctcacattaccgcctgagctccgccttcagtccgatcagtggcggtattcgattcctataggagcgtgaaccctgttgtggactgtgcatgtgagggatctaggttgtgtgctccttatgagaacctaatgcctgatgatctgacactgccacccatcacccccagatgagactgtccagttgcaggaaaacaagcttggggttcccactggttctacattatggagagtagtataattatctaattatatattacaatgtaataataatagaaataaagtgcacaataaatggaatgctcttgaatcatcccaagaccatccccccagcctggtcgatggtaaaattctcttccaggaaaccagccccttgtgccaaaaagattggtgactgctgttttagagccagaaactcaggacttcccctagccacatgagtaccttcaatatggaagttgcacatgcaataaaaagtgttttttttctttctagcaaactgcattttctcacttttcaatgtgattagtgttttaggattgcattttccagcagtatcctcccgtgtacaactaaagtgcagtcagccctaggagccttgttcaatgaaaattattataaaccatcacactca

SEQ ID NO: 5763 - DNA, 1834 bp, mus musculus
tttgtgttgctgtgatatgtaaacatagatgtcaattttcaacactttcttcttccttttattaaaaaaaaaagttactgtgtttcatcatgattggttaagaattattgttttgtgttcaggttttcattggtaaaagattgaaactgggccccatgctgtggctcatgcctataatcctagcactttgggaggccgaggcaggcagatcacctgaggtcaggagttcaagaccagcctggccaacatggtgaaaccccgtctctactaaaaatacaaaaaaattagccgggcctggtggtgggcgcctgtaatcccagctactcaggaggctgaggcagaagaattgcttgaacccaggaggtagaggttgcagtgagccgagatcacaccattgcattccagcctggacaatgagagcaaaatttcatctcaaaaaaaaaaaaaagattgaaaaagattgaaactgactgccaggcatggtggctcacccctgtaatcccagcactttgggagaccaaggcgggcagatcacctgaggtcaggagtttgagaccagcctggctaacatagtgaaacaccatctctactaaaaatacagaaattagccgggtgtggtggtgcacacctgtaatcccagctacttgggaggctgaggcaggagaatcgcttgaactgggaaggctgagtttgcagtgaaccgagattgtgccactgcaccccagcctgggcaacagagcaagactctgtcccaaaaaaaaaaaaaaaaaagtataaaaatgaaaatgtatcattttaaattagatttacttgtttaattatttactaagtgacagatttaccagactcaaaactttaaattgtttaagaatgaaatagaagcaaaattctcccttcctcctctgctgccttatcctctctttccgccctctccccagatagataactattgtaatcaatcccttagttatcttccgaattttttaaatatacatctaaagtctgttaaattgtgactccaaaatatacattcatgtcctaatcttcagtattggtgaatgtgaccttatgggaaaaaggatctttatcagcagatatcattaagttatctcaagatgagagcactctgcattgaggagaggccctaaactcaacagcaggtgtgggggttttttggggattctttttacttttttttttttttcgagatggagtttcactcttgttgcccaggctggagtgcaatggcacagtctcggctcactgcaacctctgccttcccaggcacaagcaattctcctgtcttagcctcccaggtagcttggattacaggcatgtgccaccatgcccagctaatttttttgtatttagtagaaacgaggtttcaccatgttagtcaggctggtctcaaactcctgacctcaggtgatccacctgcctggggctcccaaagtgctgggattacaggcgtgtgccaccacacccagccgaggtgttcttttaagagaagagaaagtcagagactttgagaagagggctatgtgagtcacaggcacagatggaagtgaggctgccgtcaaccaaagaaggcctaggactgccagacgctggaagagggaaagggggactctccttcgggtcttcagaatgggcccatgtggccctgctcacacttgatttcagacttcgacctacagaattgtgaaagaataaaactctgttgtctttaagccatcgtgtttttggcaatttgttataacagccccagggacggaaaacaacatctaagcaatgcaagaatatattcttttttgtgtgattttatccttaaaag

SEQ ID NO: 5764 - DNA, 1655 bp, mus musculus
attcccagcgtggggctgttatgagcagtgctgctctgaacattctagcacctactttttggtggccatgtttatgtgcatctgtatgatttaaatctgaaagatgtgaaaggagaagagaaatcttaaaggaggaaaaaaaaagaagtggacttgaaatgttttatgaaagctttgcatccagtaagtcaattagaagagtggtgtaggttgtcctgggacagccccgagcttaggaaacccccgtgtttaataagagcacgtaagcaagcctgtccaaagtttgccgtggagagtgacatttactgtcccagacagcaaacagatgtgcccccctcgctgggagtagacactacccctgtctcaccagtctgttcattctgtcaacatcccttgcaagatactaccttaagtctaaggtagtatcttaaggtagtatcttaggtagacttaaggcagtatctcccctttccatctattctttatctagatgggcctaattccaaagtctaaaagctgcagtgtcccctggagcctctcctgtaccttccagcagcggtgggctccctgaccctcatactttctggctgctcttgtgttactctgccttgcgtttgggccacatgtggatctgctgtataccttctactagactagattgtaggttccctaagacagggactccttccttcattgtgcccaatgcagtaggggctcagttccatgcggctgctcggcccgctagaaggtcaatgttagaataggcggcagcttctgcataccgggtcccatcttcccctactcgcgagttagcaggttagcctgccctaggttcctgggtgatgagactcctggatcaaaatgaatgacagtctcttgcagcaatagcaatagtgagagtatcagcattgtcatgcactggcttcccaagcctcagttcccacagggtgacaccagcacacacagtaactcatgttgtaagaggaaccccaagcttaggaaaccccatgtgtttaataagagcacgtaagcaagcctgtccaaagtttgctgtggagagcgacatttactgtcccagacagcaaacagatgtgctccctcttaaagtagacattacccctgttgtaccagtctgtttactctgtccacatcccctgcaaaataacacagagcagagagcacctgcccgtgtccacacccagaggaagaagaaactgaggcccgtggagagctggctgccagcaacagtggggtgggatgtgctggtagcagcagggagagtggaagtcagggaaggatggaagggaagggaagaatggagagtactcaccccccaaagtaggccacatccttgtacttatccccgagtataagtgtaccctcggcttccggggtagaagcttcctttaagacccttgtatttgcgcgtgacttgaggttggtgaattaggaccacttgttagactcacctcgtctactccaggaaggagggcattctaatctggcttttacaatctcctccttctagggaaatacagacatgcctgcaaagaacatttccaacgatggtgcgcagagttttcccacatctaaacgaccccagcttcatatcttactccttagacacgggaatgaaattctgtagcaaaacggct

SEQ ID NO: 5765 - DNA, 1185 bp, mus musculus
caagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatcta

SEQ ID NO: 5766 - DNA, 1185 bp, mus musculus; identical to SEQ ID NO: 5765

SEQ ID NO: 5767 - DNA, 1185 bp, mus musculus; identical to SEQ ID NO: 5765

SEQ ID NO: 5768 - DNA, 831 bp, mus musculus
cactcactggataagaacagtggcttcctcctcactgagctttcactggtgccttaggctccactgttggagatctagttgttttagtcactctgttgtctcatgctggagagaagcgacctttcacatgagagttagtcacttgtctatggtgagtcagatgctatcagctgcccttggtgacaggaggctatggatggatattaatggctgggaggagggtcaggaggccaccagcaagctgaaaagagtggcttggagaggtgacagtaagtcctagaaggagagatgagcctgggaatgtccaactccatcggctgacagggctgacctgctctgcacctgccgtgtgaaaggtacctgggtctgagtcaggtcccgtagggcccaagcacactcacatggacttcctgttactggggctgcaaagagttgctacttccaactggaaggggctctgaccaaattcacagccctggaccaatctttctgtttggcttgtagcaaacttgcaaattcctgtgaggggaaacaagatttatttctcattgaaacattcacagaagaatcaggttcaaataattattcccgacttcacttcccttttactctgcgttgcttcacaaagacgcacacacacgcacacagaaatgagtcatatgttcagctttctgaaagtcaaagagaataaacagatgccacagaggagatggaaaactggcattgttttaataaaaactctgaagacaaaggaaggaacagaaacttaaagatttaaaagagcaaatcccaatggtgggtgattcaaacatctttccaattcccactccc

SEQ ID NO: 5769 - DNA, 949 bp, mus musculus
cacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagc

SEQ ID NO: 5770 - DNA, 438 bp, mus musculus
attgctgaagaatactgatattaataataatgaggttcagaaatagtttactaaattgtacagtgttccacaaattttaaataagtatctctcatgatcttcacaaccagagaaatgttgttcaaatgtattatataatataaatagcaaagtctataaaaagtttctaattacataagtttttgaagtctgaaagacttcctagaaaaaaaaagtcgtgatttttatattttaccagtttctgagtttattttgatcttatgtggagattttctcaggaaaacatagatttttttttaaaagtgttgtctcaagggtaaaaatacagaacatatatttaaactttgaacttatactggcatactaagagggcataaatcagaactgatgggagaggagaaaagattttatttcaacaggcaaaattccatcctttgt

SEQ ID NO: 5771 - DNA, 995 bp, mus musculus
tcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgcattttgctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaaggtagggcagacaactttcttaaaaaaaaaaaaatcctgcttcctcaatgccccctctgtcatctcctttagcccccaatgcctttattctttcctgcttgaattttaatttccagatttaagtttgacagagctagtgctagcttaaaatttagaacatctgtaggaggcctaccctttactaattttcttcctacttacttaggggtgtgcccttgtgattcagttttgttactttaaaaataattacaaacaaatctatttttctcactaaagtaccaaataaatcagaatctttcactcttttaaaacagacccttccgtatgtttgtctctttgcttttcttgtctgtttatgcaattccatctgt

SEQ ID NO: 5772 - DNA, 922 bp, mus musculus
tgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattcccc

SEQ ID NO: 5773 - DNA, 922 bp, mus musculus; identical to SEQ ID NO: 5772

SEQ ID NO: 5774 - DNA, 587 bp, mus musculus
tgggccctacaaccaagcatagtacacattctgggttctgattgcctttttcggattcttttttctaccagatcaccaagtttccataaggtcagctatgtaatgcaaaggacccctttttgggaggttattccaactttacaatctccttgccagtctgagtttctctccatttggtgcctctgagggcttacctctttaacatttaacctcggctatgtgtacttcttaaagagttttatacttacatagcatttacatgtgtttgtagtggaaaagaaatccctcttcacgttgcatggtgccgtgtacttccctatacttccatgttggctggacttgttcccatccgctttccatcatttagaaagtcatcaaactctcacttgctggtattttatttttatcaggtactcttatggtttcatggagttattttgtaataggcaatggaacatttgctaatttttttctggaaacattgtcaagtctcaggtatataatctaataagaaatggttaatgtcaattgtatatgtctttccattggctccacaaacattactgtaacaaattaaagtgcttgtt

SEQ ID NO: 5775 - DNA, 604 bp, mus musculus
tacccttggtgcacaatttcattgtgaaagaacagattggatctattaagtagccatagctacttaaatgagataatctaagctaaacattgctccagaggtaaggatgttgataatgacatacacaagacaacactgctttaaatctgtttgttttgttagacgtttcatggtgtgtctccctattcgcagatactattttagtttagaaaattagattgtctgatgatagagttctgtgactatgcatagtgataatatcttgtttttccaaaacatactttttattcattctgaaatgccagcaaatctttcacaattacttactttttccttgctatttgaattattataatttttctaacaggttgatactttaaatctccctagactctaaattaaaacttaaaattttttgacaacctctcccctcattttctaaaaattaactacaacttctagtgcttttactatagtcatggcctcataggcctttacaatgaaacttaatccatacagtcatacatgattgattctgggacacttttaaagttttgagtacttaaaagtttaattgttctattttagtatttttaaaatatta

SEQ ID NO: 5776 - DNA, 357 bp, mus musculus
tttttttttcatattatgagttttttactctttaaccattacagaatttgctcttgctcttcaaccatctggaaaccttaaaatccaagcttttgaaagaactcaatgctagtgcttttaaaaaatggattgatttcttccatgctttctttgttctcttctataattaactctaagaatttttaaagcatttatattaaattttcatatctgattttgaagctacaatatgtattttcataaacatactgatattatgcctttgaaccacttccccacatttggaaataattgacagaaataatcccatgactaactgctattttataggtttgtgtagttacatggtgtatattt

SEQ ID NO: 5777 - DNA, 498 bp, mus musculus
tgtctataaataaatagtgatatatgagaatcagttggtagttctttttctgatactctaaaatatttaagtgtcctctaagcaaaaagattaaaatgctgcttcataaagtttgttataggagtcatattgtgcttcaatttttaaaaatcagcttgtttctgtggtgctcattatgggtgaaaattttgcgttatgtcaaattcattaaccatgtcctgaccaccatgtactaacaggaaagtggtggggtggcggggagtgcacacgcatgttcatgttcactcaggggatcgcatgtatatatttatggttatgtggaaacagtgattactttctgtatttttaggtgtggtgggaaaaactgacgaatgatctgtctctagaagttctgataatacatgcagtctattgatagagaaggacttcccagatgaactgaagcattttttagcatcagtttataattctctgactccatcttcaagcacacttaga

SEQ ID NO: 5778 - DNA, 594 bp, mus musculus
aaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatg

SEQ ID NO: 5779 - DNA, 594 bp, mus musculus; identical to SEQ ID NO: 5778

SEQ ID NO: 5780 - DNA, 594 bp, mus musculus; identical to SEQ ID NO: 5778

SEQ ID NO: 5781 - DNA, 640 bp, mus musculus
aaggcagccaggatacaacccagttacgctgagtcagcatctttctagagacacttcccaggcagttagatatagccgtgcacagtcctctgggccagagcctggagctaatgagggaatctgggaaggagcagtgagacttttaacaaaagagccccacaagccatcgcgttcatattatgcctcttcaaaatgtcccagttcctttctcaccgtcaagtatcaccacactgacaaacaggggaggttggagtgatgaacatttcatgagccatgggatgtttctgtaattctcagcatcagaacactttttttttatacacgacaaacagcagggaaaggcacacattttatttttccatagatatgacttgtaaacgtctaactcacctgccctttcagtacttttaaagtgcttttcttctgagagaaataacacccatttaggttttccatcaagtctgggtgataaaatgggtactttcacatcagaaagtggactcattgtaaatgtgagatatgtcaggggaggatagcctggactctctcaggctataaaagtgacatttaactacctaatatcagacattgttaacagcagcaattgctaacaagtctgaccccaactctcatcagttaa

SEQ ID NO: 5782 - DNA, 1040 bp, mus musculus
ctctaagctggttttccctgtgacaactggaaagggagagcaaattcattacactttgggcactgtaatttagataaaatcaaagagcaccttccctaactgaagtgattagaaacaggccatatgttgtgattttcaaaccaaggtgtgtggtcaggagaactggctctgtgacaagaggctgaaagtttctgaattagaggatagcgtgcacaccattgaaacagaaaatgctgtttcctcttcccatcactttggtacacattgagagtcatttagtaaaagtagaagaacagagacgctgattagcagtacacagtcaagtgcattggtggtgcagtggcctcagggacaccttggtttctagagaatttacaaatttgagaaataaactttcaggacgaccattacaagatgagagggaaaagaaggaccctggatattgcaaagaggaaactgctccagtgtagtggcattaatattaccatcttgcatttccctacaaacatcactaacatagactttgggctaaattctacagttgttttgcttgtaagctccccagcatctctagtggcagctattatgtccactttcagttcctagctgtgtgcattatatttgcattcgtgattgccctgactattcaccctttcgcttatctacaccctctcaatgaaactgcagtgccttctctggttttagtgtaattctctaccactgcattcaatccgctgataactttggccaacagaccgatgcagaagtgatggcgcactgcttttctctctagttctcaagcactgtcttgcttctatattcccgcctattcttcagccattgctaagagaaaggccttgtaccaggtgaatgatgagagatacacggagcagagacccacagacacatgaccggtcccagccaataccagcattgcataacatcgattagatgaaccccacatatgcaaaaagctaagtaccactgatgtctggggtggtttgttgcataacagtaactgactgatacgtcatcttttc

SEQ ID NO: 5783 - DNA, 132 bp, mus musculus
gaatgacatggaacttaaaatacaaaagcaaaagcataaaatataaaacatttttactattacattcaacagacataaagtcactccatcaacttgccataaacatttctaatgcttactttcagtttctgt

SEQ ID NO: 5784 - DNA, 1725 bp, mus musculus
agtcagtgagggtgtggtggccgggggatcctggggacagcgggctgggctggtggcctgaggctccctgcagtaactgtgtcatctcagccaagtcatcctccctttctgggcctccattttcccgtctataaaatgaaaaagtggggttgtgtggtctctaatgacactttcactttgacagttcgattttaatttttctcttattttctcatccatctaccaacatacactgaatacctgcttggctctgacctctaggtcctgtaagagggccaagacctggggttcttcttaccaggcagtctttgtcagccagggaaaccaacaagcaactccatttgtcgtgcagggcagtgggtgctgagcaggtaaagtttggaaggcttggagagacaaagtagacagtgacacttgagttagtttccttcggctgctgtaagccatgaccaccaatgggtggcttaaaacaacagacacagctgggcgtggtggctcacacttgtaatcccagcactttgggaggccaaggcgggcagatcacgaggtcaagagatcgagaccatctgggctaacacggtgaaaccccgtctctactaaaaaaaaatacaaaaaattagctgggcatggtggcgggcgcctgtagtcccagctactcaggaggctgaggcaggagacaggcgtgaacccaggaggcagagcttgcagtgagcggagaacgtgccactgcactcccgcctgggcgacagagcaagactccatctcaaaaaaacaaaaaacaaacaacagcaacaaaccagacacctattatatcacggttccggaggccagaattccaaaatcaaggtgtgggctaggctggttcttctggaggcactgagagggaagccatccccttcctctcccccagcttctgggagctgcgggccgtccttggtgttccttggcttgtgactgtgccacttcagtccccacctgccttgtcacccagccttctccctgcatgtctttttgtcttcacatgggcttctaataagaacacgtcatcggatttaggccctaccttgtcatatgacctcatcttaactaaatgcatttgcaaagactatctctaaatgaggtcccactctgggattccagtaaacttgaacttggaagggccgctattcaacccagcacaggcccctcagtggcattactcatggcattagttgtcttttcagaaaccttcattcaggcctattaacaatcccagggggtaaaaccaaacttctcgcgttctttggtgtcctgattcgagcctcatcctttggccatgctctgaccctggctaccgtgaactgtcttctccaccagccctttcatccctcgcctgctgggtttgcatccccagctcactcctgcactgcctgtgggtcccagcggtggtcttccctggaatgtttctggagcccaccatgagcccaactgggagcacagcctaggccttttctgggggccatttctcaaaaggagccccctgtctccagtgccaggcccctgaccagcgcctgtgtcccagcttcctctcaacacttggtaggggtcaggtctcaggggttgtggggatcagagaagaggcaggagaggctgatgtctcaaaagaaacagggatcttagggagtggaggctttgaaagctacaactggaaggatccaaagataccccatctccaccccgcaccat

SEQ ID NO: 5785 - DNA, 1725 bp, mus musculus; identical to SEQ ID NO: 5784

SEQ ID NO: 5786 - DNA, 664 bp, mus musculus
acctctatgacaatcaagtgtctccagcctttgccaaatgtccccagattgctcctggttgagatccactgttctaaatgcatggtcaatgccctgtgtgctgggctgccagagggaactgggatggcctggtggcagggttgcccaggaagaaataatccaagttcccaagtcaacagtgaggatatattccaacaggtctactgtcacaaggagaggacaaaagtaccaacggagcatttaaaggggaatcagtggccaggtcttagaatagagagtttcttaatttgggtatcccaggaggagaccttcagacaagggttccagaaaaagtagcttatatgaaaggcgcaaggaagactgagagggggtagggaactgatataggaaaataaaggttgatcaagctaaccgcccctggaggtgactggcctgtgaccctgctgggggcctctaggcggcagtgtcaagcacatgcctcagactcatctccccaggcttccaagggtgagggagctcgggtgtatatatttataatacaccaattcccaacagtcagtggttgctggcttctcccacagggcagtaattccccaaagcaggctccagggcccaaggaaagccctcggcagggaaacattgagtgtcaggcacagggaatcag

SEQ ID NO: 5787 - DNA, 1091 bp, mus musculus
ggtcctattattatccccatttcatgggtttttaaaatggggtcaaagggtcgagagcgtgtgtaagccttcccagctaaaccgtttgcaaacacaggattcaaactccaatctgtctgactcagaaactgacaccatgacctaggtcatctcctctgtatttgcacctctgagctgggcaggtagttttccttccagcatcaaccttgctgcctctgagggcggctcccatgttcagggagggaaagggggcagctcagagctagcacctactggacacttgcctgtgttgaagggctccctcgcttatctcatttgatcttcacacagccttatgaaataggaactgttaccaccacccccattttacagggtaggaaactgaggcacagagagatggaggtaaatgtccaaatggacacctgggtgtcaggatttgaacctgggtcttctggctacagagcccacgctcttgtactctttcaccgccctctggagggagcactcctatggagctgggtgaggccagagacagtccctcctggggctcctcatcaatacctacagagcttgcctgggccagggcttgccctccactctccctctgagacaaggactcaaagcctcacaggttcctctccttatactctttccatctcaggaaccccctacctccccaccactgccctgccctgaactggagacccaggcttctgaggagaccaaccagtccagggctgtggggagtgcctcgcgaacccagcctcccatacctggccagagatggcggtgaatcacccggtgtccccgctgggtttcaggccacggacacaagtaccctctctgactgctcggctccagcacctacagtcactgcagaagtctgcagcgtatggccacaccctgcaaggtggccacggcaccgaggcctggctgccagcagggctgcctccctttctggcctgaggatcggtgaggagggaggtggggtggggaggggcaggggagcagggctggccactaaggtctgtgggctggccttcacagtgcggtaatcggcaaaacagtggtctctgtcaaaagcaacatgg

SEQ ID NO: 5788 - DNA, 2116 bp, mus musculus
tccagctctcaggacaggtgctatgtctgggtctccatcacaagaatccctgtgttgcattggtgggtgtgtctctgcctgtggtggccatacgctcttgaaggagggattgtgcctggacactggtgtgtcccaggggttgacaatctcagcgcctgaaatgtcactgtgtgctcaatcaatgtttttgaacacaggggtgaggttttaagtatttagcaagcagcacggctttgtcatgtgccaagggggacactagctataaataaccaacagggctttcctgaccctgcttgtcagtcaaacatcagccctggtggaatgaatgaatgcatgaatgaatgagtacgaatgcatgaatgaatgcatgaatgaatgagttgtaagacccatataagaggttgtaactattaactaaagaggaaaagcactttctgaggaaaagcactttctaaggcaaagcccaatgttgtgttttttaaatgttttcctttttctggacttttctggcttggctgttcagatgtgggggtgggggcttggtggtgcaaagatacccgacccccaccatggcaccaggctggagccaaggccagatgggaaagcgggcctttctgtgtccttaacagagctggcggcagctttggtatttcaaatgtccttctgaaatctgaatccaaaatggaacaatttttcgagtaaataataccattgatgtcagtgttgctgcaggaggttcagcaggccccagaaactcagaggtgaggacgtggtattctggctacacaaggtctctggctgcacgaggccacctgccttgcaggggaatgaacggtctgtgggtacttaaggcattggcctagctaagagacacattttctttttcctgattatacttgatagtgccccagggacattcaaaaatgccataccttgggaccctatgctgtcatgggcttcgggggcctgggtcaagagtgagaaggtgaggggtggtggagccagggggaggagtcttgcagctgcaggggagataagaacgggtcagggccttctctgagtgatgggctgcccctggctcccgctgaactactgaatgggatggcttcagattcccatattggtttcctactccgccaggatttgacgcagatactccccggtttgagttacagaatccggatcatggcttcctgacccttggcttcttgggcggtttgtggaggagggggaggtgttgagttttcaagaggggccgggcccagagtgtattcagaaggcttggaggagagtggccaggatgcagccagggctacccctctgtggtgggagtggtgcccccacactcagggacccttcagcagggaccccctcccattgccacccaaggatgggaggcacactctgggacacctctccaaggagaaagtctgagtttagtgcgcgtattgtatgtttaacacctccctgacgcttgctaaattctctcttaaacaaggagagcagacctccactggtaggatgcagtatccacccaggatttaatagcatcagcagtctgccttctttttctaaagttttttaaaattgttactttctatttatgacagctgttaccatttttttcccatttatggtagcaataaagtttcactctaaaataagtttattttggttgaaaaaaagtgagctcatttgaataaagattttcagtactttttagtacaggtgttctgatctccaggtgtggagggagggaaagaaacaactggagtttgggaaactctcatctagtccaacctccccacagcagagatgggtacactgagtcccagaagagagaggcattgcccaagcacacacacctcgttataaaagactgagacagggtaaagggctcagggttggggactccggcctttttccactttgccatctcttctttgtgaggccaggatgtgaatgtctctcttggtgtgatcctcacaagcagggggaaatgtgggctcatagatctgctgctgccagggtcctgggggatctgcaggggctggaactgagtgagccttttcatctctaccccacagagccagtcacagaattgatgcttagtgag

SEQ ID NO: 5789 - DNA, 1040 bp, mus musculus
gcgggaaggacgggcgctgcaggggctccgcgcgctcaaggtgctcgcgggctcccgggcccagccgggctgaggtggcgtgggcgccctgcgggccgggcctccgcggcgcgtcccagtcccagtctccgcgctggtctggcccggtccctcagctccaccccctgcctccccctcccgcccgctcgcgcctcctgaaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggtgaggtgatagtgaggagaaggggagggggcgccaaccgcccggtgggggcggggagccaggggcgagcgcgagaccccctcccgcgcctgcgtggagcggaacccgagcggagaacctcgactccaggcacctcgcgtgtgagctcgccccggagcgcggcccacctgtgccagtgcgcacgcgcacgtgccaattcgcacctgagggttccacctgccagcgcggggacttgcccgcgttctgtccccagcatgagatgcagaccgaggccagggagcccttgctttgggtaggcgccctggtgtttcgggcacttggccccttggagcctcagctttcctaactgggaaaacggcctgtggggaagggactcctgatgatcaaagtggtctcagtttttgcgcgcttactgaagtgccgagcacctttgaccatatcatctcatctcatcctctcagtcactttcgtaggcaggggtctacccattttgcaggtgaggacactgagggtcagagaagt

SEQ ID NO: 5790 - DNA, 723 bp, mus musculus
gagttagaagggagagagggtttatgaagaaatatttttggggagagccgctgcagagttgggagtctcaccccactttctcccaagcaggtgagattaaaagcctcaagccaagggagcaaagatgtatcagttagctactgctgcataacaaatcactccaaaaaccaggggctttaaataacaagagtttatttagctcactggctgggggctagctgatctaggatgatctcacttatgcatgtggagttgactgctaggccagcaaatcagttctgctgatcttgtctgggctcgctcatgtgtctgagatgaatccactgacccagttttgctccacgttgtctctcatcccccagcaggctagcctgggtttgttcatacacagtggcagaggtccaaggaagtgagcagaagcatacaaggactcttcaggtctaagctggaaaaggtacatcattatttccactgctctctattggccaaaacaagtcgttagatcagcccagattcaagaaagattttaacccacctccaatgggaggatcatcaaagacacattgaaaaggggtgtggctacaggaagaatggagaattgtggccaattttacaagagagtcttcagggagtttgaaatggcgcaattatgggggtcattagatttaatttcttacatgtgacgaggaaatttaaggtgagagactacagcttccaaactga

SEQ ID NO: 5791 - DNA, 1731 bp, mus musculus
gctttgtaggttgtgatatgtttgggtgacttattatttaggttattttgcagaattatttatttgctgttttatttatgtatttcattatttatttatttgattatttagtaaattatttatctgatgaattattaatacatcttcacgacatcctttaaattatttataagttaattttgagtttattgcttttagacgctgcattgttactgactagttttgatttttttctttgtggttcttgaaaattaaagtatcagctctaaggcaaaagtatagtcattgcaatgctcatggattttttttaaatttatggcagagataaaatttcagctttttttagctttaaatttacctatttagagttaccagtggtagaatgtttgtgtattatgtgcatactcattttagagtcacttacaaattaatgatatagcctatcatttataaacagtgattgaacatgtaaacctcagtctgcattaccctttgtgtctttaaagaacagatctgcattttttacttgttttaaaatgaataagtcttggttattttattttaatggcaaatctgttctactactggaatgtttttaggacagttcagagaaatgaagtccaactcagatttggattcttgacgaataaatttgactgctgtaatctttgtttttttaaatccaccttatatttgtattgggaaaacatcaggctgtttatataaatctttctatataaattgtgtatgtcagtcataatgacatatttcttatggaaatttttatatttaatgaatgaaaatggacaaagagctttataaatgcaagctgtagtttctttgacttagttaataattctcttgtgtgaagtttctatttttaatcaaatttaagatcatttctgattctatttcgtaacatagagcagttattagggctctcttattgaaagggtttaatgaataggttaaagtagtcattcgggtgagtgccatatgcacaacatggtctttattttgtgtttgcttgcagtgaattagtatgtactttacagttttcacacttcagagagaaactgcattgtacatttcaagttgagatgctactgaaatatagtgaaaatggcctctgtagacaggtttcactataaaattgtaaattatgcatacatatatccaaatttcttattttgaaatattgaatatatgaatatttaattggaatgttcctttagtatcttcatatgcttgccttaaaggaagtgttttcctttgatttatatacatggatttagaaatgtgtgtgtcatacatatctgtgtcttttctggagatgaacaaccacagatactattagatatggcattttctttttaaatgtgcttcagtaatgccaatgtggtcttcttttgaaaaaaaaagaaagaaagaaaaaaaagcttccttctccagtattgaataatctacccagcccctattattaacatatatttggggagtgctagctgtgtcatctaagtgatctttccttggaagatacacagatatgtgcacagacacacatgcacatgtgaaattttcttatgacatcaaaataactttttaggacttgtttttgaaaagagacattaatgtagacttttataataatacttagcattgttgatttcttatgtgcagatacagagctcatatcttttacatggattattcgttgatcttcacagtgat

SEQ ID NO: 5792 - DNA, 1731 bp, mus musculus; identical to SEQ ID NO: 5791

SEQ ID NO: 5793 - DNA, 1731 bp, mus musculus; identical to SEQ ID NO: 5791

SEQ ID NO: 5794 - DNA, 1019 bp, mus musculus
gcagtacaaacaccgtaaatttcagattgcttaggacaaaacctgacaccgagcggtaacattttactcattcttaccctacccgccacccccttgagaaagtcaggtcccctggcctccaaggatgcaaacatggaaacccagtcagtcagagcagtaaggttctctctggggaatagggcatccttctgttttccctgtctcttttataaccatgtggagtccaagtcttagaacatttgcttgtaagtccggaatgccactgagaaagttcgccaaggaagggcgcagaggtcaaagttgccaaccaggacactttgagagaggaccctgtggttgacatttgttagtgaaatttgcaacacctcagtggaggccaaggccaaaactttcaaggagatccctatgcccctttcccctgttggtcttctgaggtcatcccaagaggaaactgcgtttccccagtaagcacgtggcactccccggacctgccacctgcctgcttcgtccttctcgtcgtggtttcccaaaccccggttctgccggcccgggagccttagcactggagcaataggaaaaggccaccgcgctcgggtctggacagcaggagggaaacacggtgtggactgcgaggctgcacctgtgatgtcccggcccctgctaagaggacggccctttcttctgcctcttgcccaactccaaacccacattcacgccagcagcctctccaggaccggcctcgctacagccagcgagggctcgaaatgaggagtgccgcggctttcaaactccgggctccaacttgagcgccccggcgcccgagtagctcccgggatgcagaagttgccacaaacttcccaggcccctcttcgccgatgcttacaatcagccgcgcaggcagggagcggagggaggcggagatggaccgggaaaggatgctgagcagactcgcgatccggtgggggaacattaccactcccgcagcccactcctccaggcaccttactgcccgcccggct

SEQ ID NO: 5795 - DNA, 808 bp, mus musculus
gttattttttatagaaatgccatggacttttatgtgttgattttgtattctttgactttacttaattcacttattagttcttttgttttttgagaaagagcctcactctgttgcccaggctggagtgcagtggcacgatcttggcttaccacaacctccgcctcctgggttcaagcgattctcgtgcctcagcctccgaagtagctgggattacaggtgcatgccatcatgaccagctaatttttgaatttttagagaagacacggtttcaccatgttggccagactggtgaactggtctcgaactcctggcctcaagtgatccaccagtctcggcctcacaaagtgctgggattacaggcatgagctactgtgcccagccaaattcattagttctaacagttttttgatggagtctttggagttttttacatatgtcttttcaaatattaacacaacgtattgttgtgtgtagcatcccaccagtctcccagctcacatgggggaatgcttctgtcatctgtagctaaatctgtgcagtttctgcactgttacaatttcattttttgttccattctcattttcaatgtcaatgagaacatagtgtgcatcttgcatgataaggttattcgtgttgcttaagtcataagtcttcctttctttttccacaggagaggcaaagaaccgaaagtataacccatcaagtttccataggtgtagtgtgtatggagtaccaacaccacattttaatgatggacgagccatggcaaaatctctatattggctccatgaactacaaatgtaagttt

SEQ ID NO: 5796 - DNA, 820 bp, mus musculus
tttttcatttctagaattttcatttggctctcttatagtttgtatttgtctgttggggtttgccatttgttaactcattatgtccatcttttatttaaactattgaatatatttacaataacttttgaaatcattgttcactaattctaacgtttctgtcatgtctgggtttctgtattctgttttgtttctcatgattattttttcaagattttgttttccagtaattactgagtgtgtgctaggcatagtaaatgctatgttgttgggactctgggttgtattatcatcctttaaagatgactgcgttttgttctggagttttatttgttttgcaactggactttcaacttggttttaggctttgttgggacaaatctaaagtagctttattttagggttagagttgccttactctttaagatatggcctttataaggtttcaactagatgccctgggtattcagcaatttttatccactccgacaaactgaaatgttgtccagtactgtgtggcttttggaatctttgttcatcttccagcccctcagtagcttttctctggcagagttctctcagtctcatcctctggatatgtatctcagtatttggctaatgactcagtaagacccctaaactgagtccaatgggacttcttccctatttggtaccctattcttcacattctatctaactcagcagttccgtgttccagttgactcctcctcttctcagggaatctgctgcttcctgtttgagttcctcttctctgtgccacagtttggaatgccttccccagcagaaacaactctctcatgtg

SEQ ID NO: 5797 - DNA, 1218 bp, mus musculus
atggaaattacctgcataactaacccccctgctcaagcagaatgccagacacctgagaacacctttcattacaatgtacctccctttgcaaaggaactaattgcatctgtttctctttcctttaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacacta

SEQ ID NO: 5798 - DNA, 498 bp, mus musculus
ctctacagaatgctttggggctgtgggagctgtaataatgactgagtgactttcagccttgcctaggatggtggcttgcagttgaatttaattttatttagagaaaataaagtacagtactgtgacatttcttgcacacttgagttcatggagcaaaatccatacccacaacacaaccattaaggaaaatgctctggacttgatgcagtttgttgttgcaaaaacaaagaatagacccctgggctgaaaggaaaagactttttccatggtctctttgaagtgcttttgccagtgcccagcctgccccctggtggcacttttgctcatgttttcgttcacagctggaaaatgacacactaaatgcggagtgaacaaatgctgtgaaaatgttatagagttacagcatcacaggtgtcagggtatccggttctgccagaccaagaaagactcacctaagtcaaattctcagagatcaaattgttccttctcttcacttca

SEQ ID NO: 5799 - DNA, 1235 bp, mus musculus
ccttgaagctggagctggcgtcagtccctgcctaaaccacatagcagttctacagtggaccagggctgaaatggatgctaagggaggccatcacaatgtctactcgttttcattatcttttcaacttctaatggatatttcctttgctgtggcagagatcattattgtcttcctttagcaaatgagaaaaccgtgagatcacactcttacatttcaaattatttatcagtctaaaagagactatttgtttatatagagagtatttggaggtgtgagaaatgtaactgaggccagcatgctgtaagaaggtggtttgatctgtgcttcatggaaactcagtgcttcccccagagctgagatggacaaggagtgggtgaggctatgaattcccaccttacttcagtcacagtccttctttcttagatgtttcatatatgttgcagttatgcatgcaggattccatttaaatctaagctgtcactgcacaggttgaaaaccactactccattctagctctatgatcttgaaaacaaaaatcccttcctttttttagtgctcagttccctttacctgtaaaatgaatgtgttgaactaggagtttttgaagcttccttccatctttgacagttcatgattttgtgacttttaccattggccaaggtggaacttattaatttcatgaaaactgactaaatgactgtctcagaagttattaattcagcacagcttcctcatcttagtgagttttcagctggctaatgccacataacagtcagaaaatgccaacattgctggtgtgggatggagttaacagtgtgagatttgctaagtgtttctgcgcaatcagtgtgaaagcaatcacatctccagagtgagaaaggtcagtgccctgtagctgccaaacctcaccacactaaggggacatgaaggggactgccacctgcagaacacaaatcaggctaaaaaatgaataccctttgcagttgcagtctaatagcaccgactgtcaaatgatattactttgggagattgttaagcccccttctcagtgcacagcagtgtataaatcccctcatctcatttgattaatctgagagactatagaatatgttattaggcatagaaaacatgactgcaatgtgactagtattactgagcatgaaaattcctttaagtcctgattttttttctagttccacattgtttgaaagtgggggaacattgatctcagtgaa

SEQ ID NO: 5800 - DNA, 577 bp, mus musculus
acactgtgtctctacatactgccataccgacccatttattttaataccatcaatgtttgaacaccaggagtttgatcctgtgggatatttgattgcacacttgcaaataccagcaagcaaggtttataattaatcaatttcaataatgacccccaattgtttacttcttgtatccatgtcctgtgcagtgtgatttgctgctcttaccattaagaggtgaaatctctttcctcgctatttgaatatgactgtgcctggtgagtgacactgaacgaaagaatgcagcagaagtgatggtgtgccaattccaagtccaggctttactctcttgagattcttgcaaacaacgatgtgtgcaaatccaggatggcctgctggagggagacaagtgaaccatcaccatcttcaccctgaccaacagccagccaatcattagacaggagtgaggacatcctaggccagccactgacctgatgactgcagatccatgagtgagctctgctcagatcagctaaatatggctggcaccaaaagaatgactcagctgacccacagattcatgagttaaatatgtccc

SEQ ID NO: 5801 - DNA, 999 bp, mus musculus
ggttatgtattaaaatgcaatggttgttttaagggagtggagctttgagtcattgtatgtattaatgctactatcatttaatgttcttatagcactgaaattgaaggatggagaatttaaagaaaaaaaaaaagtacaccaatactttatccctgattttagtcagtttattaccactgataagaaaagcctgagattagaaaacttgcaagaaattagtaccctggagctgaagaagaaatcactcatcatcagttcagtgttggaagtgaaaagaagtgaattcaacatgcaaagtattgtgcctttctgtcaaagtagcaccagagagaagtaaatgatcaaatatattgaaccaaatatcacatttgtagattaacactagattatttgtttataggtttacttagaaaataccactggagcttttgaaaattttattttactttttttattatactttcagttctagggtacatgtcgggcagtggggggctgggggaggaatagcattaggagaaatacctaatataaatgacgagttgatgggtacagcaagccaacatggcacacgtatacctatgtaacaagcctgcacgttgtgcacatgtaccctagagtttttgaaaattcaaggagcctaaaattgtcctaggctaatcctaaatcttaatcatgattgagattggtgataaatcgatcaatggaatcaatttggtggaatcctcaattttaggctaatccaaaacatttcaagttttacataggggccaaacaatctgtaaaatgatccccatgtaaaacttgaaatgttttgataatctcaagaacctaggcatatatttgatgttatcctcatattttagaatatatgtgtgcagtatttcctagataattcatataagatcatcctcatatcatttagaagaattgctgttctataaagtaatttttctactgtagacattattttcatttgtggaaattctaagtatatag

SEQ ID NO: 5802 - DNA, 999 bp, mus musculus; identical to SEQ ID NO: 5801

SEQ ID NO: 5803 - DNA, 999 bp, mus musculus; identical to SEQ ID NO: 5801

SEQ ID NO: 5804 - DNA, 543 bp, mus musculus
agaagcaagatctggtactgtacaaaatcacagtttctgaattcaaggtctgcatttgttacttgctatgtgggtcctggcaaagtcaataacctcagttttctcatctatatgatgggggtcatagtgatacctaatataatgatttcaggtattaaatgtgactatgcctataaaaatccttagcattatatctgacatgaaatgtagtaagggctcaaaccaagggtgactttggtttgtattataattattacataccagaaggttgactagggtgagaaagacttgaaaaggtgccagagtggtcatagtcaaataagtttgcaaaatacacatgagtacattgaatgctttgaaaagtactgcactaaagattgttcctaagctttatgtaactcagtatttttcaatgttatatgcccaaggatggcttcccctacaccactctcaaaactttgatgtgaatgtcccacagaaattagaactgtgataggtactccaataacaagccctcccttccgtggtggtgatttatattta

SEQ ID NO: 5805 - DNA, 3264 bp, mus musculus
tgtctgcgcaggttatggactggaggtggacatgtgggctgctggcgtgatcctctatatcctgctgtgtggctttcccccattccgcagccctgagagggaccaggacgagctctttaacatcatccagctgggccactttgagttcctccccccttactgggacaatatctctgatggtgagatttggggcttcctcacacagcagaggagcggatgggtttttcaggtcagatgtgtagaggacccaccactgtgcctggtgcagagttggactgtcaacatgtcatgtctcagcctttacttcctcagtagcttcatgtaggtttgtgtagcactctgaaaacatggcttgctttcagatttagtgaaaaagcccaaccaccagttacagtcaccaagtacttttccttaaggcaattcaagaacctcagaacagaaaaatatcagaaacattgtaactcccctttggaaagagaaaggccatcttatatgcagaagtgtttgtgaatggaacagactgaaaatgcttattttacacatgcataatcaagggtcctatagcagcacacttgaagcacaggggctctgcaatgaagatctcagttattttttagtgacttggagcatgcatggtcctccctgcttttggccctctgttccatttgattccaaatgaaatccttccccttgtctctactgatttgtctgtactactcactgtccttgtaaaactgggaactagataattggggattttgagtctttagcttaaaaagtagaataggaggctgggtgtggtggctcatacctataatcctagcactttgggaggcccaggtgggaggattgcttgagaccaggagtttgagaccagcctgggcaactggcgataccccttctctacaaaaaatgaaacaaattagccaggggtggtcccagttgctctggaggctgaggcaggaggaccacttaagcccaggagtttgaggctgcagtgagctatgattgtgccaccacactccagcctgggtgacagagaccctggttcaaaataaaaataaaaataaagtagaataggagtgataacattttgtttttcaattttccctaaacatgctattgaattttagttattgaactgcctccatccctagcctctatttcctcactgggattggaggatgagggaagggaaaatcttcattttcccccctttaaataaggtagggagagggtggcttgtcacagtagatgaggatcttgagctgacaaggcagtggcaactgggaattgagggactaaaaatcattttagaaagttctatgcagcactccttagatttgggcatgggtggcccctgtcctgggccctgctgtagtcacacccttctctacagagtgaggagagtatggggcctaggggatgtgcccccagagcccaggtcccctcttctagatcacttccttagggcccctgaattccctgtccaaatggcccaagcccacatccaaggtttgtgagacctctttccagcctcttcccactatgccataaagtggccaaggagtggccatctggaggggttagacagagcttggacatgttgcctggggtgtctggttgtccacacttgtacacaagagtctgaggattctcaacttaaatctggccttccagcctctgagtcatttgaggaccctgagggagtgatgtggcagtggtggggctggggctttttggggcagaattttcccagcttgaattgggtggtgtaggaggaatctgggccttctgtgctcaggaggtggctggacatcgggggaggggagcggtgattggtgggtaagcagctggtcttgagtaagagacagccttcaataaaggcaaaaaataacaacaacaaaaagtggatgttttcttcttgtgcatatcttgagtgattggaagagcagtctcaatgagccaggctgggagagccagcaagccagggggaaatctcttctgctttctgcctgctgctgggcccaccagttgggccctcatttctctaaaatcagtcatggtcttgggcagaaaataaaattatttttgaatttgcactatttactttttagatttctttacacggttttcagttttgtcaatgtgaaggcatatgtattgacttggaaagattgaacatattttatttaacaatgtgttagtttcgatttgaaaccttaaagtatgtagatgtatagcatgtgttctccatttgttcctttgccctgagtgccagggatgttaagagtgggtctggccctgcgattccagagaaatgaaggaacgtcctctcgagctgtgctgtccaacatggtaacccccctccctgctgccacacgtggctatttaaatgcaaatgtaaattaactcaaagtaaatcatataaatattcacttcctcagtttcacacgccagatttcaaatgctcaataatcgcaggtagatagtgcagatagagaatgttcctgtcttctattggactgtgctgctctagaatatgaaggaggctttcagccagccgtggtgctgacgtgaatgtttatgttcttatttcatgtgtggggaagaaaaattcagaaccacctgcattcatcacattttccccttctctcattccaacagctgctaaagatctggtgagccggttgctggtggtagaccccaaaaagcgctacacagctcatcaggttcttcagcacccctggatcgaaacagctggcaagaccaatacagtgaaacgacagaagcaggtgtcccccagcagcgagggtcacttccggagccagcacaagagggttgtggagcaggtatcatagtcaccaccttgggaatctgtccagcccccagttctgctcaaggacagagaaaaggatagaagtttgagagaaaaacaatgaaagaggcttcttcacataattggtgaatcagagggagagacactgagtatattttaaagcatattaaaaaaattaagtcaatgttaaatgtcacaacatatttttagatttgtatatttaaagcctttaatacatttttggggggtaagcattgtcatcagtgaggaattttggtaataatgatgtgttttgcttcccctttgtaaccaagtttattctgtactacaggagtggtgcttaccagggtctaaactccccctgtgagattaataaggtgcattgtggtctttctgtgttaataaaatgtgctctgaataacaga

SEQ ID NO: 5806 - DNA, 999 bp, mus musculus
gacccacagggctctgccagaatctgcacgttggctcctgacccgtgggaggatggacgaggcgatacaactgatccagaaggcggcctcggtcaataggcggaaactctccccggagctcatgaaccaggtacttccagcaggcccaggcccaggcccagaatcagacccacacggatcttcctgcctggcttctcactctgcttcttcctcccagctggtcccagagaagacaggcccctcagggaatgccctggatctgttcagacacccccagctccggaaggtgaccctgattatcttctgtgtctggtgagtgcccagaacccgaggacagaaccacagggctgcagcctccctggtgtgtgttggcagaggggtgggctggtggctgtttggctgggatggtctctccctggttgtgccagtgtcccctgctgtgactgctgaccaaggcaggctctccctctgggtggtgtctcgtcacccagcagtgacaggaacccttcattaccttgtaggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcaggtatcagggctggctatccctcacccgcatgccccctcacccaccggctgccaggggctagaccagtggccattgttctgcttccaggagtaaaggcttcccgggggtttgggtacagaaggggtggggagttccagtggatgggaccggcgtcagggcccaggtgatggggctgtctaccctctgccagatctgcccgtggtggtcaccatgctggctgtggtggggaagatggccacagctgctgcctttaccatctccta

SEQ ID NO: 5807 - DNA, 6622 bp, mus musculus
tcaagataggacagacaggttccctgccctcatggagcttaaagcatagtggaagagatagggaagaataaaaaggaaagagtaagataaataaaatggctgcaaattgtgaaaagtgccctgaacaaacccacctaggggctgagggagggcataaccccacagaggttggccagccaggccctggcccctctgcacctgtgcagacccaaggcccagcaggaagctggaggtttggaaagacaatattttgcccaggagaccgggctccttcacagcccctttgtctctgcaccaactcccctggcactgtgttctctgccaccccaccccaagggaagaggatgtgagggtgccctggcaggcttcttccaaaaatcttcaaaaccaaaaccaaccatccttgtggcatggaggaaatttcttttctttctttattgttattattattaaaaccatccttgtggcatggaggaaatttctttttttatgattattattattatttaatagagacaaggcctcactctgttgcctgggctggtctcaagctcctgggctcaagcagtcctcttgcctcagcctcccaaattgctgggattacagacatgagccaccacacccaacccagaattttttttttttatttttttatttttttttttggtgagacagagtctctctcactctgttgtccaggctggagtgcagtggcacaatcttggctcactacaacctccacttacagcaattctcctgcctcagcctcccaagtagctgagattacaggcatgtgctaccatgcccagctaatttttgtatttttagtagagatggagtttcaccatgttggccaggctggtttcaaactcctgacctcaagtgatctgcccacctcagcctcccaaagtgctgggattacaggcaggagccaccgcacccagccccagcccagaaatttatttaatttgagtaatgtttatgagaaataaatagctcatgcatccctgagaacttgtcctcagcccggttgagaaatgctaacttaagaaaaagagagggctttagtctatgaaaatatctatcttaaattaccactgcagaaaagaaattgagttttgatcgttggtaaaaataattttagataatcattgaaatgcaaacctaaaatgaaaagcatgtgtaagactccctgcaggtacacccagcttgagaacccaggctgggtcagcaccgtgccagcagcaaggacttctgtgaaggcctgggttctcgctccatgtgatctcactttgtgtcctggccagaaacaggctgcaagcgcagttcgatgtcattcagttcaattgtgcccatgttctttgtgcctgtgacatgctgggctctgcccacaccagggatacagagacaagagctaccgccttgtcaccttggaacaaaggtctgggggcacatgagctgtcacacacagtttatgtaagggctcggaagtcaggccatcctgggtataagtctcagttttacaacatatttaacacctctaagcctcagtttcctgagttataaaatggaggcacacacagtgcctgccttatccggctattgagagaattaggtaggataatgccaggaagtgcttagcctgcttctggatgcactaatgacaaaatcctcttaatacagagtgagcgccgacccagggccacgctctgccctagaacttcccaggtgtgagcttatttactaagcacagtggccctgtgaggcaggcttgttgttatccccattcacagacaggcagatgtgtgactaaccctatcttacaggcaaggaaatggtggcaggatggagctaaataactcactgaaggtcacacagctagtccagaatctactctgaatggtgactgctgctagcatcagcgttgccacttctggcagttggagaatcagaaaatacgttatgaggaaaaggacaggcagctttggctttgaaagaggagcagcctctccccagtggagagaagggtgtcgcaataccaggaacaaacataggggggcaggcccacagagacccgggctgagccagggaggtactggagcagagggcatagggcagtgctggagacaaagctaaaggtagggagtgtcccctcctcagaggccagacacccctcagaggacagggggctaccagggtgtgtgagcaggagagagaggggctgtgtcaggtcatcccgtctcttccactgcctggggtggagcctaggtggacaagtgacttcacttcatgtgcctcagcttccctatctgtaaaatgggatgggatattcatgcatcgactcacaggttcatacaagtgaattgcatagttcaatgcttggcacagagtgagagctcagcaaatggaagcttgtactgttattagccatcgcaaggctaccctcatgatggggacaggtgatggattcgagtgggaggaacacctgtggcctgggccctgtccggcaggtgtcagaaaagtccaggagagtcatgcttaggccttctccaaagatggaggtgcaagagccccacagcatagcagcctctttttgaagtgatgtcaatgtgcttcttcctctttgggcccttgaagctcaggctcagtgttgagtcccaacctgacttctctgcccatctcattggcgctttatgccagagacagggggagcatgattggcacctactcaccctgaagggactgccttggtaaggcaactcaggggaggcctggggagccagaaccgtgtgagggtgcccgaggcagcaagggaaagactcagagcacgatggccacattcagagatcacatgccctgcccccaaagccccagctgtggacaagaatgactcaggtcccttggacaggctgtcaccagtgatgacttaggaccagcctgcccggctccagcaaagcacaggaagctcgaaggtttagaaatgggtcattgttgtgctgaggccatgcgtcaaagaggacatcccacagccagctcctatcctggccagcactcttgacaaaggcagagggagtgcagcttagtgagctggtccctttacacaggttattcactccagaatctggagaattctgtccttaaggaaaaaaaaaaaaaaaactaagctcaagatcccacagcttgtaagaccaggcctaagagtcaaacctgaatctccccacatgagagcaccatgctccccctcacccagcaccccctctgtaggtggtggcccagaggagatgttgccctgggctgctcttccataggaggaaagacatgattcactaataactgcatgtcctgagaattccctgttggggaccccaggacttcactaggggcatggctcttgggtgacagttgggaggtctcttccagggtctcagtccagccaagcatgtggccttgcaagaaggcagcttctaatggctcagaaacaccagggcaggggggccacagtccttcacaccacacacttagttccccagcttcagaacgctttaaaacgctgcagcatggagcctcacgctttcaaaacagtatttcataatatgccaggactttgtgttttattcgtcctctccctgtgacctaggctaatgcagacaataaaaatgccaccaagttctgcaaaactgaaaaaatgaagtgggtgattaggggacatttgataatgtgctttggttgaaacttgagaaattattcctagtaacttttcctaagactgtgactatattttccaagtgaaaaataagagctagtgaaagtaatgtgtgtgtagatttcggagcaatgggattgaggatttggaagcatgacttcagaaactgagccacgtggtcaccttccctcattgaatcaatattcggtgaatacccacctgtgtctggaactgtactgacccatgttaagcgagaaagagtgattaatgtgacaagatgtggctccaatttctaagtcctcacactagagcgcccccttctggagccagtcagcagagagagaagtttgactgtgtcccccttgaaaccgtcaactgtttggtccacttgagacctaggtaaaatctgaggggacagctcactctaacctggatctgaacttaaacttgagccccgatgacagaataatccctttctgcctggaaatggcccaagccatctcatgctgaggctttttgacataatctctaccacagctgtgtatgggagcagtgctcagaaaatgcaaggcggtcctcactccacgtacgggcactcacatgcagtctcagtgtcggtctctttctgcaggtctaggcattaatcctattcagctggttgcattttacccttatgggaagcagagtgctgacttcctcctttctccacctctattcctttcccctaaacaaatgcagccatgccctttacaggcaggaggtttggtattgggccgcctgccactctgaggatgttcctcattgtttatcttggcttttctccttctcagatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcacttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggatgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatgacttcaggacatatgtgtgatcctggaatacaccatattccaatttcagagttaattacaaacagattgaggtattccatcatcatcggaagcattggctgtgtgtctgactccacatggaatgctataaagtgggatacatgtggttcttcttgttccagaacttacagtccatggtagacaacactgatacaggcaaactagcaacagcaattaagtcactggttctcagacttaatactctgcctggtcctcatgcccagatattccaatttaattggtccatggtgtggcttgaacaccaggaatctttaaaactccacaagtgattctaatgggcagcaaagtttgagaatcactggacacattgatgcacttgagccatcatttctatctagttcttcctcttcctaatcttcaggttagcggggataagtttggtccaggaccaagagttggaccaaaagggaagacaggggccagaagtctagagtgctagagccgacttgaatgtactcagtctcattgcacatggcagtgaatatggattaaatataagcccatgaaaatatttggtacaaggaaggagtgagtgattttgat

SEQ ID NO: 5808 - DNA, 1100 bp, mus musculus
acctctggaccctcagtgacttcgccgtgcgcctcggtaggtgtgaggacctgagcaaggggccggccatagggcagctgagcactgagaagttagaactctgctctgggggatctgagggactcacctgttaggaatccagaatgccatggggcggctgaggggactatgaccctgccctggaagtctgacaggcacatggccctggcctggaggatctgaagggcccagctcagcctagtggcctgagccctctgctcattcccgctcaggtcacatccagtacatgtccagcatagttcgggagcacagacagaagctgcggaagaagtacggcgtccagtttatcttggatgctctgcgcacccactacaggtgaggccagtggggccagatgggccatggggggctgacacagtggcctccggccttggggactgggcggtgcgcttccctgactcacctgcccaccctctctccccgcctttctttgggacctggctgggtgtgcctactgacctgccagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggtaggctggaggttggggagcgggaggcttgggtgaggggagtgggggcccgacacagtgtgagaccctgcatccccaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaaggtacacccagcccaccccctcccctggcatcccattcactggggcccctgcctggggttcagggaggtacagcaggccttgggccagcggatgaagctgccttcaagggcctcttgagccacacacctgcacggtgacttcccctcctacagtaactccttccacatgatgac

SEQ ID NO: 5809 - DNA, 2293 bp, mus musculus
ccatctctcccagccccctttccacagagggggacaccaaggctcggggaagggaaagagcagagcagagccaggtgtcttcatagaaggccagcggtcagcccaaaaggcaaaggtgtgggaactgaggagggtcctgggacggatgtggctgggccagatgggagaccgtcccgggctctggccagcctgggcagtcagcctcccttcccgggcccggctgggtgggggcagcagggctcaggcgggcgggctgttgatccagcccgacaatgatgaaacggcccctttgtcctgcggcgccaaagttgctgtgactggaggaggcgtgacgtgaaagggtcattgttcccacttgggcaaccactcagggagctggaggaccggcccagagcaggcttcatgccagcactgcagccctgcctgctgcctgtggccggtcggggtatcctgggctccctgctcctactgtggccagttcctccctagggccagggccagcttgggcacaggtatccctccccaccactgtgtccccctccctttccctccttcctcctgtctggaatagatcacaaatgggggactccacatacacgtgaacgctgccaggtcggacgcctgcaggcaccaaggagagctggcgggtggggggtaaagaaggtgctttatcctgggacaaggaaacatgccagtgacattcacatcctgaggctgtgacctcaggaacatctccttcccactcccaccccccaaccctggcaccttgtggatggagggagagagggccagagaagggaatttggcagccctgggcaccttctggatagagggagcgagggccagagaagagaagtgggtgggcccgggcaccttgtgggtggagggagagagggccagagaagggaattgggcagccccgggcaccttgtggatgaagggagagagggccagagaagggaagttggcggccccgggcaccttgtggatggagggagagagggccagagaagggaagtgggtggccccgggccattcagcacaagctcgtgggctgatgcccaggctggacttcactccccaccagcccctagacatgatggacctccattctctctggaaacctgaggccccttctccatgccccccattcctcccttgtcccttcaatccactctcccctgagcagctgtgccccgtgaaatctttctaaaaccaaaactttattggattccaccctagcttcaaacctgccatgccacgtccagagaaatcccaagctcttgtgtggcattcaaggccctccctgcatagcagcagccagggctgggagcccctgtctggatcctccctcagcccctgtgcaggaacacagatcacagcaaagactatttcatcttcccagatccagcctccacccttttgctctcacaggtcccgcctcttgagtacacattttccctcctccgggtcccactgcctctggcctctggggctcagggccggggtggtcaggagtggctggtctgggctgaagtgagagtctccttctccccaccctaggtggcccactggcttcagtgcacagaactactctcctcttgggctctccactgcccccagcagctggcatcaggctcagcctgacccaggctaattaaaccctcccccagctcagaggaggctctggctctagctctagacttctttccctggagggacagagctaattaaccgaaagggtttaattaatcaattagcgtggcctccagacccctccacttagctgtggccatggcagatatttataaacaggagctgccagacccttctctggctggaacctgacagaggggagggcgggcgatcatggtgggcacagtagcagtgaacacggctgcagaggcaggacgtcctgtcagagctgcagaagcgccagccccagctcctgagcaccaccaaaggcctgggcagatgcagtcagtgatgctgggacatgtgaggggacacagtgaggcagatactcgggggccccatgcaacacctctttgtgcacaagtcacacagttctgacacccagagctaggtaagttcccagaggtgtcccagacatatggccaggggtgctgatgatgtccagctggacacagcaccctagccaccaagacctccagggatgggcctgcacagagggccatgggagccagaggaggcaccagaaccccagctggaggacaaggtgagggaaggcttcctggaggaggagacatgtgcactaaactcagggaaagag

SEQ ID NO: 5810 - DNA, 483 bp, mus musculus
agggtacttcgggaagtgttggtgactgttagacaggtgggccagactcggcattgtcttcagcacctgtcctgggaggcagctggccaccagagactggattcagggagcagagtcccgctaggggaggccgggcaggcccgactggctggaggcaggtcggcctttgggctgaatgtctggggcttcctgccagagccccatctttccttctttggccctcaggcgccctgacaactcaccactcacttcttagaaatggactcagctgctgcatgctgcttcagcactgctgggtagttttgctctagacagccctggccacccaccccactcctcaagtcagtgcaggcaagggccccctgccatgatccatcaggaggcctacactagcacaaaacacccagcaaaaagagtgccctgttcttcaagctcttggctctttgtctcagtgtgcagaagggatgggaaaatgggatgggg

SEQ ID NO: 5811 - DNA, 755 bp, mus musculus
ttttttgttcatctccagatccctcattatccatatggactcctggatccttattttattcaaagggttacaattgactactttttaaaaattttgatgctcaaattgtcctagatttggccagcgggagacttttcaagctaattcctgtgtcgccttaccatgtttccatcattcttcaaaacccttagatgatgatttattagcaagatgcccctaagataactttactttctggcacagcaagaatttccaggctcattgtgtactttcccaggtccagtcctgaaaccagctgtttctccaaggaagctctttttatttattattttagtttattttttgagacaggttcttactctgtcacccaggctggagtgcctggagtgcagtggggccatcttggctcactgtagcctcagtttcctgggctcaagcaagcctcccacctcagcctcctgagtagctgggacttaggcatgtaccacaacatctggctaattttgttattttttgtagagacagatctccctatgttgcccaggctggccttgaatgcctaggctcaagtaaatctcccaccttggcttcccaaagtgctgggattataggcatgagccatcatgcccggctggaagttccttttagttgaggaattatatttagaagccaagatctgggcattagatgtgctcattgctactgggatatcattgctttgagactcccacagcagacagatctgggaaatatat

SEQ ID NO: 5812 - DNA, 1506 bp, mus musculus
tatactgttttaacaaagggtaataaattatggagaagtgacaagacaaaggaaaggaggtttaggcttctaggggtggcacattgtgggaaggtaaatagggaagacaaatggatgataaggattatttagtaaagtttgctatgcagacgaaagttagtgctgtttccagtgataagagttattgcctcttcctggtacaggagaggggaaggcaaaccttcacaacaggaaatttgtgtccaaattttaggcagaaaaggtaaaggacacataattcctcctgcatctgctctttctcagttgccttcagctgaaaataatctttatgacaaagtggcatattttggggtggcatattctgatccctgtcactgtttatagtcttccacttattagcaacttcctaatcattgctgttggcttctgatggccgccattttatactgctctgtccccaatactgttactgcatttatatacatttccttattaattagcatcctgctgtattctgtgacttcatattttcttttatcttttaactgagtaatctcatctgtcagtcatgatattactgtgggtcataagggtttgaaaaccttttaccttttttgtaccagtgttggacatggtaatcttaaggaaggctgttcctcaatatagcctgttgaggtgaacatgtttggctgattttcttaactggttttgtctaatattccttgcctgattgttcaagatgtctcaccaccagtccgtgactaagtgtgggggaagatctgtcagggcacccagacaccttagagccccaagtctctagatgtcttctttgtggtaattaccttcctcttagtatccattcaaggagccagtcggaggtgtccaaaaaatcacttttgaaactctccaaatgaggagtggaaagcctggggatactgaggaactgacctttgtccctttcaacttggtgctatcagtgaccacaccccagaatttctgaggctccttgacaactcaatggacattgacgaaagaagtttgaagactgaggctccagcctgtgctctgccatgtgcccttatataaatcacttcctttttctgggtccaagtttctctacttcattgggtcaggtgctataaaatttatattgtataacaaagttaaagtgctgatactgtgaatatttaaaatattcatgtgaagataatcattgcagtaatgactcagtgggttgaatttgcctactctaagtattcttaggtattcatttctaaaatatttctccagaaattcttagtacctggtatgtaggagacatttaataagttttgttgagtgaaaagaaaaccttacctttccctgggttcatgcattgttgattgagcggccaaaaataatgataaaaattacagctgcatttattgaatgctcacagttggccaggcacagttcaaagagattaacacataactatatgtcaagaatatttctaaataaatgtaa

SEQ ID NO: 5813 - DNA, 1197 bp, mus musculus
aatcactgaattagaggctgtgaaaagtagaataataaagtataataacaatagcaaaaatttattgagggtttctaagtgccaggtaccatgctaagtgctttacatgtgttatttaatttaatactcaaaataactcaatgaaggacgtactgttattatctccattttccttgtaataccttagaaatgttcatgacatttgaaaggccattgttatgagttagttgaacatatatatttgcattgcagaggatgttgcaaaacatacccacctgagccgcttgtctatccaaactgaaactcaagttgatgagcttaaggggatctttcctcttcagtctgtctttctctctttttcccaaggctttgatctttaacccccgtgtctactcccccaaggttctactgcttcttcctcttagctctgtctttggccctctgtcattttttcccccttctttggatttgggatgaaaggagaagggaagttgaaggtcctatatatagaaagagtgaaaggaagtaccatagccctaattctttagattcatgacaatctctaagacaaaaaaaacagttttagttttaaggtgcctattttgcagcaaaatcatacgagtttattgtaataatttctaagctatttaacccatcatactgtaagtccaacccgttttaaggattgaggacttgggggagaacctgtttctcacagtcacttgaggatccagacttaggaaggttctgccatcttgtatctccaccatctggaaagtgtagcctctacgatctctgaggaagaaaaggagtgtggtatggaacagacaggaagtgatgtacctcacttctgcttacatttcctgaagaaaacacagcgtttcatcttcccaaaaggcgcctgagaagtgtgatctttcctgttttcaggaggaaaggagagttggatgtgagtgagaactagtcgttactaccaagcaagttttagattttaggttatttttagtgtttgtgtctttggagactgtgtacattatgcgtacttccaactttgaaactgtctcctgtttgaatgattgcaggttgaatcaaattcaaatatacccttaactcaagtctacgattaggaaaaacaaacaaatgaagctttgaatgtgaaataaaactatattgggagcttttgtgagtgttccagtt

SEQ ID NO: 5814 - DNA, 1524 bp, mus musculus
cattaaaaaacagtcattggaacttttcacataatgagccatttggcttttcttgtggagctgtgacatggttcagtggaaactggctgttgtaaagttaggtaaaaccagctttgtattgaaatcctatgaatgaatttcagaccatcatcttcgttttctccctggcttagatggtttaataatgagtatggctgacttactgagctttgtcttgtgtgggtgctgctgtaagtggtctgctccgtaaagtgccacagttctctttctgaaccagctgctgtttttctgatttacccttatttggcagattttgccctttgatacttttgacattatcaacaccaaaggcaggaggaggtgcactcttggagctggtgagagagagggggggatagaactgagagagagagagggagaggttgagggagagagagggagagattgagggagagagagattgagggagagagattgagagagagagagagaaagagggagagagagaaagagggagagagaaagagggagcgagagattgagtgcattattgagctgattgcttgtcttgtttttgtctaaactacgaattggtcttggctgttagaaagtgaatctcttaaagacactgggactgaagcacaggatttgagttcatagaacacagcctcagggacacaccaggacacattccttcacacataactttctggggtctataatgggaatgtagaggtcatgtgccctcaattggagagagacttagagtccttgagccactgtccctcggtggccctacccccacccccttgaaaacatctgggagacagtgatcaggccaacaatcaaaagaactaggagtattccatatgaacaggtagagaccctaataagagcagatgtgtattctggactccagaggtgaccttggcagacatgagatgcagtcaaagtctttttcttctagctctcattctagattagtctttgattatccatttagatatgtagaatcaaataagccagtattgatgtatcatatcatgctggggaaatttttgaaaaatatttacctgtctcaatcctgcctacaggccattttccaaaaataatttataattccccttgtaatgtattgttaatatgctctaatgatatcaatgcttaaatccatcataattttaacattatgacagaatttaaaaaattctttccatgttcctttgggactttgttatgttgtatgtacattatattaaatatagttgcatttataatatagccaaaattcagggttttgagtttttaaatttaactttttgtcattaaacttgtgcccatgtagttataagcctcttaattttattcttaatcacactgtgtgtcatgatttcccttgccacacttctacttttgttcattgcagctatttctaaaatttttcacttgtatagttagtattgcagtgggaatatctttgaacatttggattactgggtcaaagggtataaccacttttatggc

SEQ ID NO: 5815 - DNA, 442 bp, mus musculus
ccgcggcgctaccatggccgacgtggaagacggcgaggaaccctacgccctgacctctcactccaggagcgcaggctccaagtcgggaggcgacaagatgttctagctcaagaagtggaacgtggtggccatgtggagctgggccgtggagtgagatatgtgcgccatctgcagagtccaggtgatggatgcctgtctcagatgtcaagctgaaaacaaacaagaggactgtgttgtggtcttgggagaatgtaatcattccttccgcaactgctgcatgtccctgtgggtgaaacagaacaatcgctgccctctctgccagcaggactgggtggcccaaagaatcggcaaatgagagcggttagaaggcttcttagtgcagttgttcagagccttggtggatcttgttatcaagtgcccttcaaaggctagaacactccag

SEQ ID NO: 5816 - DNA, 442 bp, mus musculus; identical to SEQ ID NO: 5815

SEQ ID NO: 5817 - DNA, 351 bp, mus musculus
gctaccatggccgacgtggaagacggcgaggaaccctacgccctgacctctcactccaggagcgcaggctccaagtcgggaggcgacaagatgttctagctcaagaagtggaacgtggtggccatgtggagctgggccgtggagtgagatatgtgcgccatctgcagagtccaggtgatggatgcctgtctcagatgtcaagctgaaaacaaacaagaggactgtgttgtggtcttgggagaatgtaatcattccttccgcaactgctgcatgtccctgtgggtgaaacagaacaatcgctgccctctctgccagcaggactgggtggcccaaagaatcggcaaatgagag

SEQ ID NO: 5818 - DNA, 351 bp, mus musculus; identical to SEQ ID NO: 5817

SEQ ID NO: 5819 - DNA, 867 bp, mus musculus
atgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgagaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctctagccctcagagcgtccggagcagcagggtacatgggtgggaggttcattcagcacccaccagtcaggtatgttctgagtgaacccacagcagtcgcagaatgagcacctggcagggtgggtttcctaggaataatttattatttt

SEQ ID NO: 5820 - DNA, 939 bp, mus musculus
aagtcattttagctttgccttttatcagcttaagaaactgtagatcagctttaggcttatgtgttcaacactaaggaacatgccatgtttcttcagtgacaaaggcaaaaccaaggctgatataggaaagcaggaccaatggaccaaggtgttaggtgtcatatgtttttgggagcagcaccatttgccagggcatctgtcttcttcctcacagtgtacttcagttttctacatgttcctcctaccaatatgaagttatttgaaactcttaacccctctgtacctccacctactttccttgccagacttctccttaaaacatttgctttgtagggatgtgaaagttatctctttgattgagataatgtaattaaagggaaacttgatttccttgccaagtctggatttctctaccgagttaccacctcagggatttctaaaactcaattacagtctgctctgcttgttagtgaaaacaaggtgctataacgatctctcttcctgataatctgttttctgcatttaaatattgttaatattttttttccttaatccagctaattgaagatgtgagggtgtttcaatagtatgattcctgaaatttgtttcataaacgatattaactttatacttccaaacatgttaaagtgtgaatatgttttaaatgttttgttttccatatctaaatgtattttaagacttttacattttgcatttcctaccagcagtgtgttttatactgaatgcaggcatttcaaaagactcctattttgagcatgtctgtgcctgaaagtatgcaatgctaatttgaacagtaagcaatgtaaacacctcatatttaaaaattggttgaaaatgagaaaaagtactattttagtgaaaaagaaagtaagaaataaaaagttcttcatgtgaataattccaaagcacctcatggta

SEQ ID NO: 5821 - DNA, 1097 bp, mus musculus
tacgttacatgtgatgtgcttgagacacagtagagacctaacacactgtaactgtcatccttgcctgcactctagaaagccactgctgtagctcactctggtggtataaccatctgtccagcggcctcagggcatgcagtggctcagacatattttttcatggaaacctcatcaatggctaatagatgtaaagctatttcagctttttccaggtccttagtttagtggttttatatttctgcccttgttctttccaatttccaggtgcatgggatccagttattttttcttttctttttttcttttttttgatagggctgtacaggaatcagaattgacacattcgcccatgaatttccctcttttcaggtctccatttctcctggtactgcaaaagcctagatttctctgatctcacctctcccagcctcatctgggtaaccaacgtacttatttcattctggtcaagattcctctcaataggtttattgcagattgctgcagctgcaatcagtgtttacaatctgatgacaagttggagattaaggcttgtcatcactatttaattaacctcaaattaagcagtttctggccccattccatgcccttccacaagccattcagagctgctaaaacagtggtgtgaggcctgatagattccgggtcacaccactggagagtgggagctggctcagcagccactctgaagaaaatcaacatttgattcttactcttatgcctgagggctgaagataggtagctatccaaagaaaatgtaaagggaggggaagaaaggagggcacctttctatactagtaagtgtgtagtctgtgaattgcaaaggacatgagccaaaaagtgttccagagacagaagaaaaaagccttgctcttagtgtttaaaaataatttgtttttctaattgcagaggtgacatgcatcagtagtaaatggtaatggtaaaaaaggagaaaaataataagaaagtgaagaacattcaacttcctactctacacacccgcttttgaggcttacctgagctgtccaatctggtagtcactatcctcatgtggctcttgagcttttaaaatgtagcaa

SEQ ID NO: 5822 - DNA, 868 bp, mus musculus
tgatttggcttacacatttcaccactcacctttactaagatggaaaattaaatgctatctgtaggtccacagtcagaaagaaaaaaagtgataaataaggacaggttggaaagacttatgaactagcattataacggttctctcaaagctctttaaaaaaaacacacacacacacacacacagttttgcactgttgcacatgctagagtgtagtggcaccatctcagctcactgcaacctgagcctcccggttcaagcaattctcgtgcctcatccaccagagtagctggaactacaggcacgcgacaccacgcccagctaatttttgtacttttggtagagacggggtttcgccctgtcggccaggctggtcgcaaactcctggcctcaaggaatccgcccacctacacctcccaaagtgctgggattacaggcgtaagctcttggctcacactgaaggctcttttgattatcagcagcacaccctactcaaagtaactcaaatgaaaatggaaggtgagagttagttgtaatgctacagcaacctcacagacaccaaaaagtagaaatgaaatttagttggacattatgcaaaccagagcatggcgagcagaataaccaagatttctctgagcagaataaccaagatttctctatgtggcttttctcatttatgcatctcagagtcaggtccttcatctttctctcacctgccttcctctgcctactcatcttacataacatagcgcagcagtggtaacttcagatcctaggttacatgacttgtctactctagtgcccatctttgatgataacctctctgcatgagcatctaagtaaacttatgtgactttgagaagcgctttag

SEQ ID NO: 5823 - DNA, 145 bp, mus musculus
cagatattttccctcctttcctgtgaagtgacatttctcccagatattttctcttctgatctctttagagagttaagtctcttctgattgatcttcactgtcatattccttctagaattttgatagattccatagctgacacatt

SEQ ID NO: 5824 - DNA, 1058 bp, mus musculus
tttgacaaagtgctggtttgtcagtttcagagagaaagcaatcaggagtgttcatgtggaatatttttagctctgaaactgctcattgtggagtaggaagcctcaagaagaaagtatttcagatgcctttgcgagtcatttttgaaagagagagtgagagagacaattggagaaagcagcgagagggtctttctgctgcaccgtctctttagaaatcaatattgaggcaccagaggccatgttctgaaaggcaccctcggaggggaggggtttgggagatctcccttaccggagcctgaaagccgcatcctccaggcccaggtggtcttgagcaggccaaccctgccctctgctgaccgtcctggggaaagcgcctcttctttgaagtcccgccctgctgtgcttagtacgcggtgtgctaatcgccccagggagctggaagcccaggaagcttggcaccaagatcttgttagaaaaattacactgtgacattttgttcctgaaggaatctgataattgtgagcaacatcaggactgctgtgttagggaggccgaatggagcaaggactttgaagtcaggaggatgtgagttggactcctaccgtatcctggagaagttaatcacttccgctaagcctcagtttccctatctgtaaagaaaacctccttcgtagagctctttcgaggatgactaacatgatgcatgaagaatggctggccctgaacaaacaaaactaaatactatcaataattagtagctatcacaattaatcaacatccttctcttttccaaagtaccttttattgtatcacctttgcctttgcttttttgaggacatcacatggactgaaaatctcttttgttggtcgtgttttccagggtcgttttagcatcaacctttatggaaccggcttgtctttaactgaatctgccagatggatatcacaagggaattatgctgtctctgacatcaagaagtcgccggtaaggttctacagatgggttgggagatgaatttttatttctttctttcgttcttgtctttattactgtggta

SEQ ID NO: 5825 - DNA, 3171 bp, mus musculus
aggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggtgagtttagtgatggccagagctcactggaggacaatggacttggataaccaaaggtcagggcttggtcataacaatgactttattaccgggaaggacgagtcaaaaaataggaaggcctgggaaccctcaggctcgccactctaggtgggtagccctgtgattcagccagtgggattactgctgtgagaatgggaaagttgtttgcttctgggaatgtttgatccactaagtatcctgttggccagttccagtggatgcctgtagaaagtgggccacctcctcccgttccccattggaatctggtccgagttgctgtgttgggggtggtgcctgtgaactcgagtatagcagtgtggtattcattaaggaaaagaaagcgcaccaccggccaggccttctggctgagagttatcacgttacattattttctttcttaatatttcctttaattcacaacatcatctgaatgatcaggtttactttagcatccttttaaggtaatatgtttcatttctgacaggttttagagacctgaaacatcacagaagcttctgagtggttctgaagattcaagaggtatatatttttattacaagtagagtcattgttactattaatatgtgtttttaaatttttataaaactgctgtcaactcattcttggataaaagctccaagtgaaaatgttattgtaattcagatcagatttacagcagataacaccatactcttgagggccgccaaagtgaaaaaccacaatacttaactactccaaggggggaaaatgggggaaaaaggattcctttttggtgtccccactgttcacttagaattccatggccttggaacttgaggtttgatggaacatagcagtcaatttccttttcttctttctttctttgtttttttttttttttgagacagagtctccctcgcattacccaggctggagtgcagtggcgagatcacgactcactgcatccttgacttcccaggctaaagtgatcctcccacttcagctgggactacagctgattttttgtattcttagcagagaccgggtttcatcacgttgcccaagctggtctcgaactcagggactcaagcaatctgccagtcttggcctcccaaagtgctactattacaggcctgcagtctgtttctaaaggttccatcttcacagcccataatcaatgaagactgatttcgaaagttgggttttccggtatgacccaggaaacagcagtcctagctgatgaacatccagtgtgtattaagactctgtcatccagtggaaagagcacttaaaaaaaaaaaaagaacaaagatcccactaaagtgacctgagaatggcaggatcattgtctgggatatataggagaaatctggtccaagagatttaacacttactgggtgaattagaaatgcagtgaggtttctgaccattatcactgttcacaatgtaaaggcatgatgggagagcttaagggcacagtctttgaggcagactgcttagtgtcctggagtttctaagtcttagctattatagctgattattatacctactagcatgtaagcttcacaagggcaatgagtttagttcgtgactgcaccttcattgctgtatcctgagtacagaagcgctcctggaacattgtctgtgctcataccttgattatgattataattttttattcagcagacacacacttgctcagagccatcccactccctttgctctctcacagatacttttcccctcctcatcattcagatctcagctttaatgttatttaggccccttctctgccccacatggctttaaacttttatttaataaacatttccatagcatttagcatgtgccagatagttttcgaaacactttaccaataactaactcatttaactcatgacagctctatgatgaaggtttattattatttccattttacagatgggaaagcttaggtgcagaaaggttaagtaacttgttccaggtcttacagctgggaagctgcagatttgcgattcaaatccaggtggttaagctttaaatgttcaccatgctatgttgtctatcatattactttatttagtttcaggtatcactaaactggatcctatcaagcccttccataatttttgtaagttaaaaagttttattggaacacagcctcatccattcttttataatagaccatggctacttttttggacagaggcattgttgtgtagttgccacagagatcttatgtctggcaaagccaaaaatatttactgcttctcctttacaggaaaagtttgctggcccctagttggtttgattcacaggcccagtcatcagctgaagttgtttatttgattgcttgtttatgacagttgtagtaggtttaaaggcaccatgagagcaaggctctttcttgttttgttcacctctgtatacccatttgctaacgtggtgcctggcaccaagcaagtgctcaaaaaaaattgaataaaggatcattattcagtgggatagcaaagtgctttgtaattatacttagcccttgaccctttgttttttttttttttttgttgttgttgttgttgttgttttggcttttaaaggaaatttgttaacaaagttgtcttcattttgatctctaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataaggtaggt

SEQ ID NO: 5826 - DNA, 1360 bp, mus musculus
tttataaatgtcttaacagtttgctttctcaactctctaagttatttcccttgatttcttttcagctaatattctttaagcttcttccagtttctgtacttctcacttgtggttggtagcaggagtagtgagacagaagaaagaaaaaaagacacaattttaggagtatttcacattgtataaggtttctttgcttcgcaattctggtgaaacgaataaagaccatatggcatcctaggcagttttcctaatgtccatttattctgtaggatttggcttgggaaacatgttccatatcagtatgtatgcatctaggcaaaggcaatgacaggaaaactgattcttaggattcgacttttacatttttcaatggaaagtcatatactgtgcatcaaaattgcccgtaaaaattctatctatctatctatctatctatctatctatctatctgtctatcatccatctatctgtctgtctgtctgtctatctatctatctatctatctatctatctatctatctatctatctatctatctatcatctctgatagagtctggctctgtcgcccaggccagagtgcagtggcatgatcttggctcactgcagcctccatctcctgggctcaagccatcctcccacctcagcctcccttgtagctgggactacaagcatgagccaccatgcctggctaatttttgtattttttgtggagatggggtttctccatgttgcccagggtggttcgaactcctgggctcaagcagtctgcctgccttggcctcccaaagtgctggggttacaggagtgagccaccacacccagcttgtatgtagtcttttacaggatctgaaatctgaaatggtccaaaatccaaaactttttgagcacaaacatggcactcaaaggaaatactctttggagcatttcgcatgtgggattattggaatagggctgcttaactggtataatgcaagtattccaaaatttagaaatattcaagatccaaaacactctcttcccaagcattttgtataagggatattcaatctgtacggtaatgcttctttagaccagctgagctagactataggaagaaagaagagaccgtgtagatgtctgaaaatccagccactctacgtttaataactttcaaatctctaggtgtaaatggggaaatggatgttgagttaaatgttcctgcttgcttgtaggggtttattccattctgttttttatgttaaacttttatagccttaatatctgtcagtcagcttgtttgttgtaaggattaaatgagataatttatgagaaagatctcacaggccctaccaagtagtaggtgcttaaacatttgttgga

SEQ ID NO: 5827 - DNA, 122 bp, mus musculus
tcactttttgacaggacattcagagtgagccagtatcaggatgcagaatctgtaagcagacagagatacgttaccacacttttaacagattcattgggagtatggagtgtggatattgctgc

SEQ ID NO: 5828 - DNA, 650 bp, mus musculus
aggaagtgatctctctgcaatggacacagaaaagataaaaggttcaaggggaaatataggggaagagggagggggaacttaaatattggggataaatgaatttgggataattaaaaccaaatatagagaaaattctgaagggaaactgataatagtgtatatgtagacattatgctcctcaatggaaattttaaggatacaatattgtttccagtcatctgtctttcagcaatatcacccagtgactcgatgcaatcaaatgtgtatatgtagacattgtgctcctcaatggaaattttaaggatacaatattgtttccagtcatccccctttcagcagtatagcccagtgactcgatgcaatcacctcaccagttctcttctgaggaaacagttttagacagattcaaagcccagttcaatgtagccaagattctttaatttctaatttagctaattagtagcaatacaaactcttgccaaacaagaaatgtgaattcttaaagattaaattttattttatctctatgtagaggtaggaaaccaatcttttgggaggcacaaattaggatgacagccaacattcatatattcattctaaaataaagcctttatatgtaatgaattatttgtcataattctagaaagtgg

SEQ ID NO: 5829 - DNA, 669 bp, mus musculus
tatgaagtaactatgactttcacagtcatttcactctgtgactatttctaatacacagaatgagaaatttggacaggaatcttagcagctcgaaggttctatgattctcatatttccctagatgaaaaccccaggcagaaatattttctatttaatcagatattagttcataattaagtacatacaattgaatgttaattacatcttgttctttaaaaacctactttctgggcattctgcaggagacaaatcggaagaatgaagtttaacattttcaatacatactttgttatgcatattcctaaattagaaatggtttttacctaataattcccacctgtaaatgacttccagaagtttatgttatcctgaattaatcactcacataatgtcaaaagcaatgtgcttataaaatgtaaagacaaaaaagaactcggagggggggagcacttttaaaaattgttttttaatggatgttttcattttaattaaaaatcaaatatacaatttaaatacataaagggatgctgatatcagataattaacatataagtacatcttgctgacaacttaaatatgcatgtttttattaagaaataaagaaaaaactcaaaaatccaacagtcaaggtcttcctaaagtacttaaagcaatttgaagtttgttaaa

SEQ ID NO: 5830 - DNA, 603 bp, mus musculus
ataaagtaggctactattgctttggtgtgccctctgtaaattaagactatagtcgtggatcttaaaataacaacaatttgttagaacaaagaaacaaacaaacaaaatttcacatttttccttgctcaccattctaaactccagaaactctcactagaccaaaatatggaaacatggaagaaagaaaatgaaagaattatatgagatgtcactcataaggtttggtttgcacctcagttcaatcactctccagctacaacatcttgagcaagccatcttcacctccatctccggtccagtaattataagattgtaaagtaagccctgcctttgttatcatcaggggctgcaaaaagaatcaggtggcataatacctgtgaacctgcttggtgaactccaaagtgtgacataaatacttgtagttttttctgggaaggacttagcagccacaggggcattgtcaagatgatgttggaactgcttaggtcttctttctggagaaggaagaactcagacttgagctcttatgcagagagcccttagagtgattctatacgattaactaccttgggttgaagttatgtcactttctaggctaatgct

SEQ ID NO: 5831 - DNA, 1930 bp, mus musculus
tttaagtcacagaaacaaaatcattgagaatcagatgagtcttagtcatatattatgatgctcataagtatatgttttgtcctcattcgtatatattttttaaccatagggaattccttgggagcaatattaaaggggagtaatatttttataaccctctgtattagtctgttttcacactgctgataaagacacacctgagactggacaatttacaatagaatgacatttattaaacttacaattccacgtggctggggaggcctcacaatcatggcagaaggcaagaaggagcaagtcacagcttaagtggatggcagcagccaaagcttgtgccctgcacaagctgcttttaaaaccagcagatttcatgagcctcattcactatcacaagaacggcacgggaaagatccgcccccataattcattcatctcccaccaggtccctcccacaacatgtgggaattatggaaactacaagatgagatttgggtggggacgtaaagcccaaccatattaccctctgtcacagagtggaagtggcctctttcccaaagtttgccttaagtttgactctaagcttaggttggttggagaagacctttccatgacaattctctagaaagtttatcatttcagatggtgtcatgatgtgacaagttgcacgatgaggaagttgggccaaatcaataaaagtattttcaatgtgcataaatcctggattatcatgcttttctcaagactctagaagattcttttccccatagtccttgaaaagggtaagaaacaatgttggttattggaaaactcccataagggaagcagcctgccagttaaggctggaatttgggaccaacgctgctagacgatatgtaaaaacattaaaacacattacaagagaagctgctgttgattattaagaaataaacattcctgtggctcatttgaaggcaaatctgtaataatcagtggaggattcatgtgaccacatctgaagcctggaatttccaagttcctgtatgcagtgagaagctgagtgccacagcaaggcagatgaagaaaagatggtgttgaactgcttcctttccatctggtgttttacagcagctctgctcacagttactcttaaaggaaaatagaatgaagaaaaataaattcacaatcttgtgttgtttaggctgaataatctaagccaaattattgcttaggaataaattaaatattgtacaaagcagagtccaaacataaataaaatacactggagggagacctctcacttaatgagaccctgagctaatgtaatttgcccaataacagcaacataactataccagtgccaagtatgagggttagtatgggtcctgtcatttttcactgactaacctgtattaaattgcaacactcccagtattctctgccacttttcctaatttattttatctatagaatatacccccacataaaatattacatatttaacttttaatttttatttttcccctcttgcattggaatataagctccccaggcaagaatttcgaaatgttttatatccttttcaatccctggctcataataggcactcaacatatatctattaaagaaatagaaaaataattttctttctttaaagatgatgcagaaggccaggcatggtagctcatgcctgtaatcccagctacttgaaaggctgaggcaggagaattgcttgaaactgggaggcagaggttacagtgagctgagatcgcaccattgtactccatcctgggcaacaagagcaaaatttcatctcaaaaaaaaaaaaaaaaaaaaagatacagaagtaggtaatatataatataaaatatttattccaaatgcattctagttattgaaagacacttttaattcaagaagaagtttgttaattaattcatctttttatttttta

SEQ ID NO: 5832 - DNA, 1221 bp, mus musculus
aaagaatagggccaggggataaatacctctctagctcttgcaactcaagagatgtttttcatatcttagataataaatacttgcagtaggtttagctcataactaaaagtatgtgctaagagactcccctagaagagtttgtcttccgacatgctgaattgccctggggttggtggcagcttaataaaatatgtgagtgttcagtgcggagctgttaagttatttattccacttctgatactgcatgcatgaactgccactgtttgatgaatcactgaagagaatgggaactgacaaacaactcttcctttagcggctgatcacactgacagcatcaatagaaaaacacatcatgggttctaaaatgccacattttcaccgtttaccctgaataagacatgaagctctttaaggaaagcagtagtacgttatcattaagggccagctgacagagaggcaagtgtgctttgaactctctcaagtcatcattcttaatttcttctcttcttagatggaaggcccacccacatgggttctgagcaaggcagggactgttgcaccttttaaaatctcattgatagattggtttcatcaacacccatcctgactcctgcccatcgggagaagctcctattctcattagggtcctgtaatgtctgcagctaacattgttctcatgcaaatagaatgacacagaagatcagtgccatgaaaattcaatttcccccaaccatcattaccctttttcttttagttattcccactccaatctgcaggaggtaatgtgtgcaatctgctggtactgtgcaagatgattactacattttagtgatgaatttcccagctattgcactagggggtgttttagcaggttccctgatacacctaatgtagatgtggcagtagtccttgcagtccttacccagctcttccatagtggatttccacaaggagtggatgcctggtcagtagaacttgtattcaatactgttcattctttagtcatcagtggcacttgtgaaagtagtgatttgtttaatgttgtctgaaaaataaaaataaaatatatctctacctgtccaaattgaaggattaaaagctctgtcaaaagaaatgtagtaatttttgtctttagtctatgatcaaacttgggtaatttaataaggatgtaaaattcagggtagctcatataaacatattgaaattataaaagtgtgtaag

SEQ ID NO: 5833 - DNA, 1221 bp, mus musculus; identical to SEQ ID NO: 5832

SEQ ID NO: 5834 - DNA, 337 bp, mus musculus
caaaataaactccacttattgaaaatttattctagacttcttaaagaatgctaaatgcaattaaaagcaaaatataaatacctttgattgtttaataggagaataattttaaaggaaatatacatcaggaaaaacatttatgaacctcccagggttacatttggtgttagaggaatattgagaaaaaatattgataaagttagtttctggaggttttgaaactgaacacaaagtcggcagtacataaatacctacttgcccaatgcaaatgcacacagagcaataaacacacacatccaatagaaaatgcatgctgctgtttgttagaaaaataaat

SEQ ID NO: 5835 - DNA, 337 bp, mus musculus; identical to SEQ ID NO: 5834

SEQ ID NO: 5836 - DNA, 167 bp, mus musculus
aaatgctttattatgtgagtggctagaaacacatattttcatggacaatgagaagacagctctcaatttctcagtactatgagtagtgaattactaaatgactaataaactaccggtaccaaaacaacgtaactgaaagttaatattaagaaaggaaaaggaggttt

SEQ ID NO: 5837 - DNA, 615 bp, mus musculus
gcaacttacattctagtgggaagattttatgaaagttgttgatcacataattgaaatatatataatgtatttgtctctaaattatttctaaaaagaggatttcttaagtgcaggagataattctacaagaataaaaaatccaattgaaggtataagatgagtaatgaatattcagtatctgcagtaccatcataaccatcataaataatacagctgtccaaaatttagtcaagggcaagtttgtaaagattctccaatttctatttttttctaacagaagtgaattggctataggcattagattaagtatgtaattttctgtgcctttatgatcttcatcaagtcttacattactttggggcattaataactgtattagtcagggttcagtcaaagagagagaaccagtagaagacacattgcaatagtagagacctattgcaatgagttggtttgcgctattgttgggggtggctaggcaagtctgtaatctgtaggacaggccatcaggaagggtagagtggaactctcctgcatgggctgaagttgctctccacaggtggaatttattcttccatcagggaagcttcagacctatttttaaggtctttcaac

SEQ ID NO: 5838 - DNA, 125 bp, mus musculus
tgtaaaatttggggaagaactgcatagaactacaaaattttggattttactgaaaaaattatgaataagagatttctttcaattttccaaaatttctgtatcattgaattgtcacatatgtgatt

SEQ ID NO: 5839 - DNA, 223 bp, mus musculus
gttcttttgcaatttcagcaatatatggctaaaaattatttttactctcaacaaatattttggaagaaaatgggacaagtttatactcttatccttctttagagagaattttgacactggtaagaatattagttatgtgttcctgaattaacctatgatgtcatagtgcatttgggtgtggtgttttggtacttaatctaaaactatcctatcaggagtatct

SEQ ID NO: 5840 - DNA, 502 bp, mus musculus
aatattttattgtttctcatgctcgtaggcattgactgggcttggctgggcagctctcttctgaagttgtaatcggatgttgtctgtggttgctgtcatttaaatgctcagattggctgaatgtccaacgtggctcactgacatagttggcaggtaatgctgattgtcctgtgggcattcagcccgtggcttgggcagaatcagctacataatttacggaacctacctagtgcaaaaggaaagtatggagtttcttgttaaaattattaggacgttcgagatagtaacagcacacgttgcatgctcatgaatctggctcggggcttggacttctcacagtaaaatggttgggttctaagaagcattcaaagaccaagcattctaaaaggcccaaatagaagttctaaggcttttcacaacctagtaggtcacgattctaattgtcaaaaggaaatcacaaagccagctcaggttcgagagagggaaattagatgctatctct

SEQ ID NO: 5841 - DNA, 183 bp, mus musculus
aagcatgtatcctaatatgtatggtaatatctcactgacctcatgtcatgaggaactaagtaattataccttagtatgttttcaaattctgaattttatcactttaaacaccattttaaaatattacctctatttcagaattctttctaacatgttatgtgctttttagcctaggaaaaaaaa

SEQ ID NO: 5842 - DNA, 345 bp, mus musculus
agcttatctgcaaacatgggtttctttgctcaataagttacactgcaatttgaattttggaaggtggaatactcacatttcagtcacagagtagcaattcagcctcccaatgaaatcattcagaatataaacaggcacaaaacttcaatggtgagcaatgctatgtaaaacggaggaagtttaatattatgtacattatgtgactttatattcagaaaatttatgataagcaaatgatacatgaatattttaaatacaataaatttaataacaaacacaaagcaaaataatttttacatacactcaattaccaagtgagaatatattatgttaaacattgttttc

SEQ ID NO: 5843 - DNA, 6223 bp, mus musculus
tatcatcttgatttattgctacatcatcttcaaaatgacagtattgtgatttggaagaatatcctaactagcagggaagaaagtggaacaacataatccatgacactgaacaattctcatatttgttgtcagagtcataattatttgttgctttgcttttgaatttttgtttatgaatcccttgctagatgaatagtttgcaaatactttctccttgtctgtggttcgtctcttcactttgttgattattttctttgctgtacagaaggttttagattaatattatcccatctatttttccttttgttgcctgtctccttgtctgtgtttcgtctcttcacttccttgattattttctttgctatacagaaggttttagattaatattatcccatctatttctttcttttgttgcctgtggttctgaggtcttatcaaaaaacaaaaacaaaaacgaaaacaaacaaacaaataaaaaaatgtagaccaatgtcttatagcattttccaatgtttttattttctagtagtttcataatcttgggtcctacatttaagcctttactccattttgagttgatttttgtgtatgatgacaagtagggaggtctgatttcagtcttctgcatatagatatccagtgttaccagtaccattaaagagactgctttttctccaatgtatgttcttggtgactttgttgaaaatgggttgactggaagtatgtagatcttttttggggttctccatcctgttttattagtatattatctgttttgaagccagtaccatgctgttttagttactataactttgtagtataatttgaaatcagatagtgtgatgcccctaactttgctggttttgctcaggattgcttagctattagggtgttttctgactttagatacattttaggatattttttctatttctgtgaagagtttcattcgtattttaatagttattgcattgaatctgtagagatctttgggtagtatcagtgttcaaacaatattaatttttccaatccatgagaatgcaatatcttttctttttttgtcctcttagatttttttcatcagtgttttacaattttttatatacagatcatttatttctttggttaaatttatttctaggtattttttgtagctattataaattaaattgattttttcatttattcttcagattgatgactgttagtgtataaaaatgctactgaatttcatatgttaattttgtactctgcaatgttatgaagctcatttattataagtttctggtggagtctttagtttctttaaaatataagatgaagttatctgtaaagataatttgaatcgttccctttgaatttggatgttcttaaatgttttctattgcctaatttgtctggccagaaatttcaacactatgttgaaaaaaagctgtgaaattggacatgtatgtctcactccagatcttagtggaaaagctttcagtattttccactcagtagaatatttgctgtgagcttgtcatatatggcctatatcatgttgaggtacaccatttctacgctaagttcgttgaaggtttttatcttaaagaaacgttgatttttatcaaatgctagtttagcatctattgaagtaattatatggtttttgtttttaactctgtgaatgtgacatattatgttcattgatttgcatatgttgaagcatccttgcatcccttagacggatcccacttgatcacagtgagtgaacttttgaatgcattgttgaatttggtttgctagtgttttgttgagtactttcacaactatgtttattttgtagagttctttcacaactgcgtttgtttattgttgttgtgcctttatcttgatttggtatcagggtaatgattgattcacagaatgagttgggaagtatttcctcctcttcaattttttgaaatagtttgaatataactgacattagatcttctttaaatgtttgttagaattcattagtgaatcaatcacatcctaaacttttctttgatagaagaatttttcttagtttttcaatcctgttacttgttattggtcttttcaggtcttctatttatttattgctcaatctctataggttgtttgtgttcaggaatgtatccatatcttctcggttttcaaaatggtgggcatatagttgctcataataaaagctaacaatcttttgtatttgtgtgttaattataatgtgtgctttttcatctctgatttttttgtgtcttttcttcttagtctagctaaaggtatgccaatttttattttttttcttaaactatcttttgttttattatctttcttatttatttaatcttaattgtatttacttatgctctaatattcataatttatttccatatattaattttggggttggtttgttctcgcatttctagtttcttgtggtgcaatgttaggctgtttctttggaggctttctttttcttttttgatgtagcatacaatgctataatttttttagtacctctttttctatatcccctaggttttactatgttttgttttcattttcatttgtttcaatcatttttttaaatttacttcttaatttattcattgacccatttgttgttcagaagcatgttgtttaattttcatgtatttctatagtttcacaagtttctcttgttattaatttctagttttattctaatacagtcagaaaaaatgtttgatatacttttgatttatttaatttgttgagacttattttgtatctaacatatggtctatcccagggttccccacccgcagttggtacgggtacctgagactggtactggtccgtgacctgttaggaactgggtcgtacaacaggaggtgagcaatgggtgagtgagcgaatctttatctgtatttacagctgctccccattgctcacattactgcctaagctccatctcctgtcagatcagaggcagtattagattctcataggagcacaaaccctattgtgaaatgtgcatgcaaagaatctagcttgagtgctccttgtgagaatctaatgcctgatgatctgtcactcccttccaccaaccccagatgggaccatctagttgcagaaaaacaagctcagagctccagttgattctacaatatggtgagttgtataatcatttcattatatattaaaatgtaataataatagaaataaagtacacaataaatgtaatgctcttgaatcatcctgaaaccatctcacccccaacctttgggtctgtggaaaaattgtcttccacagaaccagtccctggtgccaaaacatttgggtacagctgctctatcctggagtatgttccatgtgctaatgttaataaaatagtctataaatgtctgttaggtctgtttgttctagggtatactttaactccaatgactgtcaattttctgcctgcattagctatccattgctgaaagtacagtgttgaagtcacatactattattgtattgaaatctacctatccctttatatcaactggcacctgctcatgggaagaaggctgcttcacgtgttttattggctcagatgagtatgcatcatctagcagggccctgcacaagcaggatagtttcctgacttcaacaggagagttcatagacaagactggctcctattcgtatatgctgtggagtggaggctggtgtgcctgtcacattcgctcagatgggcatgtgtttcccagcaggtctctgcatagacaggatagtttctcaactatagccgggaggctggatctgagactgggtctcctcaggatctgctgtggaaaaaaggctggagagccttgtgtttactcagagggctgtacatcacacagcactttcctgcagaggtaggagcgttccctgattcagtcaaacggccagttttgagatgggacctcctcagaatttgccgtgggatggtggctgaagagcttggtctttttggttcagagcgggacctgtctcccaagacgatgctgcacatatgagatagttccctgactgctgaagcaggaagggctggagctgagacagagccttcccaggatctactgtgagctgtgggttggaggctggacagtccatctcattggctcagacagacagacagacatctcccaacaggtctctgcacaaatgggatagttccccagctgcagtggtagaggatggagctgagtctggccccttcaggatctgctgtggggctgagactgaaaagcccatctcattggcctggacaggtatgtgtctcctgtcagtttttagtatagatgagatagttccctgactgtagcaagaagtgtcagagccgaggctggtcacctttgagatctgctgtgaaatggaggttgacaaactgacctgggatgcctagactttggggctgggagacgtgatagtctccctctgggtccttgtacaaacagcagctctgagttgaaaccttagctgaggaaggctggagtagaaccacagggcaagtttcagcctcattgctgaggccaatgttggcaggcagaggagcctttctaccaagacactagcgtgtacaattacttttggaccccttggcagatagttttgcttgcaaactcaaggtcaaatgaggctatagccaagttgcgtgggggactgggcaatttctcggcttgaacttggaagcaagctcagtgaattgctttgggagtgcagactaaacgcaggaacaacgacctgggtgttgtctactctcaaaacaatactcctaggtcttgggctccagaatagtttcaaaaactcctatttgaatcctgaggctcctatagagaaacttttaactgtggattggtatagaatttttgttgttctggggggatatgagtgcgttatcttccattctgccattcttgatgatgtcactctagtgtttaattttgatgaagaatatttcgtaaatgttttaatggatcataattttagcatcagaattaaatatttttaatgtaaatgtggatatgttctattttataacattgtgtttgaaaacaaatagacttacttaaattgaaaataagtaaatagttacttatgagtacatttttgaacctatttgagtatattcccttgatataaagaattgatgtaattatcctaattatttctagtgttttgtcaggattataatagaaaatgaatggtagggaagcctaattggtgttttgaataaaaaacttggtgctgcgcattgctatgtcctgccagtttatgtaaagagtgcaaaaaataaagaactctttatttacatatatgtttattcacttatcaatttattaaaatattaattaagggattattatgtgaagataatatgctagctgttgataattaaacaaaaaacaaatcagacttgaaaaagtggtaacatctttttaggaaagggccacatatattgagagaataacaaggatattcaggttgagattttgagctaaaaaataatttttctgcataagtattacttgacctaagacttaatgaataagagttagctatttatagattgatgaaatgataatgggatgataacttcagatacagaaaacatcacgtgtaatgttcttcctgggaaaaagcagcataacacataggaaattgatgtgagacgagtaggactgaagtataaagcaggacagaagatgaaaaacgtgaagtggaagtaaaggcaaaccagattgtgcaaaacctgttggccatctaaacaatacttaaactatatgatagaatatggatgcttgaaactttgtgtccaatctttccaagaaaggcccactgtatgacatttgctagaagaaagatcacaggacccaaattcaaagctaaatgtgtaattaagctctttaactttcatcattagtagatggtcacccacaatgaccatgctaattactgaacatggaagtgctatactggaacgtacgaagggacatctgagagcaaagtagatgaagctgtacagggaatcagatagttgatgggcatagctgagcctcagatccagggccacgtagagaaccacacatgcttttgagcattaacgatatgggaactatgttgttccatggttcaaccagattgatgagtgggatacattttctaagctgaaagtcagtaaattggcttcgagtgggatcac

SEQ ID NO: 5844 - DNA, 4268 bp, mus musculus
taaaacaataattaaatttgtaaatctatacgagttctgtggctaaagaaagtttatataattataaagcagttcacaattaaacatagatgaatagataaacatgtcaaaaatgttcagctcttgaatcctcttttctcaaaagaaacattattctgacttgtaatgccatacattcccttgtcctgtttttgaattttatataaatataaacattcatattttactttttgtgtttttcttttgtgcaatagttcatatgtaagattcacctttattattgaagcagtggctcatttattactttatcgttctgttgatgtacatttaaaccgtttgcagcttgaaactataacaaataacatcactttgaaatgttgtgtacatgtctttttgtgcacttatatacatatatctgtttaagccttcctacaagtgaaatactggcttatggggcatgtgtactttaacatttagtaaatactcttaaataatttcctgatgtagttgcagctgtttatacttctcaggcagttaagaaaatttgagtgttttatgtcctccgtaacacttgggatggttaagtctttagcatttttttcccttttagatgggtaagaagtagtagtattaatacataggctattaatttgcatttatcatataccaatgaggctaagaacctttcatgtgcttattggtcatttaatgccctcagttttatagttcctgctcaagtattctactcattttaaaaaatgagtgttgtgtcttttccttgctgctgcttatataaatcacttaaagtggtgcagagaaatgttccattgccatggtggatttgtttcattttccttttaattctgtcattttgttatttatatattttggtgttattagtagcttggcagtttaggattgctatatttctctggtagagccactattttatcatcaggaaatgtccctcttttctatagaaaatcagttatactcttgaaatctacttcatctgttattaatatattgcattatctctcagttgattaatgttttgtagtgtaagtttttccatcagttcacttatttttttgttggtggtggttgttttgttttgttttgtttttataaagtcggctagtccttgagttagttgtaattcatcactactttgaaattaagctagcttttattttgaagttttatttttacagaatgtgtttttttttaaaaaaaacctcacatatatcattgattataatttaaaaaataatgttaggactgtattgtaaggtgatgtgtttccttttgttttattctatgctttcacaggcattgttatcagaagagggtcaacacttcaccaactgctccctgttcacccctctccctccccaaaaacaaaaagtcctcatggtggtttcaaatgctcagattatcttgctgggtttcctttccctgaacataagtccattattcctcattatcttgctagttctgtgctgtcttccatcatatatgtcctatttttttcaagctttaatagttgttctcaggattagtctgtcttaaccttgtccattattactagaagtttaaccactcctttttattttcattttagacactgatcatacatagtgatttcattacttttgaacttgacctatattcctaaattctgttactatcttcaaacattttcagcgatacaattatacaatttctaaacaattatgttttctacccatcccacttatatactacttactattttcttgtacataattgatttggctagcattttttttaacaatattttaaaacattggtaaaaatggggatcattgtattgttcctgactacaatgtgtttcttacatcaattactataaagctaacttttgttttaatagtaataaaacgccaatctattcttattcttatctcattatttctgatcacaaatgggtgctgaaattcattacgtacatttttttcttttgtgaaaactactttatattcacgtaattggttagtatgtaactaattttctaatattcgataacctttgcatttctgcattgagatattttggcaatattttatcattttgaaatgtggtggttagttcctattagtatttcataaatttttttctgtcttcatttatgagtgagatcatttagtagattttttaatatcttggttcgataacaatctaagtgcttatatttttgttaataaagtaagaaaacacataacaaaaccattgtatttttctacattgacattattttcaaatattagcttaattcaacataaattggccctaaaaaagaaaactttaagactaagtaatagtatattgtaagaatattcatacctaagtaagctaaaataacataaaattgtaaaaacaattcaaacagaatattgaaatttacatgtgaattatctaattatctggaagatcacctatactaagtgtggtatagaatgttttacttttatatatttgtgtccataataggtcaccaaaacttatatacgtgtgtgtgcgtgtgtgtgtgtgtgtgtgtgtgtgtgtgaataagtttgtattgttattttaaaattttatttcagtttttgggctgaaatcacacatcaggctaggattacaaattgaagaactaagaaactcgaacagactttttattagcaaccaatttagccctctacatataagaaaatatatctatgatttttatactgaaatattttatgagatatacacattatagtgaaaaaattgcaatagattgcccaaaccattgtttactatttttatagctacttacacgcaagaaagaaagatatgaatttttcccaaccagttaaccacttaataatttttcactgtatatgctagagaagcagccaaagattatgggtcacaaaactaaaaatgtgttccttatatcctgatatcttatagaaagatttatggcatgcagaaaaataataagccaaaattcagataaccagtaagacatacatagtcacctatccatgttacgtatgtaagaagtcttgagatagctaccccgccataagtaatgtgtaatcattcctcgaagctatatttttgcatcatctcaaagatatgctccttcagagaattttattatcattatcaaggcatatctacaatttgcccaaaggagtaaaatatacagtttcagacatggatttcttaatttcgtttatgaattatatattctcccttcgttccaaatcctttctgccatgaaggagtatttgagattttatttctaaacctactcacattaacttaggttagaaaagcaaaattaaaaaaaatttagaattatttaattcaaggtataatatactgtgtgtaaattgaaggtttattttgtgcttacatatctgaaaaaaactggaagtgaaagtatgcaactttctttttattgactcttccttactatattggcttacatttttcttgatttaacctgttaccaaagaattcttgcttaatagtgcaattttatttaagtgtccttggtggtcattattgagccatagttaaaaatcttaatttttaaaaaacaaagccgcatttattttcatttatcttaaattattttgcatatctaacttggttttcttttatagattttgttatatcaaacagtgagtttgaacatgtttcattttcaccttcctaagttttatagtgtactcagaattgctaccactctcaatattaaacaggaaattagattaaatgtcctactcactcacacataattgtcactattagcctaattaggtgattctttcactttaaaattcttgcttctgggtagattttacctttgggtgtttagactaattcttctacaacctggctggagagaatatctaatcccactgcgtgctattaggtataatttatgttggtaacaaacatatgtcactaaatttcactgtttatttcatcacatttttcagctgaacaaagattacaaattaatgaagtgaaagctagcatattcagcaaagcacagttccaaataaagtttctttcttcacattacactaacacattatttattttcccatcacattgcagtaacacattatttatttacctaaaataagttcttcaactgattttagaattctacctgtctattcattatttaaattttattactggacttatggaagaatgccaactgcatgatgaaatagata

SEQ ID NO: 5845 - DNA, 729 bp, mus musculus
acatttaccttgttttctctttattcccattaatgtttttcatattgcgttcttctctccccttctttagttgctcacaccatttcatccatatgatttcctttttaagattttcatcctttaataggtcacccttacagttagtatttggagacataaaatgacagtagttcatatgattttctataactacattcctttttctgtttttcttaatttattttctgttaacatgttcagtttggtttgtatacaacccacgctctcataggtattctgtgacttccacttgtctttttctgttgaagtttccatagaagggcacctaggaatacttgctgactagacaaagtttgttttcttaaacttgcaaggcagaacaccagccatcgaccatctcaggaatgtttcaaagagggaggtccagcagaattggtgaaacttggtaaaataaaccagttactggaaaagtgatgagtttatctttggaatattagtctgtgtaaaatctgagtttagttaatctatctatggtcttattgtggaaaaatatggccataacactcgttaaaataattttcactcaagctacactgcatggtattgtttttcagtttaactgttttgtgaggcatggtacagttactttccaaattttgggttctgtttaatttgtcatttttttctcccttactctatttcccttcttccttttctgtgaaggagaaa

SEQ ID NO: 5846 - DNA, 1467 bp, mus musculus
actctgcattggctaagtgcttatcctggaagcaataaatattaggtttctgagacccctatatttaaaacagtttagttacatgagttttgttttggttgagtatgttgaatgagaagtgtctttcaaaggactggaaattgaagaaaacataattccagaagtcgtagatgttatgttaaaattgttttatttctgataaaatgacttaaaataaccctccaatttgggatatttttatttaaactttataagactaacaaaggaccaatttacaccatctgcttcagttacactctgatgtgtattttctctccattttttttctctttaaatagacattctgtttggcaccttgtgcttaagtacatgtctttgagtaaaaaatgtagtttgtctgacttcctgtcaaaccaatatttattcacaaatatctgttttgttgctttctcacataaaatcatatagcacttttccaatgtgaagagttggctagttggtgatagtgtgagctaccagctggagcttttacagtttttagtatgccagctgctttcatgatggacaatttgttctctgcctttagctttactttttttttttttttttaaacggaagtgtgttacttttgctccaattatgagaggacaggatattgcctcatattttaaaagtacatattttgattgttcagttaacaataacaatagcatttcttttgaaactattattctggtgaactgttcttgagccaaaggtgaatcagacactaagcctcacctctctgtaagatatctttcaactatctttaaaaagttcattcgaagtttctgttaacatagcatatttgaagaagagaaaaatggaacaagtgctgggaagatagaccagaatctttcacttataagtgtgttttttgtggaataattgctgggcaattctaatatttttgcctgtcctcttgctgcttcaggaaagtaagaatcagatctgcttgtcctgactttgcctggggactgttttacaatcaatgagaagcccgtacaattattttctctaagttatttgactatgtttctgaaacaaaatttgaactatgaggggtcaacaataaaaacccaagaatactgaaaatgaacttttccctggctatttataggactcttttgtttggaagaggcttctgtttttgccattatcttcatgggcattttttagcgtatgtgacaacttggaaacaaactaaattcagttgtgattaaatagaaaattcatagtcttaaaactcaccatataaatacccattacctctatgaggcttaaaattatattataaccagagcacttcaattcactggtaaattacagcaaaaaataaaaagaaagaaaaatacacctaaatcaggttatatatgcagcctacgagtttagaaatgtattgttgagtagcaaatggatgttttcaaa

SEQ ID NO: 5847 - DNA, 2538 bp, mus musculus
ttagccaattattttcaaatcgtgtatttttcttattctctcctgcattggaagactattttatacaatctttctttcatactgtccccattacctcagtgaaagctccctaagagagagccagcatcttttctacagtgtaagctggttgttgggctgcctatgtgaccaaggccaagtcaagctcaaagcctgtaagtctagatctcaaagattcatatgacagtggtggagtcagcaagtacagaagactttgaagcagtacatatcacactatggatttccctcttgagaattagtaagagcagtgtgtgttcagagctttctctctgggtttcagaagtcacctccacagtatatctcatttcaacctagctacaaagtaggaattcacagttactgctgaaccattatatttaataaaacacaatgtgttcttttattgtgaatttcacatgtgtctaatttgatgtatattttttccaatgtttttggtaagttttggaacatttcttatgtgaattactaaaaaaaaaagcctttattatactcatttataaaagatgtttatcaaattacctttcatcagtcactttcatttgccccaggagttgcaacttcaataattttaattttgcattggctttttgtcctattccatcttaaactgcccttctcacttatctatatatttattcatacatacaatgtatacatattattgtatttatatttatactttatataaatttatgtttatatttatacattatatatatataatttagatacattcagtactatatatcacaagataaatatgcttaaattttccaaaattttatggtttagttgtggtattaagtattaagatatgctgtctctcgtttttacacttcttttttgtgccttttgctaaaacttcttatcaatttgaatgtcatgaatttttttatacattgactgtcttagtctattgcatgttgctataacaaaataccacagactgggtaatttacaaacactagaaattcacttggctcatggttctggaggctgaagtgtaagaacatggtgctggcatctggcaagggtctttgtgctgtatcatggcagaaggtaaaagggcacttcccaaaacttctttgttaaagtcattaaaatgctccataaggaagagccctcatgacttaatcactctttaaagggccaacctcttaatactgttacaatggctattaaatttcaatgtgagctttggaggagacattcaaaccatagcattaacaaaactactaaatgttaacatgtaacttagtataaatagaattgttaaaaaccaattcagatcactctgtgataaagaaaaataaatcatttaaagaaagaaaattcaacatcatagaaaatacttcaaaaagtaggatgtcagccaaacgtggtggctgagctggtggtcccagcactttgggaagccaaggcaggcagatcacttaaggtcaggaatttaagaccagcctggccaacctggtgaaacttcgtctctactaaaaataggaaaattagtcaggcatggtggtgtgtgcctgttatcccagctactggggaggctgagacaggagaatcgctggaaccagggaggcagaggttgcagtgggctgagattgtgccactgcactccagcctgggtgacagagtgagtgaaattcatctcaaaaaaataaaattaaattaaatttaaaaagtaggatgtcattcttcaaattctatatagtaaatgataatttttaaaatttttattactcatcactttcacattgaatttttgatgtatgtgagatattagaaacaatattcattataatcagtaatttgctaattttttaaagataatattttatttgtggaaaattcacactcacctccttcatccccaaaagggaaatattagtaagaagtggggaaactgagggaaggaagcaagatcaagtggtgaaactttccgtagcaaaaatatattggcaatgaaaaatattaaactcatttcatagaaaattatggactattgttaataaaatttatattattttaatatttttattcttatgcctacgttttaaaaatataaaagagaacagtttcttaattgtacaacaagtgcctggattttcagtttgtgtactctaagaagttgtttatttcattaaataattatgttattaccttagtgaaaacagaactgtgaaaaatttaatccaaatttcaggctgtagaaggtacaacttcgggattattagaattgtacacaatgtagtctggagtcattttcccttcctgtgttgtaaatgccaactgaaggctttcacagaatatgggattctgtaaaattacaaggcagattataaataacaagggctggtttctctatctaatgaaggcagatgtttttgattcccaatctacctttgtgtatgcatttccataatagcatgacatataatcttcttgtctctttgatataaatgctacatgagagtt

SEQ ID NO: 5848 - DNA, 2538 bp, mus musculus; identical to SEQ ID NO: 5847

SEQ ID NO: 5849 - DNA, 2538 bp, mus musculus; identical to SEQ ID NO: 5847

SEQ ID NO: 5850 - DNA, 1711 bp, mus musculus
aatagcaatgtaactgaaaagttaaaaattgctgctgtctttcatctttatttgccctcatgtacctgtttcactcttctctacacactgactttctctgcttctttaatccacataagaaataactagaagccacatactacactgttcccagtgctttatttacttttttaaaaaatatataatccttaaatcactttttgggggaaaaaactctgactgcatctcttaggtccagtccaataaactaagatcataaaggggtcaggtgcaacagtatttgaggacttagagctataactgaagtcaggggatgggctgataagtggtttattaggatgttggtggacacgacaaacaaataccaattacaccaaagcatagttctttacccaagtatgtgtgcccacaccctactccagacattaaacccgaatctctaatgtattatctcagaattgagattttgaagaaataactttcccaggtgattatgatgaacacctttacccttattgaaaatcattgataaaatatacttataagttagtaaaatagaatagaactagttctgcttctcatctcaagtactttggatatctcatgtgaaatgagccatgtctgtcaggtgcacactggtacaaaatctttgaatctggaacgatcatttatctgttatttactttgtgaagctcatgaatctcagacttgtgtttatgtttggacaccgataagatagaatggattgagggattacaatactgtacttgtatccacaaaagagtatgttatgagttaataaaagataaaaatggtcttctgtttaccactgagatgtagaaggtaaaatatcctgttccccagtatgggtttccttgacactttgcttatcttctttgctattctagttttattgtattccctgatacaactgggcagatgttccatggtacggaaacggtctgtctggtttcaggagacgtttctgaacagcaatgaacagttttacttcactttattcaaaatgttcttgttttttcttgagtctcacagcttttggttgcaaaagttttctagccactcagagacaactaactgcagtctacgtacatgtcttgatatcccccattatacctgcattctctgaacatgatgccatctgaataaaaccaaagcattaacacaatctaaaatatattaattgttcctgataattatgacagaatattttgccctgtatgtagaaaaaatgttttttgtcagaaatggcattttcactctttttgctagaggggatttaaaagtttttccactttaaaaaagcatattttaacaatgagaatattctttgaaggttagaaacgacattaagctttcaagagttggtatagatctatgcaaggtcactactaatttgctgagagtggcaaacatttaaaacatcatacatgaatataaaccaagatctttacataatatatttagcaaaaggatgggaacagttatttcacaatctatcccaaaatataacacagggatcaagtcttactcatttttatgtttacagtcttagcatggtgccttgtatataatgtttcttttgcgtttgaatagattatttagcatgccatttcattttttaaacggataggcatacaaatttatcttaatgattcagaattgaccttgatgctttctaatgctgtggtgc

SEQ ID NO: 5851 - DNA, 208 bp, mus musculus
aactgaggtgaaacgtgcatattttttgaagatcacagcttccccaattcaaaacaagaaatagaaaattttagtagatctctatctatttcatatttttgtaattaaaaagaaatcccacaaagaaattcctgacacaaatagtttcagtggtgaattctgtaaattgtttaagaaagacataatatcaatatcaaacaaaactctt

SEQ ID NO: 5852 - DNA, 225 bp, mus musculus
gcaataatatttcctaaggttcttatgggtaagttaaaaagtgttcatgagatctccatatgcaatgtaacaaacttacaacaatatttgactttcatcatttgcatactaagaaaatgacttataacttatttctatgtaacagagtattttctctgtgaacttcattaacatgggtatttttccatcttcttgatttggaattacacttcaaatcatcacatg

SEQ ID NO: 5853 - DNA, 810 bp, mus musculus
ttgttacaaaactaaaaagagataatgttatataaaatcctgttgaacataactattttttaataattatacttcaaggtttggagcagatacactttccattttctttccttcatgaaaatgagtgaggagtctgttttaaaaagaagaagaaatgatcaagagcaaggggctcaaaccccacgagaaatcacctattcaccaaaagaggggaaactacctcttgacacacaacgtgttgaaagctctttttaaaagctctgtttagaataccatctggtcccagcatgcttcataaagcaaagaaaagagaggatgatggggcttggcacatctacagctctccctgttagtgaaggaatgctcgccataatactggctaatggatgaagagcaaaatacaaaacaaggagcagcaagtgggacccagttcgttaggcaatgtcacctacatgtaaatggggtcatgatcaacagtatctcaaagactaagcatgcttatgggcttcaggatgtagaaaacatcctgagtatccactaatagggtctggagtaatagacttgaaaagcagcattactgaaagagtgaacagattgctgggctgaactaccatggtgagagccagcagcgtggtgccaaaaacagtcaggactgttatgatacctgagttaacacagagatgatgccaatgtgcccaagcatattttttagaattagaatggccctttagttagaaataataataataaataggcagaagtagttaccttaaggaatcatgttagcttaatgctttctttaaggggata

SEQ ID NO: 5854 - DNA, 1374 bp, mus musculus
gagtactttatactctactttaggcccagcatttgatttaacctagggctatatgtacatataaattttcatggacacatttaatacatttccatttttatagccctctcaaacttttcaaatagaagtgaagggctgtttaatcccttctctttgagagatttaggaatataatatatgtgtatacaacctgacttgctggctctacatttggctttttttgaatcagatattaatttgagaagacagtttaatattttcaataaatattacatgttgctgtttcacacaagagggatttgtcttctctgaattaatttagtaacctgaaaggtttcagatggtagaacattcatttagatgcaaaatcacaaggtacagtcagaagcaatggaaacctctctaatgctcagttgaggaccctgctgggctaaaatgtctctacacattttccttctcatatttaggagaactgtaaatcgctggaaacagctacttcatttctgttctctggccagtgcttgaatcccaggagacattccagggtgtatgggtttgatgtcttcagcacatcctccagaggactctctatacataccacagttgaactggctgcctttgtaagaagttttgatccagcaataagattgcattatctcttttccctggagagaaagatcccgtttgatcaagtttacagtcacctcagggtcagcagggagcattttgcattatgtcttgctggctcttccgcagcctgcagtggagtccatctgctctcctgacagtacccgtttaaacttgagcagcagcattaagaagggaggggtcaggaaagggatgaagcataaagaaatccaggtatgaattggtgaccagatgtttcagttggagggagcaatgtccaatctattgttagaaattcccatttcagtgttgcttaactatactagttttcagcaccccagtattttatgttctctcaggtttagggttaattaccattcttctttagaagcacattttgaggacatcaggtgagtgaagagattttcctgccctatcagagtggttttcttccaggaaaattccatctttctattaaaataaatttcacactaaaaacttgcattaaaatatttttaaagaaaaatatcagtatttcattttatagtaatcgctatgaaagtatgaaaccattctatgaagcacttactttgcctatggaaagttgtttcatgtacatttctaaagcattaacaaatcacaacacatacagtgtcatggacgattagaaaattattagctaattaatttttattagccaaaaaaacccctcaaaaattaacatacatggctttcttttctcctgga

SEQ ID NO: 5855 - DNA, 775 bp, mus musculus
aactcatattgcaaactctccctcccaccaaaaaaaagagtgtatctccctataaaattcaatgtagtactgggggaagaattcattggaggaaggaatacctgcacatttcctaaaggtgtaaataaaataaaagcataatatgtaggatgcttgctgtttttatatatttcacttactacttcaatcaacttcaatgactaggttagttttaggataggcaggcccaggagggaataattctatcctgcctcagtatgacctattagttatgataagaactgctctttagcattgacatattccagtgctctcattcatcaaactagaataatatatctaagaaagatatgataatcttggggaaaaggagagatcagtgaaccacattttgaaactagttttagattactacctttagtatttctaaaaagaaaattacattgctgtcgttttaaatcctttgaaataaatgtattttaaaagtcatcagggaaaaccattgttacacgacaatgtttcttctagttgttgtttgttttgttttctttccctagctaagttttactttcttccctgagaaaaagagtagggaacagctgtatgatctatgcaatagttgatgcaaaactacatcgaatcctcatgctgtttgccatgtctttgtctattgatatcagtaaaagcaacatgacttggtttctcaaacatacaagtgagatcactctcctcatgagcaacattcaacatgctggaagaccaagtaagactgcag

SEQ ID NO: 5856 - DNA, 178 bp, mus musculus
ttacaaagtaattcacaaaaggaattctaagagaacatggaaagctgatcataaacttaatgaatttgtagggatagaggaagaatataggaaaatgaacaggggtagtgtgtattgattacttttgattatggttggaaggtattatgtgaaagaaatgagttcaaaaaaagaattg

SEQ ID NO: 5857 - DNA, 809 bp, mus musculus
gaaaatcaggctaataactagatgtgaatagcacccagccctctgtttttctcccacatcaggcagcttgtgttatgtagaagtcctaaaattcttggcacggggcaagcaggagcttcctgagtgtataatgcccacaactagcctatgatgccaagggcctctgtccaagatgaggtttggcaaaacatatgtcaattatgtcttctttgtcacactcaggttgtcactgctcaggtactcctgatcctgagacaccagagagggcttatggctccagcctcatttgaagcataacttttcctgggacacaacttccatagccttaaggatagatgtgagtggaggaaattctgaatcattgatttcccctgccattcctaagccaatgacaagtcaaattcagtattagaagacaattgcaccataacccgctatctaagcccttctgcttaagaaactccctcctccctcaagccctggtctgtccctcaagccctcaaaagaattgtccacagtggagtgtttgtgcggagtgtttgtgtgggtagtgggcagcaggggaatagttagcaattggtagcaacagctagatgcatctccttccttctgtagaaatgggaacccaatacaacattagttactttctgggctaaatgttctcaggctcagctcatacggctgtcttaagactccattaaggcaagattcccaacttccaggcttctgtcttctgcctagcatagatgtctagcttcttacgtgtctgtaaatgtctctgtaagaaacaggaaaaacttagtcaccat

SEQ ID NO: 5858 - DNA, 670 bp, mus musculus
attagttaaacttcccctgactgactctgtgacaacatacaaaaatgtatgtcatgcattctttctttgcccttctaagttagtcacatttaaaataaaaatagcctgtggacatatgttactttttctaataattatgctctttcactgcttccacctctcaaaaataaaggtcttgctgtatctcttttgtcttatagagatgttaaatatgataagagggttaatatggaatatctgagttatgatgaggtagtatagacgtgtagcatggttttgatcagaaaacagtgaaattatgatgaaatataatcgtgccagaacatctcatgaggactaaagatgaatactttctgtaatcaatggttgggtatacatgatgataattccaactgaacttgacttttgaaagaattagagaaaaatatatgatagtactgggagggaagaggtagaaagtgtgtgatcaagacagatgtcaagaagggaaatacagctgaaataaaaagtcaaccaggatgatcccagcaggcataattgtattctaaaagaagctgatcctcaattcatgtagtctttgtgagaacaaatgattaaattatatataaattgtaaaattatttagaccaagtttgaacatgtgtagataaaagaaataaaaataagatat

SEQ ID NO: 5859 - DNA, 2966 bp, mus musculus
aatgtagtttcagagtttggttgagcccccttcagtttgtttttctatcccaaataaagggtgcctttacagcttcaaattttcagcacctgtttccttgttgtcttagtctgtttgtgttacagtaaaggaatacctgaggctgggcagtttataaagaaaagaggtttgcttggcccatggttctgcaggccatacaaggagcatgacaccgccatctgctcctggtgagggcctcaggaagcttctactcatggtggaaggtgaacgggagcaggcatcacatggcaagagaaggaggaatggggggtgggggaggtactaggttctttcaacaaccagctccaggtggcaggggtgaagaagggagaagactgtcatgggaaataattgagaactcattcattactaagaagatggctccaagctattcctgaaggatctgccgtcaagacctaaatacctcctgatatggtttggctctgtgttccccacccaaatctcatcttgacatgttgagggagggaccttgtgggaggtgatttgatcatgggggcagtttcccccatgctgttcttgtgatagtgaaagagttctcatgagacctgattatttgaaagtggcagtttcccctgcacatgctctctctcctgctgccctgtgaagaaggtgctttcttcccctttgccttctgccgtggttgtaagtttcgtgaggcctccccagccatgcagaactgtgagtcaattaaacctcttttctttataaattacacagtctcaggtagttctctatagcagtgtgaaaatggactaatacacctcccttcaagccccacctccaacactgggtatcaaattccaacacaacatttggagggaacaaacatccaaactctatcacgtgttcttacccaatggctatgtgtctttatatttaaattgctttttccatctcatttctttgtcctcaattgctatcttttccgtcatcctctttagatggatctctttccttttctttcaatactacaccactttcaggagttaatgataaaggccctaactggtacctactagtaagatgcagcttatgaatatgttttggtttggtttcaattttgtatttggtttgaattttagttttttatctccattctacccaaagtagtaaacaatttaatgtttgggccaagagcagtggctcatgcctataatcccagcacttcgggaggccaaggtggccagatcatttgaggtcaggagttcgagaccagcctggccaacatgaggaaaccctgtttctactgaaaatacaaaaaaaattagctgggtgtggtggcacatccctgtagtcccagctactcagtaggttgaggcaggaaaataacttgaacctgggaggtggaggttatactgaaccaagatcacaccactgcaattaatcctgggtggcagagtgagactctttttaataaaaccaaggagtagctcttccatgattgggaaaagttaagttattttcttttcaaactccattttccatctgaaaagatttagtttgttgtttatccaatccactcatttgatggccatttttacgtacatgaatccttgaatttcattccattttctggaatattttacatgtgtgttcttataaaactttcaaaagttgtttttatatatgctttagaataagtattgttgatacataaactgtagcttatatagtgattttcagagtgttaaaatttaaaatttagattctgtgtattatttttgtaataatgcaaatactgcaattaaagataaaaagagagagacaaagtgaacaaacagggatctgttgagggagggacctagaaaatatcaatcactaaaatcaaataatcttttcatctatatccttaattcatatttttatttatagtgattcctccaaatcactaaaagttcagaacacataaaaattctagaaagttctaaacaaaatcttctatgacccattacaccttgtttcagtctgtaaactcttcagctaatggtctgcctcatccttatcattatctaattcaatatttatttcagctcaatgtaagtcttaaagattcatttgccattctcctgcaaaagggaatagcactaataggactcgctactcaaaaaagattggtttagaagattttgcccctttcttacccaaaggcagctcttttactgatacttccccaagcctgttgtgctctgagaacaagcttttatttcccctttcctggaatattatccaagtcatttctgaatgacatattatccaagtcatttctgaatgatacttccccaagcctgttgtgctctgagaacaagcttttatttcccctctcctggcgtattattcaagtcatttctgaatgacccagtttgcatctaaagtccttattgtttctaaccagcagcacccagaactggacatcatctttacctcctgaataaggttagctgtgctagtccgtatcagataaaactggactgggttcacatgcccagtttgaaaatgctttctgattgtcagtgattcacccttccccctagtgttggtttttttgttggtttgtttatttgtttttgcttctcatttatcatctttctactctctcatccgccctaacttcacttttgatctatttaagatttgtctcaccctcctcccagaatgctgtttggcctgctcctgatagtgccagcgtgtggtgacttgctatatcacagacatgcaccaacgtctgctatttgactgcataaactcagtgtttgcccagtgaacttcagatcacactgagcatctaattctaaatatatgcttattaaggctctctgtgcagtaacccacacaattccttgtattatgttaatgaagcaaccattctgtttatttgccctcaccctaattcaaaattacacatggct

SEQ ID NO: 5860 - DNA, 292 bp, mus musculus
atttcaattgttaaaactagaagtgtctaccatgaaatgatgtttgtgattccagaagtttgtaatgcccttggggacaacctgaacttacacttgtgcaaatgcacaatgcccattagaacagcttcaatttgtcctacagggagtcctctgacactgttatgagaatttcagtttttcattcctttctcttctggcaaaagaccctagtggcacaactgggtcatttatgtgctcaaagcatatttaataaacaacatttttctatgcttggaaaaagaaaccttcaaaa

SEQ ID NO: 5861 - DNA, 192 bp, mus musculus
agaggactatggagtataagtgtatcattatgtggaagatagcactgccatcagtctataacctgctgtaagaagcattggggaatagcttcacatctaccaagtctgtccacaggtttactctcctgtaaagaggcttcctggggtatacctggttttgaaatggttaatattactgtgtcttcatcttac

SEQ ID NO: 5862 - DNA, 1531 bp, mus musculus
ttttcaaacaagtataaattctgcaataaagagatgtagtttttttttaagattgagtttttgtttgttatttctgaatggttcatcagtatgttaactataccttttatcgagaaggaaaatcactaagttttattcaggctctaccaacccccattatatctactgtttgtttatgtcctaaattaacctttcatcctatgaagtaataaagttcattttaaaccaacgattaccaaatgcatttttttcaaaggaagggcaaaaaccaaatggcactgttttctctgaatggaaatctgtaagttagttaaaatgtttatacttcattttaagaccaaacaccaataaggacttctgaaaaattgttccttttttcacataatgttagtgactaaattaaaatttcaagaccactaatggattcaatcatctttattaacctatcatcagtgttacattttatacataatatcttgtattctcaaagggctctactttagtacatcatgttaatagtaaaaagccaagtaagatggctaaacctcaccctagcattttaatatcctccggacaagggaagctagaaagtcaagtcaatcactttatacatgtaagagtagtgttccaaagtaactaagaagctgctacatttttaagcagggaggaaaaaactttcattttggtctttgtgttccagcaaattatactttcaattaacaccaacaatgatatcataaaaaatgctctgcttttaaatttctgaacttcttcaatacaaattaaaatagtactggagtcttttgggaggccaatagctagcagctacattaattggtgtagaggagcctccttatcgataaccaggtccaggttgggtatagccctgaccaaagggaggacggttacgcgcataaggattaggcccacttggaggaggggtcatggtacttccaggaagtgaagtaaaacctggtcttggttgataggccccaggttggcttggagccattccaggttgagaggcaggagccacagtataattagtaggctgagaagtttgggcagtgtaagtttgtgcaggataattgctcgcctggtactgctgtggcggctgagcaggcagttgttgaggctgaccagaaaaggcaggagctggtgcctgggaagttggttgctggccatatccctggaactgctgaggttgttgaggtccagtctgctgactatagcttgctgaaaaggcaaaataaataacatgtatcttatcttttagtaaaactacttttccaaagaattagtcttactgttaggtggaccaaaaatggtgagaaatttaataaatatgtatgtaacaagcagagtggtagattccatcacataatatttcaagaccaagtagttatcaaagaggcattctctacaattttttaaactctctaagacataatccctgagagcaaattcctgacatagcataattcctagaacagatgctcaaatgataaatgaaagaattatactttctagg

SEQ ID NO: 5863 - DNA, 1531 bp, mus musculus
cctagaaagtataattctttcatttatcatttgagcatctgttctaggaattatgctatgtcaggaatttgctctcagggattatgtcttagagagtttaaaaaattgtagagaatgcctctttgataactacttggtcttgaaatattatgtgatggaatctaccactctgcttgttacatacatatttattaaatttctcaccatttttggtccacctaacagtaagactaattctttggaaaagtagttttactaaaagataagatacatgttatttattttgccttttcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccattagtggtcttgaaattttaatttagtcactaacattatgtgaaaaaaggaacaatttttcagaagtccttattggtgtttggtcttaaaatgaagtataaacattttaactaacttacagatttccattcagagaaaacagtgccatttggtttttgcccttcctttgaaaaaaatgcatttggtaatcgttggtttaaaatgaactttattacttcataggatgaaaggttaatttaggacataaacaaacagtagatataatgggggttggtagagcctgaataaaacttagtgattttccttctcgataaaaggtatagttaacatactgatgaaccattcagaaataacaaacaaaaactcaatcttaaaaaaaaactacatctctttattgcagaatttatacttgtttgaaaa

SEQ ID NO: 5864 - DNA, 1531 bp, mus musculus; identical to SEQ ID NO: 5863

SEQ ID NO: 5865 - DNA, 1531 bp, mus musculus; identical to SEQ ID NO: 5863

SEQ ID NO: 5866 - DNA, 198 bp, mus musculus
cacacaatgaatttttgaatgatcaacatattggcagtagtatggtttagggttttgctctaatgtataataacctacttgcaaaattctttatagacagtctttcagcaaaacaagtgattttgaacattatcccattttgtgaacaactcaaattttaaatattgatattacaactgagttaccagaatgactaat

SEQ ID NO: 5867 - DNA, 841 bp, mus musculus
ctgagaaatatattgcaaagtctaatataatatctgtatcttttttttataattcttataatgtcacaacttaactttaaacatttgtgtagaatagtgaggcagaagcttggactagagacaaagccatattagaatacacattatcaaaagataaactgtatagtctgagccaaattgtttggggccatcttgtccagcacccccacacaaaataagaaagtaaaaggaaagagttaaacccaggagtctgcaaaacaaaggcactggagtagattggagatgcttccagagttgctcattatatatggggtttgagcagacatgaagaccagtggagtctactactagggaaaagcaccattctggctttcatataacagtgaaacactctaatatgcaaaattctctttttaatatccttttgtatctttgggacttatcttgatttttcccattgtctagttcacatttctcctgcctcaacttctcaactttaagcaatgattgctgactttgtactctgtttcctggcttccgatttcacatttttcttttgttatagtgcctccaagcattaatcctttggtaaggagtttttggctcagttctagggctttccatgcatatacagtgcccttataggcagccttatagttactttgagcacttattgagatagttaccaaggtcacctggcctgaactcacacatatgaaaaagtgcctggtgttgctaggtggtagaataagacttacccataattgacatatatcatttttaagattgcaaactttctttaacattttaaactagttttgatttaaaaaattcaaaagcg

SEQ ID NO: 5868 - DNA, 263 bp, mus musculus
ttccatacacatatagtatgttcaataaatattccagattcattagaccttgtgtttaagtgacatccctacacaaacataaatgttgttcatcacatactgttattactagttcatttgtaaggttgattgccaaagttgaatgtctatgaaatgatattagttgtggtaatgttttcttcatttcattttatgtttttaaattgtggtcattgaacattgtacacatattgaatctctaatgggtagaagttaaataaata

SEQ ID NO: 5869 - DNA, 1431 bp, mus musculus
gtcatctgctccaggttgggtttagatgtaccatttttctccacactgcaggtctgtgagttctagtccactctccatgtatgtcatcctccttggattagcagatcagcagggcatgctcttatcatagtgatgtcaaaagcacaaggcaatacacagaattacatgagactcttaagacttagattcagaaaagcacacggtcatggatgactacataccgttagttaaagcaagccacatggtcaacctccaagtcgagaggctgagaatgatactacactcatgctaagaccatgccaagggtaaaaagtcataattcaggtttagctcagtggccagtgtcagggagcattcagtctatagaattctaaattacatacaaatgtatgtctcttaaagcagcagtctccaacctttttggcaccagggaccagtttcgtggaagaccatttttccatatatttggggtgggcatggtttggggatgatttacaggcataacgtttattgtgcaccttatttctactgttattacattgtaatatataatggaataattatacaactcaccataatgtaggaacagtgggagccctgagcttgttttcctgcaactaggtggacccatctgggggtgatggcagaaggtgacagatcatcaggcattagatactcataaggagcatgcaacctagctcactcatatgtgcagttcacaatacagttcatgctcttatgagatctagtgccactgctgatctgacaggaggtggagctcaggcactaatccaagtgacggggagcatatgtaaatagaaatgaagccttgctcattcctctgtttgctcacctctggctgggctgcccagttgcttacaggccatggaccattaccttatgtcacttaaagcagcagtctccaatctttttggcaccagagaacagtttcgtggaagacaatttttccctataatgggggtgggagatggttttgggatgatttatggacattacatttattgtgtactttatttctactggtcagtggactggggtttagggacccctgatttaaagaactgcgttaatcacaaaaacacacatataattaatcttgaataaaaatagaagacacttatttagcataaatataaaatgttataattactgtggtgcaggaaatgttaaaaatactaagcaatggttttcaaaacaagtaaagattaataatagattcaaccaaatgtgtgagaaatttttaatttgaaaaaatgtagttgtcaaaagtaagtataattcagtaacatgtttgcttctatgtttttgaaaactagatagtatgcaactttcagaattctagtttttaaatgtggagattaaattagactgataacacttcttaatgaaaggtagctcagcatcagagtg

SEQ ID NO: 5870 - DNA, 1056 bp, mus musculus
gtcaccccacctagcagcctcagtgagacctatgcatccaagccaagcgatgctcctaacaaggcctgacacttgcactcaccatcaatagatattagggactacttgcaggaattttggtattgccatttcaaaaaaaaaaaaatgcccatgattactatcagacaccctgtcatctcatagagttagctattttttttttctggattttggagaacagtctactacttgaaatttgataggttgtctcatctggtgctcacaatacctccataagaaagaaaaagtggtcatttataaaatgaggtaacaagttcaatatgatcaagtggcttaggtatagtcactgctgatgaagactcccaggcctgtcagctaggatggtgtacttgagcaatgaatctgggaagctgaccttcagtatatcctgagtaacatgttgaggcaacctgatgtacaggaaaacatctaggcagagtttctgtaactgcagagaggtgccaagagaggatgaaaaataaaacctataaggatgccaaaaagaaactttttaagaaacctgagcaaaactgtgaagccttttcagcaacagccagggctcttatggagaactgaagtccagagaaccttgaccaattcatgagaatggatgataaattatgaaccgaatcaatattctcttccaaaacaaaagctgagacatgcattatagatttagaaaacacagaggcaagagaaatcagagtacaggatcacagttgaaccttaggtattcttgtctggcctctttttaatttgttttacagatgaggaaaatagggtataagagttaaacagatagcaaacttgataaagcaagctaatggcggcacttagactgaaaacctgattcttcatcttaatccagtgctcttcttacctcacagctcagctctaactgtctgctacatataggaaggcagttacagcttctagaaattcctcccatattctggttccagaatttttgcattagatacactacagggtggtcttctctttctgtctctctcaaga

SEQ ID NO: 5871 - DNA, 134 bp, mus musculus
tatttttgttgattaatctattgcttttattacctaaccttatttacaaatgggatgccttaatttttttccttctcataactgaaaaccaaaatatttcagtaacattttcttaaacgtatctgttatttttc

SEQ ID NO: 5872 - DNA, 304 bp, mus musculus
taattactatttttatttatttctgagtgttttactaccctaaaacttagtgatataaaacaacaatcattcacttgctcaggataccagtgattggcaacacaggaagtgctcagagggcatggctcatctctgctccttatacggtgtcagctggactcattcatgctgttgtgggtcatttggcaggtcatctggttggtcctggatgactttcattgctggcaactggctgacactgtcagccagggtatgtcaataccatccacattctatctccagcaggctactatggactttttta

SEQ ID NO: 5873 - DNA, 767 bp, mus musculus
aatccaatgaatggactataataaagaatgagagttttttcagagttcctttttgcctgctctagaattaatgaggtacctatacaaacctagtaaattattaatttatgaaagtgaagctataataattatactaaactacagtatccagaagatactactagaaaagatttaggctatccaggatatgtttcttttattctagagttgatgacaaagtaatgagagtaaagagacaatgacagcaatctcagaggaaagctgttttcaatggaaacataacatctgggatggggttaataaaagaaaatggttgatctctttgattccagtaaaatgactcctctgctgagcaaaaatttaaggggaaaaaacaccaaagagttgacctctctaccagagtgattctctggacagaaatcaagaatgcttctatgttctcaacagcactcatcatcttgctggccttcagtcagtgttaataattataacatgtctgtccctactgtgacctctgagagaacttgtcttccatgtcccttctcctgagaagaccatcgttttctctctgctccagggccagcccacttccttagacagggatgatcttcatccaaatccagaccattcctactggcagctcttgtctggatccaactggtctcagctggaggtccagatggctcattcctcattccccagcagggtttcagcagcatccaccccttcctgatctctctgccattagtgccatcaggcttaatgtt

SEQ ID NO: 5874 - DNA, 5546 bp, mus musculus
gcccctctgcaactgattctgcttatgctatagtgatgagatctctgacactcacctttgttacaggtgagtagtgacagatacttcggcagaataagtacctcttagtaaaccctgatcagttgtggaaacattgtgttggcttacgagatgcatgagaatctatgttggcagatgcttgtaggatgcagggcttaatttttactttaaaagatggacagaaaggagtcgacttctacatttacacctgagaattggattgaatatacagaaataaaatctatgaggaaagtttaccactgaactctctggggttgtatgtgtgactaaacaggaaggaaggaaaatatccaaaggctatatttgacaatgtcaccaatttgcaataaaactttttcatgataaatgtccaaaggaaaataaagctttttaaaaattatatgccacactactttttaaactagaaatgaatatttctaaacatcttatcactaggcatttttttttacttacatgggatggctcaactggcaaaattatagattttttaaagatctgtggatctcactgactgtaattctctaaacaaaacatgtaattatctaaataaaacatgtccagctagctccacttgaatgccgtattagttacctttaatgaaagaaccacaaactttccacatttatggttgtctgaaataacaaccttagagacaggtatttaactttgatgttactgatttttcttgtgctcaccaaaacgaaggaggagacaatcacatcactagttattccattttcttttccaaggcacatgaattgtatgataaatacagtagtctctaccacctaaagattagatttagaacattgcctttgttgtttaaattataattctgttttcttttctgtttctagatattaaaactcctgaactaaaatcagaatactttattgtatttcagaatacaatgttatgtatattgtttttctaataatacataatactggagaaagtttgttaatctttagattgggttcaatatattatttatattttgtgaatgttattttcttacctaagtctaatatttctggaataagatcagcaaatttatgttctaataaaacttcatgtaatatactgtggataaacataacacatgaagttccttatcaaggttttctatatcattatcctttgtgtgtgtgtccaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttaggtaaggagcatcacatactgaggtatttcacatcaccagatttgtgactgaaacaaatgtctctctgaattccatatgctttatgtgaaaactgaagcatttttttccctctttcctctctgcagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtaagcgcctgtttcttgtagaagagtaaacttgatgctcaactttttcttccatagaaaataacgaataaccaaacagcaggtaagaaaatttgagctcctagcttgaaaatattctctcaaactgagaaatgcattacaacgctagaatctgtcttttagtagaacagccataaaaatagattttgttaacttagtgatctataggcccttactttgagattaattcttgatatgaaatatcaagagttttatgtagttttaacaatccttgttcagtagatagcccagaatgacagctattttcttcctgattttatttcttgtagtagttattactttgttaccttgagtaagagacaagtaattcttcccgtctcatcatccaaaagcaatatattaattaattctccaaatatttattgaatgctatttataagtttgaagctggtgatgcaaagatgaaaagctaaggtccacatctttatattgttttgggcaggataatctggtgtttaggagcaaagcctctcacataacatggctttttgttcaccagctatatgaacttgaacagtatttaatatctctgtctcatggtttctttgtctgttaaatgaggataataggatctacctaataggattattgggttaattaaataaaattacatatatatgaaaacatgttgtacatataattgtattaatatacctactacataattgacactcagcaaatgttagccactagatttccttatattaataaatgttggttattatatatatcgtattaataaaaattagctattgtgataattattacaactaatattaaatataatcatattaattattcctcataatatctttcatgtttgttcttttcttttttgcatcagctttattgacatctaatttatataccatacatttcacccatttaaagcatgcaattcaatgcttgtgtgaccattgctacaatcaattttagagcatatttatcacccccaaaaggaaaccatgtattcgttagctgtgttttccatgatcaatctcccatcaagtctagcctcttacttcatacgtcttatctatagatcagtccatttatcttcagtattacctgatcttcccttctgtagtaccaacattcaacccaaattctaaatcttttttcccttttatctccttaggagcttttcttcattctcctctctcttttgtttagtttttttgttccttaaattattttcctaaagctgctcataaaacacgcctatttttcttctgtatccaaaaacttggtgttatgacttcctcaaacattaactcttggcttctactcatatccaagaatttttttaaaagaggagcctacacttactgtctcttctatatcacctcacatctattccttaactcatttgtgtctccctgcgcagaaaatgctctgacaaaaagcatctcccaagtgccaaataaaatataaatgtttcattctttgttcacttaattagcttctttgtaatatttattataattattaattttaaatatctaataatatataattttatataatatttactaattttaaatattttattagctttttaataatacattttatgatcctgtaccccatgcatgtgggcctctttgggctcttcaaaagtgttaagtgcttctattcctctgttcccttttacatgcaatttcttttttttttttttttaatctttgttttttgagacagagtctcgctctgtcgcccaggctggagtgcagtggtgcaatctcggctcactgcaagctccacctcccaggttcatgccatcctcctgcctcagcctcccgagtagctgggactacaggcgcccaccaccacgcctggctaatttttttgtatttttttgtagagacggggtttcaccgtgttagccaggatggtctcgatctcctaatctggtgatccgcccgcctgggcctcccaaagtgctggaattccaggcgtgagccaccgtgcccggccttacatgcaatttccacctctccataaggcacttctttccctatactttcttcttccattgcatttgatcaattcctgttgaagttttaaaacttagtttgacattgatcctctgggatgatattctcttgccttgaattttggttagctattcctcctctgtgctcacagaatgcttcatgcatgcctctgtcagagcacctccatagccctgtaattgactgcttggcactgttttcattcacaatgcttctgacacaatgctcctttctgatgcgttttcctcgtattctcacttggttcttttcttaactttcagtcaactttttcgttttcttaagtagatttatttcttctattcatctcatgaatggacacatttctatgtattccatctttgtccatcttcttattctacctttgtacttgagtaacctcatccatacctgtggcttcaaccactgtctaatttttgactctcgagtctatagttctgctcagatttctctccttggctacacagtgaccaaaaccaacttccaactggacagcttctcctgcatgcatcaagggcacctctacttacatatttttgaaaccattctgctctactccttcatgagccctatatctgtattttatatcttgataaatgactcaagctagaaactttagaatattctacaacatttctctttcttattccccatattcaatgccagtcatgatgttttgttgattttaccttaatttttttcttacatctgagtctttttctttctccctactgtcttagttggtcaaatagtatctcaggatactacttgtatctgatttgtatccaaatcagtaatcaggattattgcaatgtccttgtaacaactcttcctggacccagcttaacttcctccaatttatctcctctactgtttctggagggaactttctaaaatgccactcttctacttacataaccccagtggcctctcttatagttcgtattgagctaaacactttgacaaatcacaacctgccttgcgcttcactattctccatcctgtaccccatgcatgtgggcctctttgggctcttcaaaagtgttaagtgcttgtattcctctgttcccttttacatgcaatttctacctctccataaggtacttctttccctgcactctcttcttccattgcatttgatcagttcctgttgaagttttaagacttcgtttgacattgatcctctgggatgattttctcttgccatgaagtttggttagctattcctcctctgtgctcacagaatgcttcatgcatgcctctgtcatagcacctccacagccctgtaattgagtgcttggcactgttttcattcacaatgcttctgacaccaaatgtgtgtgagtttttttccctacaccaactaattctccaactctctggacaccacctaggtgtcctacaattcaattcagacactaactacctggagttagcacagaccccacaggttaaaggcttagtctcataagaccttcctcacttcagacaccagtcacaagtcccagattgccacctgaacttctaatcaactggctataaatt

SEQ ID NO: 5875 - DNA, 708 bp, mus musculus
aatattatttctgataaatatgatgcttgacttttttgttaaatactttaggtgatactcattaaagaaggaactcattatagaaagaatgtaatggggaaactaaatggttaaatgttggaaaagtcatttcaaacatggaaataataaaaaacttattccacaaacatttcattatttcaatgtaggcaaatgagtgtacaatgatgtatttattttgtgatttagaatcaaggtaattttggcaagtatgggtctgctcagtagagttctgggtcatttttctctcataaaccacactcataataaattatctattcattttctgttttggacttttttgaatgcagtgaaaatctaaagacctttgtaaaataatatgaatgcagtgtttttatctattgttagttgttttcattcttttactgttgtcttgcccacattcaatacaagagtactttttaagctacttgcctttaatgaatgctttcaaactactgactatagtttaaataaaaaccttttcttccacacatatatttcaacagtccacacaatagtaaattaaattacttaattataattaatagtacaactgttagagatttcatagtaaacacaaccagatcatagtaagtatacatcttcactgtggaagaagtagctggccatacaggattagccaatatcatttagctggccatacag

SEQ ID NO: 5876 - DNA, 541 bp, mus musculus
attaagttaatctttaaaaatagtggtttcagggtaaatgttgcttaaaattaactcccctaatgaataaaaggcagaaatatagaaatgtcccttttttaatattcccattattaaaaaaaggaaagtcaaagcattttttgtactatttgcctcgtgatccaacaggtctaccaaaaaaaaaaaaaaaaaaaaaaaaaatgaacaaacactgaaaacttgccgactcagctttcagtctttgtaaagatactaattttcactttgagagaaggtatatttaaaaggaacttactttctcagcttttatttttaaatgtgagtatttttgtacttgtgaatttgcacatcttctgaaaatgatttaaaacttgcaaatgtactttgatagtattattttgaaaatgtgtttatcttcttttttctgtcctttctgtcacctgttgggtattcttgcatttctctaaaaatgtctttactgcattaaagaaaggacattggttgaatcctactctttgattaagatgggatgtatagatgg

SEQ ID NO: 5877 - DNA, 332 bp, mus musculus
tttcatggcttgatagctcatttctttttaacattgaataatattcctttgtatgtaccacagttgatttctccattcaccaactgaacatcttggttacttctaagttttggcaattatgaatgaagctgctataaacatctgtaggctggtttttgtgtggatatgcttattattcctttgggtacatagcaaggagcataattgatggatagtatgtaagattacatttagttttgtaagaaaataccaaactgtcttccaaaatggctatatcatttagcattcccactaacagtaaataaaagttcctattgcttcacatccttgcc

SEQ ID NO: 5878 - DNA, 682 bp, mus musculus
catttcaaatgatttcatgttagtagagattgagaagttgacatgactgttagtcttgttccaagctccacctcacagctcactggttgggtggcattaccagcctgagggctgaagaagcaaggcagagcagcttctgcatcatctctgcagcttatgaagatgttttgccaacacagtggtactgaaaagacaacagcagcagacacacccagacagttggtgcttggtctggatttcatattgctttgtaaaatgtgttttatatattggtgacatcctacaattcccctgatctttgagaaaattagtctgttatcatgaattgatgtagttagaaattcagcactaaaattccttgtgctttttaggggaaaacacctgtggtgctcaccaatatttatcccatcaggaagttaggaggccctgacccggaaaagacctttcgaatgtagattggagactgcttcttagctagggttattaaaagtccacacacatatttattaaaatccacatactcattaaaataaataaataaaatttaaaagtccacatactctctggataaagtcttggaaacacacaattggactaggggagatggtctccgataatggttaatctctcctatatctcctgagcatggacctgttcccactacttaactttgtataaaggt

SEQ ID NO: 5879 - DNA, 463 bp, mus musculus
ttctttcaatatcctccgattgctgggatagatgttcagaagaaaaatagaacacttcatactgcttcaagttttgaagtatgtaattaactcaaaacattcacacattttccaaattatttatggtgatacgttaaccttctctatctgtcttcccagagtaaacactcaaagtcctcatctttaaattctctttctcctactggccactttagaaggctatctaagttgccttttacaaagagtaatctggatgatgcattggctaaactgcatttaaaattgaaatataaaagtcaacagtagttggtataatttaaatattgaaacatgcatttttattagctataaaaatgtgtcctaaaatatctgggttagtttctctgtgctgtgctgtggcactgaatgccccctgttcagtccacaagaatacatggtggtcttgaacagaacaggctgaatg

SEQ ID NO: 5880 - DNA, 186 bp, mus musculus
tgcacatctcatggcagctaagccacatggctgggatttaaagcctttagagccagcccatggctttagctacctcactatgctgcttcacaaaccttgctcctgtgtaaaactatattctcagtgtagggcagagaggtctaacaccaacataaggtactagcagtgtttcccgtattgacagga

SEQ ID NO: 5881 - DNA, 1232 bp, mus musculus
aaagaaattaaatatctttgtatatgtgaggatgatggggaaggagtaattctacttactagagagcaaggtaagcaatcaattccttaggctctagaaggctatatattctgaaactgttgaaatacaattctccttggcagatacgaaccattaagccattattggtaacagcaggggttaatcacagatacaagttgagtgcaggtagcaggagagtgatgggagccagatagatgctcctgaagaccgggaagaggctcgcagaagtgaaaaggtgcaaaacacttgctcagttcaccatactgtccagagccatacctaaggtaagcaacgcttcccgcatcctcagactccaggcgtccaaattcgcacgcttgcaggcattctattgattcacacttgagtccttcaacaggtagcgccaattacatcccccagagcacgacccccagcatactggccaataccgctgtcaatcaaatacctcacctacttctctaaattcccccctcccactgtcattggctttaccttcggcctatccacagatttcttctgccctggagaccacagaacttaccctatcgaatctaggattggcgccgaagctactcccgccctttgacgtccccgggcaccccgcccccttcacctcccagctttgccggggaagaagcagggcggggcaagctaggggccggcccgggggcggggcctgcctcccacggcgggagggcggagcctgctctggagcctgactgctcggttaggacctcggagagcgccaggcgccgcgaccagagggcccagagaagcggccggagcccgcctacctcggccccctcagcttcccgggctggcaggcggctagaggcgtctgaggaaggtgcctaagtcctgggtcagatagtcatccctctgggacgccgccgccgctgccgccgtccagctgtggctccctcgcacctgtgtgtgtctgtgtgagtgtgtgtgtgtgtttgagagagagagagacagagagagacagagacagagagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctgaggcggg

SEQ ID NO: 5882 - DNA, 242 bp, mus musculus
cagatctttccaaatagttattatgaaattcagctttattaaagataaaaattattggttcacttaggctaaggtactccatgccaatagttttatattcccttcctttaggacttgctaccagaacccctgagtcagcactaggcttttataggaatgaaatatcagctatgagacagaggaatcaagtatatcacttgccaggtgaagatgaaaatctctttatgaacaaacaaaagtta

SEQ ID NO: 5883 - DNA, 465 bp, mus musculus
cttacgctagtgggaactctgtttataattcttgtcctttcatttatttgggtggtttttcttatcaatttagatgagtgtttttatgtagtatacctttgtaggtgttgacattcattttaaggatatgatactaagtgtacgtgttagaggtgttgacattcatttttatggaatgatattgttaacctttttgttttctagctggtttaggtgaatttcgaattcgtgacctgaatgatgaaattaacaagctgctaagggagaaaggacactgggaggtccggataaaggagctgggaggtcctgattatggagtgagtacatggcagccccagtggcgggtcttgtctagttttccacccacagcagttcccagctcattcttgccatagtagtcgcttgatacaggaaagctatgaacaggatgggtaggatgatgctggaagacctcacagcacatgc

SEQ ID NO: 5884 - DNA, 465 bp, mus musculus; identical to SEQ ID NO: 5883

SEQ ID NO: 5885 - DNA, 1227 bp, mus musculus
agaccaagtgagctccttgagagagctgggtctgtttgagcccatccagagatgaagaaaaaaaaaaaagagagagagagctgggtctaagttgtatttatatacactgtaaacatccacaggagtagggcctcagtgaaaatctgatgggagaatgaatggggaaccttcatgtagactcagtgggagtattatgtgtcaagttcagggaagacacagctgaaatggagatagagattcaggatctgtcaaatccagaggacacagctggggtaggaggtttctgctagtttctgctgaactagaaacagctgctggtcctgaagagctcatcatcccctaggagggacaggcataggaagcagacctctgagaatgctatgtaattccctgcatgccaggtcctggaagcactgacactaggcaggcttagaagagatgtgatctcacagcaggcggctctaggctgaattagtagattggtacttgggattagggcgttttctgttgaagggataccatttgcctttgggcacctcaaggataggtacctggtcaagttgctctatgtccccagagtctagcacagtcctcagtgccgagcaagcacctgtggaaagagttgcaggaagggatgtgtggatgagttcagagcagaggcccgtaggtgtgtagatgggtgcctgatttctacctccatctctccagctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaaggtaaaatcctgggaatgccatctctggcctaattactgttcaagatctttggctactattgaagtgctcatcccttttctctccaaggatccagggccatgtctggagcacatatgtcaaatgccacttcattaaaagcccttcagaacatgggggagtggtggtggcacaaagggcagataagatggcttaacaatattgggatttctcattacagaggctgtgggtaatattgtgaagttcttgggaatgcacccttgtgagaggtcagacaaagtgccggataacaagaacacccacacgttgctcctggctggtaagtggcatttctagatggggagggcctggatagcttacagcctggatgccactggatcctg

SEQ ID NO: 5886 - DNA, 1244 bp, mus musculus
tccactcctttaccaggagttacctcccaaataaactaattgaatgaattcttgtccagggtctgcttttgggagaacccagtctaccataaactttttggctatttcagtaaatgcagtataagttatactgcagtaaactaagtatagcttatacttagccaagtggactatagatgccattctagccaaaaagtaaatcatgaatggaattcttgctttccacagtgcagaacagaattttgtctgtagctaatactgtttcattggtgtcttggtgtcttgtttaacttgtatcttattggtcataactggatcctaaattctcatcgccttttttggaaactgtcatgggacatggagggagatatcagtgaagatttggtgtgactccagaacaatgagggtttagtgtgatcccataattagagaaatagcacaaagaacatattctgctcatgttatgtaaagaggttctggaaagtggttcaaacacatgctcagtgaagataatgctgggccctttattttcctgctgggtgttcctatcccctccacaggttgggtcaccatttatttatcagtgattttctaatccataccgccaggccagacctctcctgagaactccagtcccagatatctaactgcccacaaggcacttgaagatttgtttgcaccacaagtccaacaagtcccaaatggtactcattatcttcccccaaaccctcccctcttcctgcgaatggcacaacccagtggccccatcagaaaactttgaagtagccttgaggatctgtccttctcacttcatcaacagtcccatctaatcagtctccaagtcttacaaatttaatttcctaacaatctctacaaacttctctccattctccttgtcatcactgcatttccaaaacaccgtcatctatttcactcaacaccggcctcctagtgcccctccctgtatctagtcatgcccctcttgtagcattctccacacttcagcctgaaaacatctgctcacacttttctctggttaaaatgctccaatggctttaggtaaaatccaaaatccttatcctggttgaaaatcctcccaccactccaccttaactgtgtcttctgcatcatgccttcttattttgttcccactactcccagtcctctagttctttagggagatcttgctctctctcacctcctgccacttgcattttggaatctcttctacctaaaaccatatt

SEQ ID NO: 5887 - DNA, 1209 bp, mus musculus
gcaattcaagtgttttcgtctcttaagtttcagtagtgggcagcttttgtctcccttctgttttcactcaaagcattttgtctgtaaagaatctcagcttaggactcaaaacaagtctgtgttgaggatttatttctagagttgtgttaaacagttttctgtagctatagataattacttatgaagctgcatcaagtacgtaccttgattactactatctcgtgactaactgcttgttcacagccttccccacccttcccaccagctccccttcactaacctgtgcatcctttgcttgtctggtctcttttacttcttgtttttctcctagtttgtgaatagctcttaaagtctgacttgttgtcatggtgcgttgaaagagtagccagttgtcttttctgggtagatcagctatgagctgactgactaagaggagtagttaaaatggagaaagcttagctgtactttgtcttgcatgttaaacgtaatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttagtataaaattgtctttcctattaggactagctacgtaattagtctgaaatatttttctaactggaaaattagttgctgtgaacttttggatttttattattctagactgcattacacttgtttgctatattcaaatattttttctttggttttacttcctaggttgcacgttttcaaaaaatacctaatggtgaaaatgagacaatgattcctgtattgacatcaaaaaaagcaagtgaattaccagtcagtgaagttgcaagcattctccaagtaagtggttagtggggaggaagggactagatggtgtaaagtcagtcacttagactctataaaacagtgctgtctaatttacttttcttcagtgatagaaatattctgttctgtgccattcagcatagtagccacaagttgaacaggactgttgagcttgacatggggttaaacttgacagaattaaacatgactatatgacttgaaatgtggctagtgtgatggagaaactgactttaatttaatttaaatttatttaa

SEQ ID NO: 5888 - DNA, 1209 bp, mus musculus; identical to SEQ ID NO: 5887

SEQ ID NO: 5889 - DNA, 1209 bp, mus musculus; identical to SEQ ID NO: 5887

SEQ ID NO: 5890 - DNA, 1209 bp, mus musculus; identical to SEQ ID NO: 5887

SEQ ID NO: 5891 - DNA, 1209 bp, mus musculus; identical to SEQ ID NO: 5887

SEQ ID NO: 5892 - DNA, 1209 bp, mus musculus; identical to SEQ ID NO: 5887

SEQ ID NO: 5893 - DNA, 1209 bp, mus musculus; identical to SEQ ID NO: 5887

SEQ ID NO: 5894 - DNA, 1209 bp, mus musculus; identical to SEQ ID NO: 5887

SEQ ID NO: 5895 - DNA, 1209 bp, mus musculus; identical to SEQ ID NO: 5887

SEQ ID NO: 5896 - DNA, 190 bp, mus musculus
agttggttgtatttttgtattaatgagttgtcgcagctgtatgcatatttctttaaacatgtttttgaacacttttattgtttttccagcttaactttcatagaaaatttaagagaagaaaaagaataaaagcatataataaaaatcatccataatccactatttatattcaaccactgttaacatattt

SEQ ID NO: 5897 - DNA, 8340 bp, mus musculus
ggagtcagtgtcctcacatcagatatgaggaacccagacaggggccctctgaggccatccatgttagcgctgctcctcacttacttgctgtccgttccatacaatgctgcgattttcagatacatcaacttcacagagagaccaacatttacttcagtggctgaggttttcacagcagacacatttaagcaggtggcccttctgtactgggtatcatcttgaatgtgaggaaagaaaggtaagttggttcctttatgggttgaattgtgtccttcaataaagacacattgaagtcctaatccccaaaacttcataatgtgacctcatttggaaataggttcattatagagataatcaaattaaaatgaggtcattatcagggccctaatccaatacgactggtgtcctgatcaaaagggggaaatgtgaatacagagacagacaaggacagagggaagacgatgtgaagagagaggcacagggagaatgccatatgaagacgaaggcagagattggagtgatgcatctataagccaaaggttcccagcaaaccaccagaaactaggagagaggcatggaataaactaccccgcacagacttcagaaggaaccaaacctgctgacacttggttttggacttctaatccctcagagtgtgagacaatacatttcttttattttaagccacccagtttttggtactttgttatgatagccctgggaaactaatccagcttctgaaggctcaagagaaggaaggcttagtcatatacagtctagtttgaaggattaaaatgcctcagaggacttccagatagagttggtagattgaatgaaaacacacctatttcaccttgctttttccttgtaagctcatgaataaaagggtttttgaaacttataaattcacaaagacaaagaaagggaatcaaccaagtcaactaaatatcacgggtggaaagcaggtgggcaagtggcaatggccttgactgacttgaaaaagctaaatcctaacctagcaatgggtaaatccaagaagcaactcaactggtaccagaaccctcatgtccatgtaggagactggaagaaatgtctcctaggagtctcatcagactgaaaggaaagacttaaagatgctgacacccagggtcggctgacaaatagcccagccagattacctgactgtgaagatgagagttgatgaactcccactacatactttggacttccaatgacacttttagagtcacaatcttgggagcagatggtctaggatctccatgttatgaagaaatcttcttagatgtaagagagggtgctatggtttgactgtttgttccctccaaaactcatgtgatagtattcacagttggggcctttaagagacagttgtgtcacgagggctctgccttcatgaatgggttaacccattcatgattagtggagtaatggaaatgggttaatggatttatgggttatcatgagaacaggattagtggctttataagaagagaaagagagacctgagctagcacactcagctcccttgctgtgtgaagccctacactgcctcaggactctgtggagtatccttatcagcaagaagttcctgaccagatgtagaagaaaagaccttggacttggcctccagaactgtaagaaataaatgccttttttttttttgagatggagtctccctctgtcccccaggctggagtgcagtggcgtgatcttggctcactgcaacctcttgggttcaagtgattctcctacctcagcttcccaagtagttgggattacaggtgcctgccaccacacccagctaatttttgtatttttagtgaggatggggtttcactatatttgccaggctagtctcgaactcctggcctcaagtgatccgcctgcctcagcctcccaaaatgctgggattacaggtgtgagccattgtgcctggcctaaatgccttttctttataaattactcagtctcaggtattctgttacaagcaacagaaaattggccaagacagagagactaaaacagatacaaatattttgaaataaataattctgtaccaagaaaaagtatgaaaaacaactatcaataatattctcagagagataaaagaagatattgcagtccaggtatgtggcttatgcctgtaatcccaacacttcgggagggtgaggcaggaatttcacttaaggccaggagtttgagaccaactggggcaatatagtgagatcttgtctctacaaaaaatacaaaaattagttgggcttgttggtgtgcccttgcagtctcagctatctgggtggctgaggtgggaggatcacctgagcccaggagttggaggctgcagtgaggtgtgatcatgccaccacactccagcctgggtgacagagtaagaccttgcctcaaaaaaaaaaaaaaaaaaaaaaaaaaaaaaaatgtcagccatgaaacaaacaaacaacaaaaaacggattgctattaaacaaagaactgttgggatttaaaaacatgtgagataaaagtaaacattcaatagaagggttagaagaaaaatttgatgaaatctttcaaatggtagaagaaaaattctagtaatagaaaattgaagtgacaatataagaaagttataggaccagtataggaggtccaatatccaaataataaaagtcaaaggaacagagtatagagatagcaaagaagaatacattattaaataaataagagaatttttcagaattaaaaacttgattatacagattgagaggtcccactgagtgtcaaacacaatgagagaaaatcagccaactctaagacgcattataaaattttagaacactgggaatgaggaaagatgccaaaagcctttagagagaaaaagcaggttatgttgtgagggtcaggaatcaaatagtattggaaatctcaacagtgacactggaagttactgtaggatataaaataaaacatcaaaatattgagatgagatgactttgatgcccacttgtatcagtcagcgttctccagagaaaccaatatgatatgtccagtgggatatacagtcagccctccgtatctgtggttctatatctgcagattccaccaaccctggatcaaaaatgtttaaaaaagtccccaaaaccaaaaaaacccctcacaacaatgaaaagatacaaattaaaaataatacagtataacagctgtttatattgcattaggcattatatgtagtctagagatgatttaaagtacagtcatgcattgcttaaagcttgggatatgttctgagaagtgtataactaggcccttttgttgttatgtgaacattacagaatgtacttccacaaacctagatggtatagtttactactaggctctatggtacagcctattgctcctaagctacaaacctgtacagtatgttatgtactgaatactgtaaataattataacacaatggtatttgtgtatcttttttttttctgaaatggagtttcgctcttgttgcccaggctggagtgcagtggcatgatctcggctcactgcaaccttcgcctcccaggttcaagggattctcctgtctcagcctcctgagtagctgggattacaggtgcctggaaccacactcagttaatttgttgacagtgtttgtgtatccaaacatagaaaaggtatagtaagggcatggtattataatcttttgtgtaagtggtccattgttgaccaaaatgtcattatgtggtggtgtgcttaggttatatgcaaatatcatgccattttatataagggacttaaacattctcagattttggtatcccaggaggtcctggaaccaatctcgcatggatactgagggacgactgtgtatgtaacattatatatgtaaaatatatacaaatagatttatttcaagtaattggctcgtgatcatgggggcaggcaagtctaaaatctgtagggtggctgtagacgcaggcaggaattattgttgtagtcttgaggaagaatttcttctttttcaggaaacatcagtttttgctttccaagcctttcagtggatttgatgaagtccactcacattatcgaagataatcttaatctcttttgcttaaagtcaactgatcgtagatgttaagcacatttacaaaataccttcagagcaacatctagatttgagtttgattaagtaagtgggtactatagcttagccaagctgacacataagactaatcatcacaaaaactgaactatcaattaagtgtgctagtagaataagatgttttcaaggatagaaagcctaaacaattttatatgccatacaccctttctcaggaagctattggaggacatgttccaacaaaccaggaaattaaactgagcaaaaggaagatatgtgtctcagatggactccctcgaagactttgagacattgattcttgtgcaagtgatttattaaagagacctataaaggagtggaggaagcaggacaaaagagagaggaagccaatcaagttgtgattccaggcagcgtttcatggagggtgacttctatctgatcctggagaattctgtggtataaatgacttcagagttgtcccaacctgaggcaagggagctggctggcatattcccaaactagtataagaatcaattatactagtcaatgctctggagggtgggggctgggggataaaaattcctaggcacttggttctctggctttagacaaagcacttccagtagccaagggcagtcttctgaagaaggtccgtaggtgctggctgttggaagcaaaagcacactgaagccaggaagtgtgcgtgtgtgtgtgtgtgtatgtgtgtgtgtgcgtgtgtgcactaaaagtggtgaaatggggtataatactacaaactgggatacaggaaacagaagatccaaaacaggaaacaaagctatccctaggataatggtgaagggaagcctaaaaacaacagctgtgcaaacagttcagattgccatagtggatcagaagaccaggagataattattcaagaaggcaaaaatgattagatgctgaatgagtttgaacgtagtaagaagatgtttacatatatggggaagactttgaggttgaattcatgataaggatatagaaaacttaacaaacgaaagaccaagacaagcgtaaactcaagggaaaacaaactgtattataaagtaatgtaatcatagctcacaagcctcacaagtaagttgtgaatagcatttacatcatcataataatgtaaacactgaatgttttgaatttaactaaaattatgaatcaactccattgggaggatcaggataggaagtaggtgtgtgtggtgtgattgcaaagaatggtgaaaaagtcgcatttttcatattgggaagccagtggatggtgcaatgaaaaaaatcgaaaagtagcagtatcagcacattacttatagataggggcaaaaatgtccaaaacatcttctagaagttgaaagttttttcctctggtggtgaaactgggggcggggaggggatggggcagtgtatacaactgctatttttcatgcaagtcttacaaaatgatctgactcttgaaactgtgtgcatgcagaacatttattaaaaataaagaagtaaattaaaaaaggaagcaagtcctgaaggcagagatgacagagatgtcggaaattaggaagaataggaggctgattcagatatattttagctgtattaatttgtgttctcccactcccaagcagggccccagtagataacaatgccagcaaggaggctttgatcttcagactttaggaacaaagaatcttagaatttgaaaagttaaactcatagggtcataaaagtttgcagttttacgtggactgaatctcattatgactcattttctaaaactccactctggctatagcgtgccatgattgcacctgtgaatagtcactgcactgcagtctgggcaacatagtgagaccttgtctctaaaaaagcaaaaataaccctccactcaggtgttacttcctctaagaaaactttactgatccctccctacatccccaagatgcctgggtttcttgctatccagcactcatcagcctatagtagcaggttgtttacttgccttctccctccactgatggccgaacatgtgcttgcaatcacttccaggtaaatgcagtcatttccagaatgaacaccattgttcaggaactcccactctttccctggagcagcatcaatttacctcagcttcgtggagagctcctggtgtctggtcacagcaaaagtccctgctggcatctgagatgtgtaactgtcttcctctggtttggttcctggcatccatcctagtgacctgctgagatgtctgtgccattggtctgtgcctttcttgtcttgaccacagggaccctccttatcttctgttcgtcctaagccacatccttgagccccctggctgtactcctgagcctctataaggccgaggaagactcagggttggctatgccaggctctgtttgctcaaatgtgtcctgctaccattttgctccactacatctgtaccatatttggggctatgaaactcttaggaacctcacttacccggctgggtctttcctgggaatgacaaacatccgttctcctacagatccctgaactaatctgtattagtttctattgctctacaactatgttatcgcaaactagaacaacatatatttattatctcatgatttctgtgaatcagaagtctgactactgcttagctgggttctttgcaaggctgcagtccaggtgttggccaggactgagttctcatctgaggctcaactggggaaaaatctgcttccaagctcacatggttgttagcagcattcagttccttgcaggctgccagactgggagggggtctcagtttcttgctggctgttcattggaggctgctctcagttccttgccacatggtcctctccataggtaatgcacacagcagctggctatttacagccagcaaggaagagtgtctctttgcaagatgggcactataattgtatgtagcataatcacatgcacataatcatgtacatctcttacctttgctgtattctattggttagaaacaagtcatagggtccacctacactcagcagagggaattaggcaaggatgtgaattccaggaggtggcgatcatggcggaataccttaaggtttgctccctgcgaggtctgtctcctggacctaaaactctcacctgagggtgcagattcccacttctgcattaatctctgactctccctgaacatctttgtttcctcctggcctgtggagtcttgggtggcaaaattaactttctcttttctcaggcatgtcttctaaattctattgtttgtagaagcctggctttttgtactcagaaacgaggattttgagatttttatgctatgttctctgccagaaatttcaaaacctaaaagccagaaactcatttttgttctttattttttatgcctttcctttccaattcagtaagcccagactgccctagctattgcctgagaagtggggaaaggtcatgggcaaaagtgaatgactgagaataatatcactatgccctgaataatacacaggatctgctggaatgaacacagacgcaacaccagagatctgggtacaaatcttggctctaccacttactagctttgtgatcatgggcaagtcattaattttctatgagcctcagtttcctcacctgtgaaatagtgataatcatacctactcttataatgctgaaagaatgttcgtaaagtcggtaagattcttttgtaaattataaagtgtcatatatgtacgtattactattatagttgttggattctctgatgggtggttaaaattgacacaagtatgcaagagaccccctaacagtgattgtagatcaaactcaattatgaaaaggcttctttgtagttctggagttggcagagaggctaatgcctttgatagaggtgaaatgtgtgatagcagatgctgactacacacttgtcactatgtcttgggcaagctctagtttgacttgagattttaccaaatcagcatcattataccagatggtaatattatgtgtgtggatgcctcaggtaaattatagagatggagtgaatgaacagtcagattcctaaacccagacctatccactcctgggagtgttattccaaatgctgtttggatacagtttatttattctctgcacaatgttctttccatcacatccatcacgttcctcatcccaggctctgtgcaggagaga

SEQ ID NO: 5898 - DNA, 2978 bp, mus musculus
ttgttctgttctctacagttataagcatattgttggccttgcctatagctacttaatgatttattctcttacatccataactggcaataattaggaaaaaaaattgctgtgaagtcgaacccactatcctgtaaacataaatttggcctccctaggtttttagtaataaatgcaaaataaaatctgtacagcacattttaaagtttgccattagtttacaaagcactaataagtacagggtatgtcagtaggtggtcctaaaataaattcatcagtaaatcgccaggtgcagtggctcacacctgtaatcctagcattttgggaggcttgggcaggtggatcacctgagatcaggagttcgagatcagcctgaccaacatggtgaaaccccgtctctactaaaaaatacaaaaaaattagccaggcatggttgcaggcgcctgtagtcccagctactcgggaggctgaggcaggagaatggcgtgaacccgggaagtggagcttgcagtgagccgagattgcgccactgcagtccgcagtccggcctgggcgacagagcgagactccgtctcaaaaaaaaaaaaaaaaagaaactatctcaaaaaaataaaaataaattcatcaatgaatcaatgtgaactttctaatctttaatggcagtgtgtgaaaaatgagaggtgctcattgtatgtttctggacatcttgctgtgtatttaaggaaagactaagatagtgcatgttcaggaagtcttttaaactctgcaaagaatcagaaacacatttatgtagggtcttcagattttacttttgagacctagccttcttatcacctcctattttcgctaaattttaaaatacttactgtcagcagacaggaatgtcagtgattctgacttgtatgtttttcaattctgatttggcatttgttttgcagtaccatctgtcctgttggcttctgggtaaagagacggtattacatgaaaaaaaacaaagctcctattatcctctagaaattggagagcagctgccttcactgaacagtagtgctatgatccctgggactgttgagatagaaattaaaggtattgcaaataagagcagttttacagaaatagccccctgccccaccacttgtcattttgttgaaaaaaaaaaaaaaaactgttttgaccacattccctaatttcagaggaatgaagagttacattttctagcatattcataatgtaggtattagaggaaggaggaatgatgaaacagtgtaaggctttatattaaaaataaaaagttgtggtccaatggggagttttcaacctataagatctattaatattgggaggtctttaccacctggaaagtaattatcgaacacatgcttcttttgccttaggggtgtttttaagaatttcttaggctttcagaaagctaatggtgattgatgggataagggagactaaggaaaaggaaagagtcatgatgatcattatgataaagcatgattcacaggatttatgcctttttggccaggtggtatcatcttctgagacggtgagaattaggagaggaatttgttaggggagtaagtaggaaaatgagtttcattttggacatgccaaatttgtagtcagttggaaaaaaaggttgagtacctaaatctggggtcatgatcattattttggcatcatcagtgtattgatctctggttcttagctgtttaaggatgagaatctcaatacctgctttcccaggagaacatgcatatgcctaaatagttgcataatttctagagattgctggattccctgaaacccagaagtcactccagaattaacttcttcacctgtcccagtgtgagtcaagaaaatgtagcaaaagccaggcacggtgattcacgcctgtaatcccagcactttgggagactgaggcaggtggatcatctgaggtcaggagtctgagaccagcctaacatggtgaaaccccgtttctactaaaaataaaaaaaaattagccaggtgtggtggcgcacacctgtaatcccagctacttgggaggctgaggcaggagaattgcttgaacccgggaggcagaggttgcagtgagctgagatcgcacccttgcactccagcttgggcaacaagagtgaaactccgtctcaaaaaaaatttttttttaagtcatttaaaatcattttggaatggtaaagattgtagcaataaggtattaaaactcatgtgagctattatgtgtgggaattgtttctgaagagctacaattttttacccagagtatgccagtaatctcctagaaggtgtactttgttcacagaaagggcattgtgtagcaggcctgggatgcaaagctaggttatctggagatccaaacaaactacaaagtaaggtgattgtgggtctggacacaggcaaagtggaatagacagattcgaagtggcctgcgatattgccgtgattgtcacaggccacaatgtgggtgacaggtcaggtctgacagatcttgagtggtactgtaataggaaagtgaatgcaccagctgctgcaaatgatgggctgagtctgaggcaagcaccatggatagctccaaggcagggctattactgcctgtaagaatctgaagcaaataaagcccttttttatcaggaaggcgcctggcctgtctgaacaatactacttcgaaggtgtgccatgaaagatggtacccaggatctctaagtaattacatgacagcaattttgaataataatttcaactattcttatgggccaggacaacacctcacccatatctgaatagcctcactttgttatgtgaggattgagaagttggcatttaaatacatcctagtggacttcttgggtcatcttatcaccttgggaggcatataaatgaacctcaaccaatccagaggatatctcagtctttgtgaaactcctgatcatttttgtaaccttgcatgtgctttc

SEQ ID NO: 5899 - DNA, 2978 bp, mus musculus; identical to SEQ ID NO: 5898

SEQ ID NO: 5900 - DNA, 1504 bp, mus musculus
tctaatattgctattaagcctatttgagggttttcatagccatagcagaattagactttctggaagatttaggtgattcctttttccagaagtcttaaagactgtctagagagaggcagagatacatgcttctgtttctctgaatctcagggaagccttctgaacagatttagcagtccagacaagggtgggtgtgccaccttgtgtttaaacacaaccacgagtagcagaaaatagctggggtttatgttgcagttgtggctttaagagcagccagcacaaagctctggcctaaacaccagttaactcccattgcccaaggccactgaactgaatgtttggattgtccccctgtatttgtgcctgcccaggagccagctcagatgagtaatagcttctgctgaagaggaagcggctgaatacatcagagcatctgggcaggacttcttgaagcccgactgccagcggagactggccttgatgaggagaaggcatccctgagggccagctcagctcctgagagctacagagcccctcagcagagggatggcctgaggcctgccttccagacaacattgtcagcagtaaagttggccatgtagtgccaactacgtggtttccacaagtgtttcttcatgaatcttcacaacattctgaggaaagtcctagttccctaatgtgaatgaggaaaacaggcggggggagcccggcaggggttgaagtcactttttcaaaggaagagtcacagctgagtctaactcaagttcacatgataccagtgaactgaagagcacttatagctgggcatggtggctcatgcctgtcatcccagcacattaagcccaagaatttgagatgagcctgggcaacatagggagaccctatctctacaaaaaattaaaagtaaaaaaattagctgggagtggtggcacatgcctgtggtcccaggtccttgggagcctgaggtgggaggattgcttaagcccacgggggttgaggctgcattgagccgtgattgtgccactgcactccacctggatgacagagtaagaccctgtcattaaaaaaaaaaaaaaaaaaaaaaaaaaaacaaccactatatgagataccatgggaaaatttacaccatttcattaatcttcacaatagtcctaccagatagtatatttgctggcaaatatcgatgaataatataatagggttaaagcagttctacatttaaatctaaatggttaggggaatattccaactctgcctctaaccatctgtggcttgctattctcaagaaaacttataatgtaaaatgtatctttgcagcagttacattacattcaaccactagggggcagcatcaacacaatttttccagtcttccatctgtaaaggaagcagggtagtttgagggtgttttaataggttgagcagctgtgcaggtttgcctggcactgagtagtttcccaggatgtggggctttcagtgcttaaaaaacaggaaagtcccaggc

SEQ ID NO: 5901 - DNA, 2020 bp, mus musculus
tgattcataccccagggaagagttgatgctatcaatttaaagtgtttaatatacatttatttaaatgtgaagttgcactttgcctgaggaatgagtatttaaattgacagcctaataaaattcctaagtaatgtagtcttcccccccatttacttattagtcatattttaaaatcattcatttagagacaccagaaaagcatgtgaactaattgttaagggatataataattgtttagggaattaaatgttaattctatggctatcttctttttcatcataaatatagagctttgatcttcagtcttcttaagagcaaataaatttctggatcaacagttctacataatgttaataatatatataatttatttaaaatattctggctcttcctgttcagggaaccattcgtttggatcaaagactccaatgaaaccaatgaataaaaacagccagaatattttagctaagtaatgtttctaagatttaatagataaaaactaatcctcttttccagaagctttttagttaaaatttcacacattattatgccttattcttttctcataatttgtggtccttgaaaattttaattattgtagacattatagaattgaattacttttcatgcaatcaaattagttacattaattatttgctagagctataaatatggaaatctggtaaagaaaatcattttagcttttccaggtaaataattaaaaattcattttccttatgttctgaacaaaatgataattgtcctaataagtacgtagaaattttaaataattcattaataacatgtgtcgcttgtaagccttattttgccttcaccaagagttacctattagtcaaccacaatctactaaagtgtctgaagtatccacaggctgtatgtggtaggtttctactctatttgtaacatatcagcctgaagtctagtggagttgccattgtggaagggttccaaccagtcatggtgctcttcacattttccatcgatttggcccctttctggccagaaacttagaccacacatacacacagtgttacacagagggtgtaatgctaaactttcaggggttgctatatggtaaccccatcaagtgatttcagcatttagaaggatttgctttggcctcacagtgttctttaaatttctcgatttgcttccctctaagtaggcatgctctctctagttagttcatcacaagcctaccatctcctgtggtcttttatttggcccaattcacacagtgtcataagcaagtagattttcaatttcttatccttgctttggcctgacaaggacctcacaaaaagattggattatcctgatttagaaaaaagccccattgtttttattccattcttactagtcacttgctttatattttaaaataatcccctgcttcttcctaaccctgagggttgacaccaaatgaaaataactctattgttattaatctgtagtatacttacaacaacctgctcaaaagtgtaaagcataatgactagaataaaccaaaaaagatacttacatgtggaaatatcactaccgcataagaatacaaaaatgaaactttaagagaggtgttatatgtccattatttatcaagcagaacattaaattgttaataataattaacaacattgttatttatttgttagtaatttaacaatgaacaatttttaataataatcatttaataaccatttgtttctgtgctggaagcagtcaaatattgttctctaaataaggaaactttttcattatgaaacaccataatattgtgtaccaccaaaattacatgatgtagttaataaaataaattcagtaatatcttaaagctatatgtttttaaaatattttgcatacttatagaatcataaggaataactacaaatcattttaacacattaaattaaagatgaaaaaataacatattagcatatgcatgcttgtattatagtaatttaaatattaaccttttcaaatctttgaaagaagtaattta

SEQ ID NO: 5902 - DNA, 159 bp, mus musculus
gttgatctaggccctaggatacaatagcaaacaaagcatgcgatctatattctttaagatttgtgaggagtaggataagggaagccatacatgtacaaagacaatgtcagatagaaaatgctgtgacaaaactgagactaattgagatagagaatacct

SEQ ID NO: 5903 - DNA, 591 bp, mus musculus
gactatttccaatgactacattccaagatagcctatgctgctggatgatagcttaggtgattgcagatccttttcctcagagtctcaaggccagccctaatgaagaggtaaaacccaccacttcagataagccagtggctcaagcctataatcccagcactgtgggaggccgaggcaggtggactgcttgagcccaggagttcgagtccaggctgggcaacatgccaaaactccattctacaaaaatggcaaaagattagccaggcatagtggtgctcgcctgtggtcccagctactcaggagtctgaggtgggaggatcacttgagctggggaggcagatgttgcagtgagccaagatcactccactgcactccatcctggatgactgagtgagaccttgtctcaaacaaacaaacaaaaaaaccataaaacataaaacccaccacttcacaacttctatcccttggatggctatctaaattaacccagaatgacttcttgacctttgtcatcccttagatgacaagcatatgatgggctacagtcttactcatttattccttcattcagtgaataacgaatgtctactc

SEQ ID NO: 5904 - DNA, 1166 bp, mus musculus
aaaaagatatctgaatcaagaaagggcattcacaatgttagaaagcaatgatttttaaaattctcaaatttaaacagaatgctttgtttaagcatgatgtatgtgtttgtgttttcaaatgcaaaaatgttggaagtttttgcatgaagaaatcatttgatttcatgataaatttacccatctgggtgctagaaatgaaaaccttgattgtttactcaactacccaatcagagaaagaaaattttcaaattacagttatatcaacagatacagaagagatcttagctagtaaaaacatccttaagcattattttgctgacgacaacaaaaatatttccagccacatatcaaaccacctacaaattctttggggatcaatttcttcatttctatagcaaagtaacatgtgcatgtctactacaaatcttaaggcaaatagtcctgttcctattcacttgtcattgcaatgaagcatctgccgctcactgtttttttgttattttttttcctgattactccaattcaaaaacatcatcctaccagctcttttagttgttaaatatccctgtgcttgtggctacatttctttgcactggagaaatgatctcattaacaaactagttctgtgcgtccttaacactgaggcccctcgcctgcagctggaggcagctctctgttcagccccagtgcagagtgacacagacaggcgacagcgtcgctgagcaccaacttctattccacggaggcagacagcgaaaaccatttcataaccatggcaaggcatgagagaagcacaggtaatcctgtttctgtattcagtttgtgcaagaatcaaatatattcatctggaagagacaactgggcaaaaaaaggagttggggtgggggaggttctgtgttagaactgctgagccaggaaataaagtcacaaattaggaaatagagtataaacacaaaaagaaaaaagcctctgagatatatatatatatatatatatatatatagatatatagatatatatatgcacatacatatatttgcgcatacatacatttataagatatatataaaaaaaggggatgtgttggtgaaggttttgttacatgggaagtaagctgtaggctaatacgtagaagtaaaaggagtagtttttgtcctgaaatctcc

SEQ ID NO: 5905 - DNA, 3537 bp, mus musculus
caaaggcatccaacaagaggcctactctctttttgttgacaagacaatggagagattcttgtttttaaccacccaacactcattccccttgccaagggcccaagcctaaggcttcaggctactgttggtcattgaaactgtccaggaaaggccatgtgaattgattcgtgctgatgaaacacaaagaggaagttttctggaaccttttgggaaaagaaggtttttttgtcttttgagaatagaatgcgtcttttcctctggatgttaactggggccaatgttgagtatgagtgcaaggcctggagctgccacagccaattggaaaagttacttctagcccaagagtgaggccaatattttgaaggctccagagccagttgagatgaccagcctgagcaccccctccaccctctaggctgtttcatttatttagggcatttttagttgggttttctgttgttagcaaccaatcacatcccaatacagggagagcagcaagcattcaaagacataatagcacctaacagagactttctctttgacatacttaggaggatggaaagagaactggaaaggaagtaatatccttattgattcaaggtcatttaatgccgtgtctttctatcaaatgaaatcattttgtgggcatacctctcctacttaggaaatatttatcttaggctgggagaggtgatggcttcacagaaacaatgctgcagtaggctatgagggacttatgtttgcttcttggtaactttccttaacaagaaactccaaaggcatctttgaaagtgagggctggggatggggggaataaattattcaaacagtgtctgtgcctctggaattaagcacgaagctgtctgagcatatttcatatcctttggaactcaaactatggccaatgaactagtgtccatggcgtcaccttggagcttattgaaatgtagagtctcaggcccctgacctagacctacagaatcagaatctgcttattaacaagatgcccctttaatttgtatgcacattaaattttgagaggcactgttctaggatgcatgtcaccagctgagtgctgcttagaccataaacagctgttgtgtgcagagcttggcctcagagagacctgcttcaacccatgaataccagctgtgtgctcccagcccgagactgtctgctttgtttcccttcagtttcctctacaaatgataggtcatctgcacaaaagaaccagtttccgagaattccttggggtttacttaatactagtatatctcagtccatcgcgaacatcctcatcttgtagttgtagaagtcatagacactgggccagatgaaaacctttgggcttcttttctttgttattaaattttctatatcctatattctatatatataaattcattcattaactcaaacacggattaaacttctttgtgtcccatgtaaaccacatcttttcagatattttatcaaagttattatgatgattaacaattccctgagatcttttatattcagtactttctgggctgccctgaagaaatgttcaatcaggagctctcctgactctatgaagctttagaaattcattttttcttaatattacagttaatagtcatgtaagttacataccactagccagctaatggttaggtgaatgcaagcaaaataaataaataaagacaaaatcagagctccttcccgctagctgggttctctgtgcttcactttgtacttgctcttcaggaacgatctacataggacctcagggactttgaatctaatgttctacatctgtagaatggagatggtggttccaaaggctctgaatatgagggaaagtccccagcacttgcccagcatgcagagatgctcagtgaggtgagtgcctggcagtgacggaagcagggatttacggcatataaaggggagatgaggtcaaatccagtttctcaccaaagggaaacatatccttgactaatgacagcaaagggagaattggagggaagtaaccgaggtttaaatgtggatagtttctgggaaggggcatagggcccactgctctggggaaaaggggctttgtgtcacttgagcccttgggttggagttaggagtgcaagaagtttatggggtgagataagtgtcaggggagggcacctgtgatagataagaggggaaggttgagcagagagagcctacaactgcaatccaaatctgactgtctctgcgcactcctgggaactctggagccaagaaagcctcttagaggagttctgtgttgggcagaaatagcaacacctgaggatccccgctgtgctcaattgttggctgggccctgcctgggaagagtgtggcctcagctcaaaagctgagggagaacctgaagagacacacagctggggcctgtcagctaatgacattcttgcatctgaatagcaagtcactttcttaaagggagaggcaagctatacacctccatggctggcacaacctgagggaatgaaaatccttcagataaatttacaaggatcctacagcagaagacaccattccctagcttcccaggagaagcctggaggggagcaagcattgtggaaagtccgtgcacctgaatgtcagagtagcgatagctgtggagatactgaagcagatgaacctgtggctagcttcacagcatcctacactccctggttgggtcaagggaaacagctgagagctgtgctcccaggagggggaccgcagtgcagctaaggtcagcaggctagagaagcctttaggctgggccaggagaaggcagactgtgtagactggattgcccatgactggcagaaatggatgaaacaggaatggagtgatgcccaagaactggtggaactgggtacaactcagggggggttagcaaggccagcaggtaactttggaccagatttgtacccatctgagggcttcacctgggaaagctacagggaggagcaagattcctaaattgatggagtaattaccaagaacaaacagaattttaaaccagagggactaatttatcttgaactgatgagattaagctttgtgctaatgaggagaaacagggaagtaggagctagttaaattcagttacagaaaggaaagaaatttacaaactgcatttcccagttatgtagcctattaaatttcatctctgttaaacagaaaatgatatctttcgatataatcatttcactttttggaatctagttttataagtggaaaaaaactttgcaaaaagatttatttccataatatttataattgtgaaatgaaataaatgcccagcaagagggtgttagataagttatagtacatccacttaatgacatattagactactaacaatgatattgtcattaaaatgcaatagtatataagcattttttaaattaaattgggggaacaagcagaaagaaatattgtacactgtttctcaaaccttttgaccacaccacacccagggtaaatggttgtttttgcatcttgacccaggacacccatacatatttt

SEQ ID NO: 5906 - DNA, 1059 bp, mus musculus
tcatgagcaactgcatttagggagccagcatttaactggcactgatatttcaagatcctgaccagagggcaataacaagagagatgaagcccagggagagttaaagcattgccatggcagggcagggcacaccggcctgctcttcctgctgacagagtttcccccggcgtggtacaaatgactccccacccatgccaagatccaatccagtgaactgcaacagcaggctggctctgtgtggaccacaaggctgggtgtccaaagtagctgttcagtagtcctggatgttgtcctcccatagcccttctggggagagagcaaatgtttgggcatccaacacaactggggtcaagtccctattccactactcagaagcttttcgtaacaccagaaacctcagtttttccccaccgaaagcagttttataacacaatcagtagggttttcacttaaaggccccagtagaggggcaggcacagagaaaagctccactgtgactattaacacattctcaggtgtgaactaatcaacatgacctcctgtcactacttttttctgggttgctaagaggtataagaaaaaccatttgaaaagaaatggttaagtgatggtcagtaatacaagaaaaatcaggcgtttgcagggaggagagacacagaagaagggaaagatacatttataatcaaagtagaacaattggggatctatagaggttaagtatagccacataagattaaatgataagcggaataatcattgccaaatcaactgactgtaggacccggcaggtaatgctcctgaaagaggtggcccagggatgtcaacgcgtatgctgtgagccagagaactggagagagctcacttccccatcaggaagaggcaactaatagtgctggattgttcatgctggatgctagcaaatcttctcatctttcaaaatgggttccaaatctggattcttatgtgaaatttcctgatgttttcaacattgttcaggccaaataaaactagacctctagtttggaagattagcagttccttcacaagcttgatggagaa

SEQ ID NO: 5907 - DNA, 1059 bp, mus musculus
ttctccatcaagcttgtgaaggaactgctaatcttccaaactagaggtctagttttatttggcctgaacaatgttgaaaacatcaggaaatttcacataagaatccagatttggaacccattttgaaagatgagaagatttgctagcatccagcatgaacaatccagcactattagttgcctcttcctgatggggaagtgagctctctccagttctctggctcacagcatacgcgttgacatccctgggccacctctttcaggagcattacctgccgggtcctacagtcagttgatttggcaatgattattccgcttatcatttaatcttatgtggctatacttaacctctatagatccccaattgttctactttgattataaatgtatctttcccttcttctgtgtctctcctccctgcaaacgcctgatttttcttgtattactgaccatcacttaaccatttcttttcaaatggtttttcttatacctcttagcaacccagaaaaaagtagtgacaggaggtcatgttgattagttcacacctgagaatgtgttaatagtcacagtggagcttttctctgtgcctgcccctctactggggcctttaagtgaaaaccctactgattgtgttataaaactgctttcggtggggaaaaactgaggtttctggtgttacgaaaagcttctgagtagtggaatagggacttgaccccagttgtgttggatgcccaaacatttgctctctccccagaagggctatgggaggacaacatccaggactactgaacagctactttggacacccagccttgtggtccacacagagccagcctgctgttgcagttcactggattggatcttggcatgggtggggagtcatttgtaccacgccgggggaaactctgtcagcaggaagagcaggccggtgtgccctgccctgccatggcaatgctttaactctccctgggcttcatctctcttgttattgccctctggtcaggatcttgaaatatcagtgccagttaaatgctggctccctaaatgcagttgctcatga

SEQ ID NO: 5908 - DNA, 1075 bp, mus musculus
aaggaaatgcataggatagtaaactccagattcagagtagcatttggtaggagtaagtgaggaaagtaattaggtgtacaaagggcttcagccatatttgtaatattttattccagtagtttctcagaggtacaagatcatagagttaggaaaatttttaaaaattagattatagtttaatctttaaaaagaatttcccttttctgtaaatgagtctctttttacatatcaatatacataattcttaacacgtaatatatgttctgattgttgcttcaatagaagttacccagccatgtgttacttagattgatcttctgtttttttccaaatgctcttcaaatgctgctgaatgactttgtaaatagaagaagatggctgaggcaaatctcactcattttagaggtttcttgtgccaaggttgaggacatgcctgggagaaaggaacacagaatcacaggaacatctctgctttttccaaagaggatttgggggcttccgtatttaaaggggaaagagtaggcagtaggggaaagaagaaagaaaaagaaggggaagtagataaaaggagtaagcagtttcattctttagaggctttgatcagcattccctgaatctacattttacatatgaaagaagcaggttaaaggtttagtcaattacggtgttgaatctgcatttttacataagattaagtaaacatagagtagaggaagaagtcaagtatatatttgtctctgataagtggagggatgacttctagttctgtcctgctcccccacaaccccccctcccaccgtaaagataagctgttaattttagggtaaatcttttggaacccacaaggaatttccttgtgagcaaattatgagggagacctcctagggaggtatatagccttctatctttgtagctatctatttaggaaacaaaccaggggatagttttgcatgactcagttcccaacattgacttttacctttgtcatagtgagtttggtgtcccaagatttttagtttcctttcacaacttcataaattgtattgctgattgtggcactgagtctttaaaagaa

SEQ ID NO: 5909 - DNA, 209 bp, mus musculus
aatattaatgataaagtgagaatcctttccttttcctgattttaaaggggatgcttttaatgtttcatcatcaaatttgaagttactataaactttagaaattacctaaaatcagctttttaaaattatcttttaatcctggttttccacaaaaattaatgtaattttttacatgaattaattttaagtgttatttaatggtcttccac

SEQ ID NO: 5910 - DNA, 649 bp, mus musculus
actgacatcaaaatttgaatatataatggttccttgtatctaaaaatagaaaactgagcattgttttaccatatttcaacaactaaaaagtgttctgaaaaccggtttgagaatttaaccttaacagcacagttccataaacataagcctgtgaaattactgaaaagacagtacctgttggtctgtacttattttacttaccttgactaagaagatgaaaatatcttaactctcaagttaaaagatattttaccaaaattatgagagtacacaaataattgaagtcctaaagcttttatttattttcctcacttggttagtttaattcttcatgttttattgcagaataacactgtcaaaggcttaggtttgggggtagttacatatgacaactgcttttacattctgttttggtcaggactatttctaaatctaaacatgaacatattaccggaaatatacttgacctcagagtttaagagcctttaatactactcgttaagatacaattaatcaataaaacctactccaattatttccaaagtcaatattgagaaagctaccccttgaactttaactaaatcaacagaattacctcctaacctaggcaagtcatgatccaactttattacacttaagactatcagtg

SEQ ID NO: 5911 - DNA, 1477 bp, mus musculus
agaaattactgaggaaactctgagggccatatctttaatatgtaaatacatactgctgtctttgataaaggaaggatatagcacctcctataggaaagaaaggatcccttggctcactgatgaaagctgaatttccttaataggaaagaaaggatccattgactgttactgatgacagttggatttccgtattagaatagataagctgaggttgtccagggccaaattgtgtagctctttgatgcctgttgggtaaaaatgtgatttgaaaatggaggaaatttcaggatgaattaattgagaatcttctggttgagaagagctgctttaacagccttaacaggaggaattagtgtctttctctttgctgtatatgatggacagaactcatatactaaagatgggtgattgatctagttcagagaaagaaaaatgtgtaaaacatttaaaaagttggtggtcttcctatttcccatatgttgtcataaatgcttcatgtgtactatattatttaagcttctcaacaaccttgaataagagactacatgtctgttgtagatgaggaaaaagatttaagtgacctacctgaggttgcatagctcataacagaatcagatctaaaattcagctgtgtttaacaactcagctttttaatcatttttagcatgtgcaatattttttctttatgttctttaataaacattaattttctacttactggatgccagttactgtgctatatatgtgtgcgtgtatgtatatatatatatttaagacagggtctcactctgtcacccaggctagagtacagtggtgccatcatggctcactgcagcctcgacctcctgggctcaagtgatccttccaccttagcctcctgagtagctggcactacaggcatgtgccagtacgcctggttaatttttgtattttttgtagagacagggttttgctttgttgcccaggctggtcttgaactcctgggctcaagcaatcctcctacctccacctccccaaattctgtaattatgggagtgagccacaccagccagttatgcttattactgtttttgaagagtaataagatatttcctgtcctcagagagcttatagttgaattatctcacatcttcgttatggtcaaaagttaacaaagtagaaactttggctgccttgggaaagaatattggactatacctctctttccagtggcatttacatgtataaagcaaatacgattaatgccagtttgaaatgcagtgggatagcttgtgtataattatgtgttaagatggtaacatttgactacctggggtgttaatacttatgtcattaaaaatagtttttagataatttaaaaattattacaagataagtaagttattacaaggtaagataagtgtggtagcttttgttattttaaatgactagaattcatttcagtcttcacattgactgttatttttatggtattggt

SEQ ID NO: 5912 - DNA, 1473 bp, mus musculus
atgtaagacacttagcacagaacctgttccaagtaaatgcacatgaggccttaagctttcaatgtaaatctaaagagagtatttaaggcatctgaaatcgggattggagtccagtttatcactgttcaccttcagcttctttcctaaacactcacatacactagattttacaaacttgcctgaaacaacttctccttttttacaatgacattctttaaaatcttatttgctgattctttgctaattatatacctcacacctcatggaaataatgtccaatgagaactacatgtaagtggcagagctaggtgacctttgtcactggaagctttccagtatttctcaggcaggcatatggtttaaaaagcccacaatactgtcaatcaagtaaatgtaaaccaaaagatagagaaggtttttctcagaaactatgcatcagcatttccatattcaaatggtaaaattattcaagatgtttaaaagggtgacatcaaagatgacattttcaacaaaagatatgctaaagaaataaatccagttgtaaacacattctgtcaactgttttctttaatgtgtgcccctccctgagagctctcaaaactagaaagtcctcatatatttgaatttctagtgtttcccttttgccaccaaaatacatatactccttctcacccccattccccaaataaaagcagcctcaaatttacctatcagagtccaggtataccttaaagactgaggaagcctagctaattctctccacatgctgacaaagtttctactgcttgaagctcaggtgagtccccaggaaccccagttttttgaaactgtacacggaatagcagaatgacacttctcccaacacccattctgtgcggtctttgaaaaatataaatccagggtcaagtaactaaaaaaacacagaagacaaatagctaagtaatagcactttataaactactcagaactcctgaataaactgttgtaaaatcctaaagttgttagctataaagcagcaacttaacaacaaaaaaaaagtcaaaggaacaaaaaaagttaacaaacaacttaacagaacaaacaacaacttaacaaaaaaaaagtcaaatcaccatgcttgaagaacagaactgcccttggcctgcacaacatgttctttgttacaaggactactttgttcttccagctctttggatgcgtgtgtagttcctggacctgtgcttgcctcatagccaacatggcccctgctagtaggaaagcagtggcccagcacagtgctctcagggactggggttccagagttcctccttagcctcacgagtcagaacatcaggagacaccatagaacctggaagagtcattccaggggcaactctgtctacacccaacccttctcatctgcatcctggttcctgaaactgttataataagagacaaaatctctcattctgtagataatgttataacttacag

SEQ ID NO: 5913 - DNA, 756 bp, mus musculus
agaagaattttagttctagcctttaatatattttttaccatacaataattgatttaaagagtacttcaaaaataactaaatgttggacgtcatggagagagatgagaccatctgggaagagtatacagagtggaaagaaatgaggccttgaggagcgcccacgacaaggggtggagttggggcatagagaaccccgggagggagacaaggaaacatgaggtaggaggatcagaagggtgcagagccaaattgagggaggtgagggctttgagaaggggtgggagataagtctcaaggaacagggttccgaagaataaaaatggaaacaaagtcattgaggccacgggattcggtacagtggtgctattaggacccagacccaggatccctgttgggattgtcacattcactggaggacttgtgactgcctgaaagaatggggacactccagaaatcctacactaactgtataaaactggcagtgcatggtttgtgtgctgttcagagaacccctgaacattgaagttgacttggctgaacgtgtgctcagctgtccctagcagctcacctagtagccagcctggctttttgccctgctgtttgcccatagcagcctcagatgccagtttctctcactcatctctccccagttgcaggggtttgtagtacagaacctaggtccttgactctgcaatttcctgactctgtgaactcaggcaatcactgcatcttctggactcagtttccttatttgtt

SEQ ID NO: 5914 - DNA, 756 bp, mus musculus; identical to SEQ ID NO: 5913

SEQ ID NO: 5915 - DNA, 1964 bp, mus musculus
taaaatctgtgcattcagtgacagttcttcattagcagccgactgttaatccacagctttctatcaaatgaactggagcttgagtcttcaggctttcactgatacctaccttttccttttctctctccttctctccatccttttctcctcctcgtccttccttcctttcttaaatgtttaccgagttcctatgtgtacaggcagtgggctaggtaccagatagaaaatgatgaatcagaccaagaccctggcctcaaagagctcacattcagaccagtgaacatattaagttttggaggttgtatcagttgtctattgctgtgtaacaaatcacttcaaaatttagcagtttcaagccacatttaatgtctcacagtttctgggcaccaggaatccaggtggcttagctgggtcctctggctcagggaccctcacaaggccatacttaaggtgttggcctgagctgaagtcatctcagggctcagaggtaggaagagccacttccaagctcatgtgactgttgccaggctcctcgctggctattggccagaggcctccctcagttccctgccacatgggcctctctagggagcagttcacaacagggaggctggcttcccgcagggtgagcaagccagagagggcgagcctgaaagcagccagcacttttttgtgtgacctaatctcagaagtgacatctattattcttgcgacattctatttgctaggagttattgggtccagcccatgctcaaagggaaggggttacaaaaatatcttaaacaaattgcactgcagaagctatttgtgtgacacgtgattaatgaatatcaggacatgggggatttgggggcatgttaaaggccccccacagtagaggtattgtcataatgtgtgtgtgtatatatatgtgtgtgtgtgtgtgtgtgtgtgtgtatatatgtgtgtatatatataatatatgtatatatatgtgtgtgtgtatatatatatatatatatatatgtgtatatatatatatgtatatatttttttttggacggagatttctcttagtacccaggctggagtgtaatggcgttggtgtgatctcggctcaccgcaaactctgcctcctgggttcaagcgattctcctacctctgcctcccgagcagctgggattacaggcatgcaccaccatgcccagctaattttgtatttttagtaggatggggtttctccacgttggtcaggctggtctcgaactcccgatctcaagtgatctgcctgcctcggcctcccaaagtgctgggattacaggcatgagccaccgtgcccagcccataatatccttaaagacatttaagcctcaaatcaccgggcccgaacacagcaaattaaaaacatcaattaccctttctttaagatgccataaggaaggtatgtgaggaaacttccataggattagactaaagccccaaataataaagatggttccttattcctgttttcctactttgctaaaaggtacactcagatgctgtctctaatggagaattgggataaacttcaccagtcctgcttaatcaagtgtatctcccctccaaaaaaaaaaaaaaaaaaggaaagaaagaaagagaccagtgccagtgagacaggtaggggatattcaactgtccctatttcgttccagaaaaactaaggcgttacaacttgcaatgtatctggtttgactcaatatgttttgtattcaagtttccaaccagcaaaatttgtgaccttattaagaatactagttcatactcagtacccaagagaaagatttccattccagaatctagtctactagcttggttattattcatttatagtgtcagatcagagaaagattgaaggcattcctaattagttgccttgggatataacacatttgaaataatatcaattgatatttcagtgtctgttaagcctgatttatagggac

SEQ ID NO: 5916 - DNA, 1964 bp, mus musculus; identical to SEQ ID NO: 5915

SEQ ID NO: 5917 - DNA, 1964 bp, mus musculus; identical to SEQ ID NO: 5915

SEQ ID NO: 5918 - DNA, 165 bp, mus musculus
catcttttaggatgtttacttaatctattttttaatattagaagcggctagtagtctttatttaaaaattcattgttaattgttttaactctgtgaggttaaaacaatttaaataagtttaggctctgcctaatttagtaatgaaataaatgttgcataagtaat

SEQ ID NO: 5919 - DNA, 2139 bp, mus musculus
atccctggtggaaaacatctctgaacacaaatagtatatggttcacagatactaatatttatagtgaagtgttagcctatgtgtgaagacttttgaaaatgaaatgtgtctttatatttcttccattgtagcatgcagtccattcagaatcttgggttggccatcatttccatcattgctggtatgatactggattctcgggggtatttgtttttggaagtgttcttcattgcctgtgtttcttgtgagtattccgtatgacaacattttgtttcttttactacataacagaatgttcttatttttacttaggcatagctcccagatttgcctaattctcacctgtgaattagaatttcatagctggtgactttctagccctctgaagattcacaggcattttttaggagattcctatccttaaaggcagtgattgagttggtttcatattctgttttaactatttacagtttaaaaaaaaaaagcattttcccacttaaagtggaacaatttgaagagtcctgagtatatccttaatgtgactatgtggaaacgttggtgtgatttaggtgtgagtactcatggttattcattaggcagttttaactgatttttatttttagtccgtaatttagtttttacctgtaatttcattggtttgaaattggaagcattaggaaacttgaaaaatatataaaaataatagcatttgtccataggtaatctttaccctacatataaattgtgtttatctgaaaagaaaattctccttaacacatcaagatgtcttttatagttcaatattgtgcttaaaatgacaaaccacagtgatgattttatcaaactttgttttcatttatagggaataaagaccatccatacctgaagtgtggtatttgcagataattgcttatgagttgccttgagtgcattttattatctcataaataaacgtgcttgttttagaaacaaggacgtcaagttttaaaaataaatgtttaaaaaagtgggtcatataagaatttcagacattaaatcataaaatgttttttgtctatttttgttgttgcagcatgtggttaaatgtcagtccacagttcaacatgtatttgggtctcaaagcaaacagtgtgccgtttgaatatgtttttctgttattttattttattattattacttttttagagacaggatttgtctctgtcacccagactggaatgcagtggagcagtcacagctcaatgtaactttgaactgcggagttcaggtgatcctcccacctcagcctccgtgatagctaagactacaggtgtgcaccaccatgcttggctggtttttaaatttttttgtgaagatgctgtctcactgtgttgcccaggctggacttgaactcctggcctcaagcgctcctcctgcctttgggattacaggcatgaatcaaaataataagataataggcctgccctattattttaaagtaaattaaacagtgttcttcacttattaaaggaaaaagccaagggaaaacttgaattttgaggtcttgattgatttgagtctaatgatcacattttaatgtttggttacttgaaatttgtaaaatggacatggcattttcagacttaaagcccccaaaagactactatttggcttcctctgaaatgataaacaatcgggggctggcaggagtttttggtaagtcctgcaaaggaccagcactgagaaagggagaggaaagaggggcagggctgggctgtggctgggtcggctcccttttttctaggggcctcaacttctttgtttctggcctgccacccctgggctgagtagcccttggagaaaatagtgtgtaacttatttttagtgcttttggaaaataaaataatgggaataatatttttatttaaaatagcaattaataaaggtttgattgtgtctaagctttgctttgtgattatgattacataggaatcattgagaagaaatacatattttaagggccctatgttttttcactcctagtgtcacttttatctgtggtcttactctatttggtgaatcgtgcccagggtaagtagaagatctgatatttgcttcttaaaccgcagtggatcatcttgtggggtctctgggtctgcc

SEQ ID NO: 5920 - DNA, 404 bp, mus musculus
aatctatagaatttaaggccctggacacatgatgtatttccacatatttccaaaattttttttacaaatatttaagatatagttgttaggcaacttattaatcaaaatagacctctcatatgatactcagaattgcctgaccctttcaccttgactacgaaaggtaggacaggacagatcgagtgtttctcagcctacagaatatcaaaatacatattattttattgtattttaagaggtatcttttccttggatgtcaggcaaatatacttcagtgcagcttttgaacgattaacatattggcagtttaaaattatttaacagggacattttatcattataaatggggaaatgacatttaattgatcttaaaggaaatgattttataattaattaaaatgatc

SEQ ID NO: 5921 - DNA, 404 bp, mus musculus; identical to SEQ ID NO: 5920

SEQ ID NO: 5922 - DNA, 748 bp, mus musculus
agtattaatttaattgaagtgtatgtggttggtgttaattagacactaatttttcattggttttggcatttatttctgttttgtttccatagcaaaaaaagaacatttagcaattcctaaatcaagaaccagttctgaatcaaggatatttaaaacattaaacataagattttgaaaagtaataatgtcttcagcatgaaggaaacaggcacaccaatatagccatagtatgtgtgtaaatcaatacaacttttcaaagggcaataaaacaagatatatttaaaaattttaaatgtatggtctttaatccagtaattgcacttctagaagctgtactaaggaaataagtagggcagacatatggagatatatatacactgtagacattctttaaaacagtgaataatttgaaacatgtttatcaggaatgagtgagttagtaaagttctggaagttcatactttgccatagttatctctatggaggtaggatctcaagaggtcttttgttttctctgtattgcttgaattattttgtacaatattcataaattttcaaaggaaaaatataacagccataaaatatttatgttttgagttaataaaaaattaactacagagagccctgtgccttaaatatggttgtcagcatagcagatgaatctgaccctgtggcaaaaaaataggtgtttttagatatgaatacatactgatagtcaccatatgattttaaagtcacaactgcctta

SEQ ID NO: 5923 - DNA, 748 bp, mus musculus; identical to SEQ ID NO: 5922

SEQ ID NO: 5924 - DNA, 1199 bp, mus musculus
aaatctggttgaaaagttatgtttttaagctggattttgctctcatgctaatcagttttgtgtcatattgctgttttttattaaaattgtcatgtttttctttaatctgtttatggacttacagaggggggctcatttgcttactcttgatgctcttaaagggtaaacaaagctccatgttgaagaattgtagtgcccatggggatattctttacataatacttggttgcaaaatactatctcagtttaaataggaccacagcaaccgctaaaatgtgaaagaacaaccagcaatccacattccatagagagtccaggaaggctgtctctggaaccacagaaggtgcttaaactcagtcaccaaaccaaaattgaaacagatgcagatgtaggtttgccagggtcaattcttgaatcctgagagcttgtcagaaccttccatttacacaagactagagaagaaaacaggaatgactggatttaaaaaagactaaaggccttaacatcatgagcttcttttaatggccagaactgcaaatcacagactgcacatcacaggatgattgccttgcactgtcaatttgtaagttctaatagtacaataaagtttttcagtgttttgtaactctttttaaagggaatttacaaatatttcatgagcataattcctttggaatgtaatactcttagcaaagcagctactgtttaatctttttcaatccttgtgcaaaactttatagatacacgtgaaactcttcggcaggctgtctgagctcttgccctctcagaaaatgtgtagaagtttttctttaaagttgcacttgctgttttattgaaggaaaaacatcatagacccatactttctgaactatttttgaacttttggtcacattggccaaagaccaaaagcttcagggacttttttttttctggaaatgaaagaggcaaattgctagagtatgagaaaaatttaaagacactgaataagcagtaataatgttgtttaggcaatatataaaaaaggaagggagaaaaacctgattcgttttatcctggtatcctaaaatctttattgagaatttaaatttagatgattcctatttatgaagtgtttattgtgtgcctttattgcaagactttgtagatatactgcataacttattttccactaatcattttcatgagtgtacagaatagag

SEQ ID NO: 5925 - DNA, 448 bp, mus musculus
taaaataaattaaaggcgtagatgccttattattgctcctgtagatctaaatgtcctaaggatagatcagggaaaaaaaaatgtcgctaggaaagagatgtaaatcatgctggggtagtcactgcaaggtgtataggcaaacactcatctttttctcagttgtagctgtggtcttagggaaaacacttgaaatttaagagtccaaaataatgtgaaatataaattagagataatctcagtaaacatagaaaaatgttttgagagttcactgtatcttagtggaatggcaacaacaaaaacaatgtcatattagctaagatgagactgatctacctcagacagaatcccagtggcagtgggattacatatttgttttggtgctgcaacttggatagtcccttaatccagcttcacagactctgtaatggggatgacagcaacatatcat

SEQ ID NO: 5926 - DNA, 763 bp, mus musculus
attatacttaattggttttacaagtactaaataatgcctattaagacatcattttgttgatggggtaagttgaaattttaatgtggccttaatcaccttcttcttagaaagtcttcccaaatcctttagccttgttgcggtgacactagataattagtaggaaagaagatggggaggtgtatatcgatatcaattaaccctggcttttggtgaatttagtagttccatagaaaatctagaaaacaagaataaccaatttaaagagcaaaatctttccaaattccagggtattttaaattgaattattaattcatcttataaatagttactgagacttatgttttcttcttagaatttctgtttaatgggaaagtaaagtgttacctaaataaatataactacaaatttttataaatgctagaaaacaaatcttgaagttctctgtgagagttaaatgggtgaattcatacttagagacagagttcagaaaaaggctttccagagtaacttctatttaagctgagatctgaagggagattagccagtagaagggtatggagagcattccagataaagaaaataagcatgcaaagtccctgctgtgggaaagattttggctctggataaattttgggaagactagcaagttaggagcgtggcaagaaaagaggctgaagatagtggcacagtaaaggacatgcaaggatggtaaatagggcattcagtaaaatggaaagccgttggagaattttaagtagaagga

SEQ ID NO: 5927 - DNA, 1084 bp, mus musculus
aggcaacatacttatggtaagtgtaacctctacttggcaaattacatctaaacaaggagaactatacatacttgaaggaagatatagctccctgagtgcagtgggctttgtaactgaaacattccactatggaactagctctggagctatgaggtggggattggctctggtggaaagtaaggtttctaaatcaggtgtattccttatctacctgaactgtacttctgcttgaactcctgcaagaataccaccaaaaaggaacagctgatgctgtcctgctggcaaactgttattcctgtcctcatccttctgaatagactgatgccaagaggatttgatagcagtcttgagattttaaaggtttagttaacacaggcagactctggtgagcatggcatttaagtccttgatgagtcagaatttgaaacatagaatgttgggatagccaaaagacaaatgaaaaacacttgtccaggaatcattgacaaaaagtttttaagaacagcattattgcgatataattcatataccacacaattcattcatttgaagtgcacaattcaatgaattttagtatggttactgctaagtgaaactattagcataattgactttagaacatttttgtcacctcaaaaagaaaccccatacccttttgctccatcctcctcctatctccctatattctcgggaccaatactcctttctctctctctagattagcctattctggacatttcatataaatagaatcatgtcatatgtggccttttatgagtggcttcttttacttgcataacgttttcaatgttcatccatgttgtgccatctatcagcatttcatttatttttaaggttgaataacatttcattgtttgatatagcatattttgtttattcattcatcatttgatggatattcgggttgtttccaccttttggctattataagtaatgctgccatgaacatttgtgtacaagttttttgtggccatatgtttttagttatcttggctagatacctactggtggaattgctgggtcatatggtaactccatttttaattgtttgaggaactgcaag

SEQ ID NO: 5928 - DNA, 1084 bp, mus musculus; identical to SEQ ID NO: 5927

SEQ ID NO: 5929 - DNA, 846 bp, mus musculus
attgccatggatcaacaaattagaagaagatagctgagaagataaagtatttggtagctgtaaagcttcaagcaggaactcaagaagatttttagaacatctggtcgaaatttatttctttataggtaagcatccccttttacaaccagcatacataaagcattaaattggcttaccccaccccttcctaacaggagagaagctggttagatttattactcctttgatacaggtctggagggagagtgaagtggcatgtggaactcccactgaaggactccctcaaaatctttaggactccttttagatagaatgtttgtctgcaatttctaactcatttttaagaatctctctagattgagattgtgcaagatcattcacaaaaataaaactcaattgataatgtttctggattttttctgtaatatttatgtccaagcaagggatatcatcaacacaaaactttttattctcttatttttaaaattggtttttgtgtaactggctcattctcttgctcggttaaatttaaaatttattttcctttgacaataaaggtggagttaattgttttgtctgtgtctgccttcattttgggtgtccataacaacctccaaacaccaaactgcattgttcttttaatatggaagattataactaacaggtttcataatacttttttgttttaaagatatagcatacccaaccaatcaaaccaaataaccagttatttcaaaattgtatgaatatactgcagaaggggagctgatttcaaatcagtgttttcaagttcatggcaaaattttaacacttgtgttagaaaagtatatttcatttaatgctgtt

SEQ ID NO: 5930 - DNA, 895 bp, mus musculus
ggatacagtacagataatccgaatggaaaattgcactgaaaatgtcttcccctgagttatatttgctggttcttacataaaatgttatttatacaacagattttattgtatcttctcttgctttactcctttatcaccttctagctaactgtcctgacttcagacctctgttagatctgccagatgtgctctcctggcccatgaaatcaagcgtgggtgagacctggtgcagaacgggaaggcgacccatacttggtttcagaggctgtgagaataactgcaatttagagggaataccatttatgtttatgcaggacttccagagaaaaaacaaaatttattatagacataaagaataagagatgaaattcatgattatattgcatttctgttccaatgggattaaaaaaaaaaaaacacgtattctaagtaagttgaaccaggttgacagctaatgatttgatgtctctgttaatgattttaaaacattgtacaaatccaaaactgtttactccttcaaggtatacctccttttctcccacttctccagctattgtggtccatttgcccttgctctgggctagttccttggtaactaacagaaatggatggacagagatgccatgacaggagtatggattttgctgggtcctcatttatgctggggcatctatcaactctttttccaacatatttttgtttcccacacagccccactcacagatgcttgcctatagggccaaaaatctctagttagcaatctgccagagtcctgcttttttgtgtaggagattggagttctttcaaataacccatctggtaagatgtagagaagtagagaaactgaggtaaataaaatgtatattgttaagtactttattgcatactttgtacc

SEQ ID NO: 5931 - DNA, 895 bp, mus musculus; identical to SEQ ID NO: 5930

SEQ ID NO: 5932 - DNA, 712 bp, mus musculus
gacttaaatcaaccaattcacttaaaagaaacagttctcactaaattaaatcagtccagccctccctcccccattaattttagaatatagatccagttttttttttgtttttttttttttcagttagatccagcttttaaggtcagattctgtgacgtttatttgtgttccatactaggcctgctgtgttgccttgttgttttaacatgttggtaagcttatcaattgatattcagagagtatcaactttgagactcaggataagctttgttatgaaagccagctgtgtgaaatgcctgcagatggactagtgggagcggatgggcctggatctcccttgctcagcctgccattcacctcttcccatttccccaagcagaggaggctcagacttgagaaggactaatggaaactcctcttctcccagtattccttcagggtagtggttgtcgaactgtagcctgtatcggaatcacccaatgggtctattaagccagaatgctggccctgccccctggaatttctgattctgcaggtctgagctggggcctaagaatttgactttctaggtgatgctgatactgctagtccagggactacattgtgagggccactgctttagggacaagaactctaagttaaaagaaaaaaaattagaagaatgccacagctctagatagacatagaaaattgagaataggtcattttcaca

SEQ ID NO: 5933 - DNA, 293 bp, mus musculus
ggaagcatctcatttcttaaaagctgtcaaagaattggtgtgaggtttaaaaacgtctctgagcttgatggaaggaaggtaggcggtgatagttcatgctccctttcctccagacacttctcattttcctttcttaacctgctttgatattatgatttcttttgcttcatttgttaagttctcttacaacacttcttgttcacaagtgagtgaagagctgttctctgcttgtaacgttggaaatgggggagtgtttcagaaatgacacaacaaagcattaagccatgaaacaa

SEQ ID NO: 5934 - DNA, 293 bp, mus musculus; identical to SEQ ID NO: 5933

SEQ ID NO: 5935 - DNA, 542 bp, mus musculus
aactcagatcccacctcggaaaatcctcctctccccactcgcattgaaaagtttgaccgaagctcttggttacgacaggaagaagacattccaccaaaggtaatatttactggggtgttttttttaatcaccagcatcactgatgatttttattaccactattccagacctttcgtagtagtggagaatgtgatcatgccaaagcacttccccttctcatgtttgttttggtccctcttcattccctggctaagacttggattgccatttaccatgtctgacctttatttcccccgcaagaaaactgaagtcaggtagattgaagcacagatcctacgtccaaagttagaactctcaacaccaagtattccaaactgtcattttgctatccatattaacaaataaagtaatggatatttcattgatgactgaatctacatcaagacaattgaaaacttccagataaaaagtagaaaatccatgtattcctatttttaacaacacaaaagtgaagccagatttcaggggttcagaagatagta

SEQ ID NO: 5936 - DNA, 124 bp, mus musculus
tccttattaaaacttcttgaagtagattctgattcctgcatgactgactcagacattagcaataagaagcactacataaaacatttgactgtcaagattccatttttggatgtagaaataagat

SEQ ID NO: 5937 - DNA, 546 bp, mus musculus
gtattgaaaagcagtcagtaggttttaaaaaggtaacagagagccatagttaatccaggaagttgagtaaatcaaggttagttaataaaattttagtattttaattaagaaattatctttgcatcttgtgtaatgtgaaatgtataaagcatcaaatgtgaaagtcacacaatgagggcaagaaggctttaccatcctttgctggaggatggtaaagatgaattcatgaggttagttgaacttaagtaatggatagatttaaatacatacatgaaatgaagagagaaaaggtaagacttgacttcttcattgtgacaacatgtccatatccagacatgtgtcagattagcagtgggccagaattaaattctgctgagtgggcagatgggtggacactggtcttctcctgactttctctgaatcccaggttatcccgggagcccagtcaaggactccatgtgtattgtctatggtgtggtactccagctgagtgcacactgcctgttccccacccacctccacagacaattcaattctactttgcat

SEQ ID NO: 5938 - DNA, 552 bp, mus musculus
ctatacttttaattactatgtgcaagaagtttcagccaagtataaaattagaggacacagttcccaagactgccccgaattttgacaccaactataagttgaggaggggactgggatgggtagcattcacaaaaccctgttcagtttcaatatttctctgaaaagactcataaaactctccgaaacctgttatactcatggttatgattcattacaggaaaaggatatagattaaaatcagctaaaggaagagaggcatagggcagagtcaaggtaagttccaaatgtgacctgtcattgtcctcttccgatggagtcaggatgcattgctctcctggcatcagtgtatgacaaaatgcatgaagcactgccaaccagggaaactcacccaagtcttagcatgcagaattcttactagagcaccatcactaaggcatttttgattgattgattgattgattgattgcccatttggttaatcttagcctccaggttgactgatatcacataacccaaaactcctacccaaaatgatagggttggtctttctta

SEQ ID NO: 5939 - DNA, 392 bp, mus musculus
cttgggtgtaaaaactgaaaagtgtcgcagcatgactaaggactatttctcagttgctagtctagcaccctgtatcaggcacctaccttgctcatgttgggatgttagcacccatgaaaacttggacaaggattacattgagttaagcacttagtgattctttgagctaaataatagagggtgggaggcatatgtaaaggaggtttgtttaacgatccctgtattcattgaaaatgtaatgtgaaatatttatatatttttgagggagaatcattaactatggaaggattaggaattatcagtaatggacattttgtataaacatgttaataaatttatgtaatatttaacttctctcctgggaataaaacactttttgaagaacttttagg

SEQ ID NO: 5940 - DNA, 725 bp, mus musculus
atgacatatgacaatttatatagtattttaatgaataatgaaataaatttaaacagttttttgctgaacaaaataataaccgtctcaaaaataagtactggggtaattttattatctgttgttatgtacttatctttgataaattttataaattgtggattcttggtttttgccatttctctttttaagttgtaacctgattaaacaattttgtgtttgaatggtttgcttgaatctttaacaaaataatttgattcaatgaaagaaaaggtaatcaatgtaataataatgttaaataaatagttaaacaaacaaatataccaatgaacttactttgaacaaacatttcccagtgcgcattatgaaaggtatacaaagtagaaccttcagtatgttatcttgcattataaagatccaaagctaaatagaacatgcagccttttccaaacttgttttactctggaacattttccttcaatcatcttgtgaaaaatggccacaggaatgctgctttaaacaaaccctataatatttaaaatatgaaattctacaaaaacgaagtttccaatatcttcactttgataatgaatttttcaaatgtcaagatccacaatttgcatttttcagtgcaaatacactttttcagaagcacaactctatatacagtgctgataaggcttgaaggcactgattactccttccctttgatctggaatttcacctgc

SEQ ID NO: 5941 - DNA, 222 bp, mus musculus
cagagattgaggttagctagtattgaggactataaaaatctttgatagtttaatgggtaaaatatgcaacagggtagaaattgaatatgatagcttttctgcttctttccaaaacaaggaacaacaaacaatcagttctcctaacccagaaatgcttcatatggtttcacaattgatttggatatgtattgttcctcaaatgcagaaatatatgtatatgta

SEQ ID NO: 5942 - DNA, 118 bp, mus musculus
ataaggctacgtaaatcttattttgcctagaacacattaacatctttatgtctgtctacattgttttcaatgacaaagtcaaagtacaataatataggaccataacagttcaaaccct

SEQ ID NO: 5943 - DNA, 1520 bp, mus musculus
tcaatctagccctgaaaatttagatttacaaaatatgaaatttttactttgcctaaaccatataataaaagccatgtgcctagggaagttcattaaatgttttaaggtactaagcgaatgatgggaaatactgtaatagaaagatcacttaatccaggattttcaaacttcgttcctaggaacatcagatgttaacagttggcccacgcccaaacaaaacaaactaaaaaaaataaacaggccaggtgcagcagttcacttctataatcccagcactttggaaggccaagtgggcggatcacttgaggtcaggagttcgagaccagcctagccaacatggcgaaaccgtgtctctactgaaaataacaaaaattggccagccaggatggcatgcacctgtaagcctagctactcaggaggctgaggcaagagaatcacctgaacccaggaggcggagatggcaatgagctgagatcatgccactgcactcaagcctgggtgacagagtgagaccctgtctcaaaaaaataaattaattaataaacaataaacaataaaatgaattccattcattatataaatttggctgcaaaaaaataagccctccttgcaaagacagagagcaacagcatattgaaaagttagagagcatcagcatattaaaaatcctgagaaatacatttaagcctgtttaatatgtttaagtcagtatttcccacattcatttttactatatggcttttttttttttttgcaatcaaccactgttaaccagcaaacatcaagaatcagtaatttaatctacagagtagagattctctttgactgctgagagatcattcactgcatcagaatcccctgttaacaatacaaattccagaaccccaaccccagactcactcactcagcccgaggagtaagaacccattctgcatagtgacactctccgcatccctgggattattatgcatatgaagcatggcagcctgttatccaataggatagataacccaagggtgtaaaattggtgggtgctgttttctgggatagaatggacacattttttaaagacaaaaatatcttttactaggaatcattctgtagaggacatatagacaagtaagtgtaacacaaaaggtgctctgcaaagtgactttacagaaacacagaaaggcctctggttgaaaaatctcttgtcatcagtcacggcagtcagaatttcaatatcagaaattccattgttcttggaagtataaattgaaataacttttctcaaaagctattttacattagatgtcaagagactaaaaaatataaaatggctttaacttagtgattctacttctgggaaaaaacacttaaattcagaaaaaaacttttcatacaaagaagttaattgtaaacttttaatagggaacctaaacctctgacagtgtgtaaataaattagtgtatattcatataatgtagtattaggtatttatactaaaatttataatagcacaaaaaacacattgtaat

SEQ ID NO: 5944 - DNA, 377 bp, mus musculus
tacttagagataaacctaaaaaatagtgtagaagctgcacactaaaaagcataaaacattacgaagaaaaattaaagaactacataaatgtactgagttgacagatcaggatactctatattgttcagatttcaatccttgcctaatacagctacagattcaatgcatatccagtcagtatcctctcaggtatttatttaaagaaataaccaagtttattgcaatatttatacggaaagaaaataaaaaacaaagaataacctattttcccaccaggcatccacagagttcctatgctcatatttcatactatatttaggatatagaatttcccctaactaaagtcatttgctctatgctcattgcttaatatatgt

SEQ ID NO: 5945 - DNA, 85 bp, mus musculus
caaaggaggcccaatttcactcaaatgttttgagaactgtgtttaaataaacgcaaatgaaaagaaaaatgttggtgcagctgtt

SEQ ID NO: 5946 - DNA, 1288 bp, mus musculus
gattaaacccaatgaggcagctgcgagaaccttccgtgtagccaggtcagagagaagttgcgggtaacctggggacctactactcgcgattgatgtctgaagtgagaattggtcttgtgggactgggatcttaacctgtggggtctgcactaactctagctactgtcagaattgaattaaattgtaattcaattacaattaaatctacagagaattagagaattgcttgatgtgggggaaaaccccacacattttggtgaccaaaaatgttgtgagagtacaaaagagagcataaagcagttttttgttttgttgttttgttttgttttgttttgttttcctatagacagactatgtctcttctcccgggcccctcaaaaggtgctgcctccccttcttctctctttagccagcacaagagcacacaggaggccggcataatcacgaattgcagctgtctgaagggcagtcacataaaagaggagaagcttcacctttgcttcacaaggcacatcttgaaccagggatggaaattacagagaggccaaaaccagctcggtgtgagcaggactggtaacagactggccaagcaacagaaggggctgccctgtgaagaagcaagctctctgtcaatgggaggtgcaagctgagcctgcactaccttttgtcacggttgctatggaaaagattaagagcccggtattaactatctattgctacataacagaataccacacaacttaaaagcttaaacaacacatttttatcatgtcacaatgtttggggtcagggattctggagtggcttagctgggtggggtctccgggttggtctctcgtgaggctccagtctagatgttggctggggatgcagtcgtctgtcagcttggcgagggctggatgatctgcttccggaatggcccactcacatggctgtgggaaacaggcctcagcccctctccatgtggcttctccatagggctgcttgagtgtctgcatgacatggcagctggctccctgaagagcacgtgatccgaaagagagagcaagacagaagcgcagtgtcttcaacagcatatctttgaaagtcatattccaccgttttcactacattctattgataagtgagtcactcagaatagcctacattcaagaggagaggaatgaggctgcattgaagggagcacactgcaaagaatgtgtggatttattttaaaaccactataagccccttcagtgctgagttattgtgatgccttatgcattccgaagccaaacgtggatgtgat

SEQ ID NO: 5947 - DNA, 727 bp, mus musculus
agacataaaatgattgccgtatttatgtgtgtgtgtccaacagatctgcaagaagtgtgactctctgctgccagtttgattctccaaatggaaactggtggtggtggcagccgggggtgagagaagagggtgatgacaagaaattgtatcaagcagaagggcttattaatatcaatatttctcaccatgataaatgagtgtcctgggggctctgagggtctgacagttttcatttgctccagatgaagtcctcacagggcctctgcttttccagcctgggatagatttgctgaaatcacaaacccacagcagtctcaagaccatgggttcctataaaatcacatgtaatacacaggattaaacaaaaaccaccccagtatggtgtttccatctttctagctcatcattctgtctttggttagagtgaagcctcatttttctcatcttaactcctgtcctgtttcctttcctagagtgcccttctcccacctctaccttccccaaccataacctccttcaagaaccggttcagataaagcctactcaggtaacacccctatagccccagctctctccgtgtgtcatgcttgtctttgtctttttaggccactatcatgaaataccatagatttttcacagtttcacatttatttttcacagttctggaggctggaacatcaaagatcaaggcaccagcaaatttagagtctggtgagacccactttct

SEQ ID NO: 5948 - DNA, 16571 bp, mus musculus
taaatacaaatacaagagccaataataatttaaaacaagaaggtaaacagtaaaatcaaaagctgactctttaaaaaaatgcaaaaaactagtataaaagacacactatctaatcaagaagagaaatggcataaaaatgttctaaatattcaataataaatattaaatatttaataagtaatactaagttattaataaatattaggaattaaaagagaagatgactattttccagaaagaattataaattgtaataaaaaccttgaattaaatgaataacaattacaaaaatttagttaataattcaatgtactctctaggatctacagaacccaggtgtttttattttgacttttatgaaatcttcgaggaatatatcataaatacattaactagtatatttagagaacaccactgaactcattttatgaggtagctattacctcaatctcaataacagttaattttgtatggcactttgtcatgtgtcacatattattttaagagtaagttgcaaaatgagaattcttttacactgctgatagaaaaataatattatataatcattttagatatatctaataaagctgaagataaaaattccttgaaccatcaattcctcaacaagagatgcttttgtatttgtgccctaagagacaagtaccggaatgttcattgcaaaaccatatcaatggaaagttggaaacaaactaatagctaccaaaagaatgtacagttaatacttataaacaaaagttgcatatatcaatatggacacatctcaaaaatagaatgtggaatttgtgcattaaaagtaaggcagctggtagaaaattgatgaataaaaagtcaatatagaggttctgtggaggaaggggttggattagaatttggaagaaaaccataagtagcttgaatcatatctgtgatgttttatcacctgaaaaaataaagacagaaaaaaatctgaagaaaaataatatagaaattgtcccagcatccaggtagagaaaacaaatctacaagggccaatatcagccattgctccagtaacattcaattctgaattataatggaccagtactgatatagcttaggtctgtgtcctcacccaaacctcatgttttattgtaatcccagtgtcggaggcaggacctggtgggaggtaattgaatcatgggggtaaatccttcatgagttgtatagcactatccccttagtgctgttctagttatagagttcttatgagatctggtcatttgaaagtgtgtagcacctccagctgccctctcatcctcctgccccagccatgtgaagtgctgctcccactttgccttccaccgtgattgtacattctctgaggcctccctagaagctgatgctaccatgcttcttgtacagcctgcagaaccataaaccaattaaacctcttttctttataaattatccagtctcagttatttctttatagtgatgtgagaccggactaatacatgtgtcttctaggtttctaaggaaagaagctgtgatttaagaatatcctacaagccaagatatcattcatgtataaagacagcaccaggcagacattctcacacacgaaaaagttggggaatatgtcacacattgacccttttgcaaagcattttctgtcaagaaaatctaaccaattaaaggatgaatcaaaatagagaacccaggaattaagaaatatgattaaaataaagcatagcaaaagaaggctgataacgagtaacttcacttaagaacagaacaaatattagacaattttgttaattatgataacagaacacaacgtacattttataagtgtaatcaacataaaatgaataaaaactaaaagctaggagtaggggtgatgtgtaattgctagagtagccatatattcatcttttttcatcattcatcatctttctggccaagtgattcacaattctatccacattcaaaaaatgtagttaaaacataattatttcacctcgttttttattgtaaactttattttttagagcagttttgagtttacagcaaaattaggcagaaagtactgaatttccatatacccactacctccatgcataatctcccactatcaacatatctcaccagagtagcacatttgttacagttaatgaattcacattgatacattttcaccaaaagtccatagtttacattagggttcaaatctttgggttttgacaaatgtataatgacgtgtattcaccattgcagtgtcatacagaacagtttcactgtcctgaaaaccctctttgctctgtctattcatccctttctctcttctaactcttagcaaccactgatatgtttactatctccagagatttgccttttccaaaatgttatagcattaaaatcataagtatgtagccttttaagatcagctttttccacttagtaatatgatttaagattcttctatgtcttttcatgtgtaggggaggcaaaattctaccttcaccttcttagggtcccggctgtgtctgagaattaaattggcatgagctagattaatgggagaaaagcatacagatttatttaacacaggttttacatggcataaggaaatgaagacccaaagaagcagttagagtcagatacgtatttatttaattagacaaagaatagtaaagtgtggaagtatgataaggcaaaggagcttaggctagggtagttaactgagtagagatgtacctaggaagataagagttagtttaacatagcttgtttgtacagaattcctatggcttcctcctcaatttcctcatccttgatgataagaatgtttcttttcctctagtatagggaggacatcttccacataaaaatttcatcttccgccttaaaggaaacactaaagtcagagtgatctttttgcacctgctgtttgtcaagtggctttaacttaaatcgtcaatatgacagagtggtatatttttaagttctttacttgccttgatcgctcatttctttctattgctgaacattattcttctgtttggatttaccactgtttatttaggctctcacctactgaagaacatcttagttgcttccaagttttggcaattaggaataaaccttctataaaccatccatgtacataattgtgtgtgtggccctaagttttcaattcctttaggtgagtaccaaggaatgtgattgcaggattatatcatagcaatatgtttagttttataaaaaactgccacactgtcttccaaagtggctgtaccattttgcactcccatcagcaatgaatgagttcctgttgctccacatcctgccaaacatttggtatcatccatgttttggattgtgagcattctaaatagtgtgtagtggtaactcattgtgttaatttgaaattccctagtgacatatgatgttgaacatctttttatatgcttacttgccatctctttttcgtctttggtaaagtgtctgttcagattttttgattttcttattgattagctttaagagttatttgtgtgctttggataaaagttatttatctgatttgtcttttgcaaatatttcttctgtctatgacttgtcttctcattctcttgacattgcctttctcagagcagaggtttttaattttaatgaggtacatcttattgattatgtcattctcagatcatgcttttgatgttgttttcaaaaagtcattgatacactcaaggtcagctaagcttttccttatgttatgttccattcatttttttatttttgtgttttacatttagttttctgatccattttgagttaatttttgtgaagggtataaggtctgtatataaattctttttttttttttttttgcatgtggatgtacaatttttccagccccatttgttgaaaagactgctagtttgccaaagatcagctggactacatctatatgggtctatttctgggctctgtattctgttccattgatctatttgtttattctttcaccagtaccatagtatcttgattattgtagttttatagtaagacttgaagttaggtagtgtcagctatcctatattgttcttttcctttaatactgagttcattcttctgagtttctgcctctccatataaactttagaatcagttttagaatcagctttttatatccacaaaataacttgctaggattttggttaagtttgtgttaaatccatagatgaagttgggaagaactgatgtcttgacaatattgagttttcctacacataaacatggactatttctttggttatttagttcttctttaatttcttatatcagagttttgtaattttccttatatagatattgtacaaatcttgttaggtttatacctatgtttttcattttaagtgctaatgtaaatggtaatatgtttttaatttcaaattccacttttttattgcttgtatataagaaagtgattgacttttgtattctagccttgtatcctgtagccttgatataattgcttatttgtgcaagcaatttttttggtcagttctgtcagattttctatatagctgattatgtcatctgtgaatagagaaaatttgatctcttcttttccaatttaaatactctttatttctttttcttgtcttattgcattatacacttctagtaagatgttgaaaaacagtgggaagggctgggcttggtggctcatgcctgtaatcccagcactttgggagaccaaaacaggtggatcacttgaggtcaggagttcaagactagctcggccaacctagtgaaactttgtcgctactaaaagtacaaaagttagcatggcatggtggtgcatgcctgtaatcccagatacttgggaggctgaggcagaagaattacttgaacctgggaggtggaggttgcaggttgcagtgagctgaaatcacaccactgcactccagcctgggtgacgaagtgagactctgtcttaaagaaaaaaaaagaaagaaaagcagtagtgaggtagtgagagggaacaccgttgcttcattcctgatgttaacagaaagtctctcaccattaaatacaaagttagctataggattttgtagatttttaaaaatcaaattgaggaagttctactctactcctagtttgaaaagaatttttatcataaattggtgtttgattttgccaaataatttatctgcatctattgatataacgtgatttttcttctttagcttgttaatgagattgattacatttattgattttcagataataaacttgccttacatacctgggataaatcccactgggtcatcatatagagtcctttttataccttgtctaatttgatttgctaatatttttgagggtttttgcatttatgttcctgagagatattggtttgtagttttattttcttgcagtatattttgtctggttttggtactagagtaatactggcctcatggaatgagtcacgacgtgttcctctgattctgtcttctgaaagagattgtagataatctatataatttattctttaaatgtttggtagaattcaccagtgaactcacctattactggtggtttctgtgattgaagattattaatttttgattcagtttctttaatagatatgagccagttcagatggtctattttgtcttgtgtgagttttggcagattgtgtctttcaagaaatttggtccatttcatttagattatcaaatttgtggtcatataattattcatagtatttattttcttcttgctctgtcacccaggctggagtacagtggggccatcttggctcactgcaacctccgcctcccaggttcacaccattctcctgcttcagcctcccgagaagctgggactacaggtgcccaccaccacacccagctaattttttgtttttttttttagtagagacggggtttcaccatgttagccaggatggtctcgatctcctgacctcgtgatccgcccaccttggcctcccaaagtgctgggattacaggcgtgagccaccgtgctcggcctttattttcattttaatgtccatggaatctgtagtgatgtccctactttcatttccaatattagtattttgtgtcttctctctctctttttatttattattattttgttggctttgctagaaatgtattcaccttactgatctcttcaaataactagctttcggttttgttgatgtcctctattgattccctgtttgcaactgtattgatttatatactaatttttagtattcattttattctgcctgcattggatttaacttgtacttatttttctagtttcctagtgtagaagcttgaatttctgattttgtatatttctttctttctaatatatgcattcaatgctataaattttctccacagcactgctcttactgtatcacacaaattttgataaattatttttaatttttatgtagttctaaatattttctaaatgttctttaaattttgttttccacccatgtgtttaatcccgaagtattttagaattttccagctattttttgttattaatttctagtttaattccatggtagtcagagcagacactgaataatttgtattgttttaagtttgttatgttgtatttggtggcccaaaatgtggtctatctttatgaatgttttatgtaagcttgagaagaatgtgtattctgctggtgttagatgaactgggctatagttgtcaataatatttagttgatcagtgatactcttgagtacggccatgtccttactgattttgaaagaatagattcaacaggcacaaaatcaatttgcacctcacatattttcatggtctcttgttgggtgtgtatacattaaggaatatgtctttttggagtattgaaccctttatcattatgtaggagtattttttatcccaaataatgttccctgatctaatgtcttcttttgtgctttttaatagattagtgttagaatgcataacactttctccacccatttattcttttaaaataaataataaactgtattttaagagcagttttaggttcacagtaaaacatctctttacttttaatctatacatgtttttaaatttaaagtgggttacttgtggacaacaaacatcttgttttataatctactctaacaaaatctgtcttttaatttgtgtatttagatcaacaattaaaggtaatgattgacatagttggattaatatccaccatatttattattggtttttatttcttgcccttgttctatgtttttttttcttttggtacatactttgtctgcatgttattgttttaattgaacagttgtttatatgattctatttttcttttttacaatatcaattataattttttttaccatgttcagtggtttccttggattttgcaatatacattaacaactaatccaagtacactttcaacaacactataccactataagtggttgtacaagaatcgtataataaaaaactatctttaattcttccttactgttctttttatcgttggtgtcattcatttcatgcttatgtaatacatatgtgtatatacatatgtaatatatgcatatatacatatatgttatggtttggctgtgtcccaacccaaatctcaccttgaattgtagttcccataatccccacatgtcatgggaggaacccagtgggaggtaattgaatcatgggggtagttacctgcatgctgttcttgcgatcgtgagcgaattctcacgatctgatggtttcgtaaccccctattgttcgacacttctccgtcctgccgacccgtgaaaaaggatgcgtttgcttccccttccaccatgattgtaaacttcctgaggcctccccagctatgctgaaccatgagtcaattaaacctctttcccttataaattacccagtcttgggtacgtcttcattagcagtgtgagaacagactaatacaatatatatatatgcatatacatatacaaatatgtatatataattgaatacattgtcgatattattattttgaacactattattaaatcaattaagaatttaaaaagtaaaagttgtaattttaccttcacttagttattcttaaatgctcttcctttctttctacagatctgagttttgttttttttggtttttgtttgtttgtttgtttgtttttttgagatggagtctcgctctgtcacccaggctggactgcagtggcgctacctcggctcactgcaagctccgcctcccgggttcacgccattctcctgcctcagcctcccaagtagctgggactacaggcgcctgccgccgcacccagctaattttttgtatttttagtagagacggggtttcaccatgttagccaagatggtctcgatctcctgacctcatgatccgcctacctcggcctcccaaagtgctgggattacaggcgtgagccaccacgcccggcctagatttgagttttgaacctttcttcttcttctccttgatgttaaaaaatgtcttttaacatttcttgcaaggcagatacacgtaacaaatcccatctttctggctaagaaaatgtatatttctccttcacttttgaagaataatttaacagacagaattctggtcggctggttggcgtttttgtttttcaaacatatcaactgtttaaatatttaactcaactttatgttttcatagtttctgagaagaagtttaatgtaattcttgttctcttttctctatagatgaagtgatttttctccggcatccttaaagatttttttctttatctctgattttctaaaatttgaatatgacatacctacgtgtagttttgctttctttgggcatttattctgcttggaattttctgagctcctgcatctgtggtttggtgtctgacattaattcatgaaaattatcagtcattagtgctgcaaatatgtattgcttctgtttctttctcccttttctctcctggtattcttgtttgtgtatgtcacatcttttgtggttttcccacagttcttggatattctgttgtgttttggttttgttttttagtttttatttcttcttttcagttttagatgttgctattgtcatatcctccagcgcagagattgtttccccagctatgttaattccactaatgagcccagcaatggggttcctcatttgttttagagtattttttatcttaagcatctttttattctttctaagaatttacatctttctgcttacattattcatctgttatttcatattgttagcagcagcgaatctgtatcggtctgcaacgacctcaattcttgccccctaagaagaaagaattcggctgaggggcacaaggcagaggcagagactgaggcaaattttagagcaggagtgaaagtttattaaaaagttttagagcaggaacaaaaggaagtaaagttgttattttacctttacttagaagagggctaagagggtaacttgagacatccaagggcacagtttgactttgacttggggttttgttagcatgcttctgggttttgcatctcttctcccctgattcttcccttggggtgggctgtctgcatgcacagtggcctgtcagcacttggaaggggcagtgtatttactgaagttgcacacatgctcatttgaatcatttttcccttacccgtcaagtgtttctagaggaaggtcgtataccagttaaactttgccattttgcctcttagggtgcatgcttgagcccagttgcccaactcctgagatattatcaggaagttgctgatccccagcttcaggtgtttcctatctattgggagacggcccttccctggtgccggctgcaaccaattactattttagagagacagtttaacaaccacctgaccatcattgcctgatatttctggttggggaggggcctcacgggtcctgctcatgtctgcctaactacctactctaacaatattgtctcctttctttttcaaaacatccattagcatattaattacagttaatttttaaatttcttatctgataattccgacactcctgccacatttgactctggttctgatgcttgttcagtctcttcaaactgtgttttttgtgttttggtgcatcttgtaattttttgcagggaggcagatgatggactgggtaaaagtaaccatggtaaataggcctttagtaatgtagtggttaggtgttggaagaggggaagcattctatagttctatgatcaagcctcagtcttttggtgagcctgtgatcctggactgtgaacctcacaagtaagtctgttttgttttgttttggtttctcccccagcagatgggatcgaatgcctggagggcactgaaattaatgcatttacctttgcctaggtgagtctagagagagctggagttggatatttcccttcccctaggcaggttagacctgtatataacctggcaggttgggctctggtaaataatttctcctgaggacaagccttgttagaacaaaatgttctagagtattacaaaataattctctttgccctcttcctgctggaagcatgagaaaaattttctccattattcactgtgaggactcagtagaatttctggtggtaaaactcacaaagatccccccatacatgcccccggctacggctgggtcctcctggagcttttatctctcaggcttgtccgtaatcagccttcagtgattcatcaattacaatttaggttttcctaccctgttactggtttctacaaaagtttctgtttctggatttctgtttgggtaaagttgtgattctctgccattctctctctccggttttgggggcagtgacatattcagtgacttcatttttctcataatctaagaagagttattaatttttcagtttaactttttacttgctgggatggagtaaagacctctaagctccttacatgtttgacaagaaactggaagtgcaccgctttttttcataactgatttttatacccagagaaacttttatgaaaataatatttttttgtaccaaagaaacattttctaaaaatatcagcaactttgggtttattttactttgtgttgctgctgctaaagtacagtttgttacttaaaatagtttataaatatatatcaatagatatagatgtataaaatacatttttttcttaaaaatgctcttctatttctctgtgttacatacctctggctattttggtcaatatatataagtaaaatgatgtctgaagttttgtgtttttttttttgtttgttttttttttgagacggagtcttgctcttattgcccaggctggagtgcaatgttgtgatttcagctcactgcaacctccgcctcccaggttcaagcaattctcctgcctcagcctcccaagtagctgggattacaggtgcccaccaccacgcctggctaatttttttttttttttttttttttagtagagacggggtttcaccacgttggctagactggtctccaactcctgacctcatgatcctccccacaaggcctccgaaagtgctgggattacaggcgagagccactgcacccggcctctgaagttattttcctggatcattatgtgatgtcataggatctaaggtaattattttattattattctactttactgagtaataattaaaataaaacaccattaatattatagaaataatatcattatttttattaagaaataaacttaatcagtatctctgttgtccccttgaactagtcaagaactttaatttcatatcatgttttcttcccccaacttcctaacacatctcttattgaaaagatctcaggttttacttttaaatatgtattagtcttttctataatacacaattctttagattctaaattgattgctgcctgtgctcaatattccttgttccagcatctttgcttgtttcttctgaaagattttaagattgtttctcttactctggcttttgatgcatttggattggagactacattctccatcttgcttgataatcagtttacttttttttcttttctttttgtttctttttcttttttttgagatacagtctagctttgtcacccaagctgcagtgcagtagcacaaacagggctggcttactgcagcctcgacctcgcaggctcaagcaattctcccacctcaggtttctgggtacctgggactataggcatgtgccaccatgcctggctaatttttttttgtattttgtagagagggagtttcaccatgttctccagtttcatgatgttccccaggatggtactgaatttctaagctcaagcaattcacctgctttggcctctgaaagtgctgagattacaggtgtgagccattgtgcctggccaataattggtagacttttctttttttattttcacatttttaaaattatactttaagttctagggtacatgtgcacaacatgcaggtttgttacataggtatacatgtgctatgttggtgtgctgcacccattaactcatcatttacattaggtatatctcctaatgctatcccttccccctccccctaccccacaacaggcccccgtgtgtgatgttccccttcctgtgtccaagtgttctcattggtagacttttcaatgtaaagaatgatgtcatcagttctgtgtatttatgtcattggttgtagtagcaataatagtattgttattgggttattacctctattacattatttttcttcctttgaaatgagtattaaaatttggatcaatgttgtcttttaatttttctgatgtactttattttgtacctttcccctgcattttggaaaaattgatcagattcatcttcagctgcagctattctactatcccattcatttactgtgattttacttttggcaatcattttcaagatctctagttggtaatattttttacaaccaagttattgattcatgaatatattaaactctcttattactctgaagatactaatacatttcaaagtatctttttgcactaggaactctagttcctaggatgatgtatgtttattaaagttggtgattctctctctctctctctcccatgttacttgttttcttcaagtgtttgatgaatccagcttgtctctttatctttgtatttaagaatgattaccctttctgagagtattatttttttcttcctcaggctatctttaaatttgtaaaagagaaagaaatgtgatatatgtcagattatcctaacagcattgtaaatatgagtgtttctttatccttgtaaatgtaaccaattatccaaagcccaccctgtgtcttcaggcctaagcagtcagttactgcttttttgttggaaaagaagcccattttacctgacggttcattgtctgacaacagagtaagacatgtggggagaagatctctctacaaattaccctaaaggttgtcctaggacacttccctgcttaaggctctattacttttgaacttggcaaacacacctacagagtcatttctaccttttacaactgtgcttccttttatagttataatcagtataaaatatattatactttttgaacttggcaaacacagctacagagtcatttctaccttttacaactgtgcttccttttataattatagagctacgatcgcaataatcaaattctgttttataatatatgtatatattataatcatgatctattataacttctactcaacagaagtgaagtttccctgtttttcagcagtgtaactcattcatattgattaaaactttatatatgtaaaaaagataagtaccttatgtatcatatgtttataattttacatatatgtgtacatacatgtgtacatatatagcacgatttcttttttttttaattttaatttttgagacagaatctctctgtgtcacccaggctggagtgcagtggcacaatctcggctccctgcatcctccgcctcctgggttcaagagattctcctgcctcagattctcctgagtagctaggactacaggtgtacaccacccctcccggctaattttttgtatgtctaatagggatggggtttcaccatgttggccaggctggtctcgaactcttgacctcaagcaatctgcctgcctctgcctcccaaagtgctaggattacaggcgtgagccaccacgcccggcctatattgatttctaaatgtgtcaaaggtgagaaggaggtagatatacatcctgagttcaccatttgatttattcttacactctatctctttaagctgagattataatcactttcttgttttttgtaaaaagttgcacttcatataggatacacttaatagaaagaaagactgtaagtatctgccattccaggaattcagaatagcatatgccacgtttgtgtgtgtgtgtgtgtgtgtgagttaaagacctaaaataaaccttctaaaagaaatattattaatcagtattcttttcttgaaaaaaaaaagttttgaaatatattgctcacaacatttttatcagtattagaataattgaaattagacttatgtgcttttaatttgtttaagtccagtgtttaattttagaagtctaatgcgttactggcatttcataaatattttatgacatgtacattagtaaagatataaataactaatgtcttatcacagttacattttatcatgaaaatattaaattgtctataataaacaatgttcttgagcatattccattaactacttttctggctctctctttaatggcggtgttgtcaatgctgtgaaattatcatgaatttaccccataggcagctgtattttcctagaattactgacctcaggatttataaagagagatagaaatccccttatcatatgaattaatttagatgggcttactgtttgcaaaagaaatgttcctaaaaagaaaaaagaatttgtttagaaaagttattgataaaaatgcaatcttcctttgtaacttaagatgtaaaaaccttatcagttgattttgttttatataaaagttaaattttattcatacttgtttttaaattgttgcttgacggtggttaaaaatgagttctggccaggcgcggtagctcacgcctgtaatcccaacagtttgggaggccaaggcgggtggatcacatggtcaggagttcaagaccagcctgaccaacatgggtgaaaccccatctctactaaaaatacaaatattagctgacgtgatgacacgtgcctgttgtaccagctactcgggaggctgaggcaggagaattgcttgaacctgggaggcagaggttgcggtgagcctagatggcgccactgcactccagcctaggcgacaaagcaagactccatctcaaaaacaaacaaaaacatgagttctgagtgcaattctggttttcataattctgagaacagttccagaatagagttaaatgttgaccttgacaaaacaacccagcctctcagtcccaatggttgtgtgtatcttattttgaaataaactacagcatacagcactgacaacgtattttttcagggtaccttataatcagttgaatcaaacacatcacatggaccccggagaatgaaacttctctggctttgagcttctatctattgcatatactggccatagatatatctactcaggcaactgaaaataaacctacttgcttggaacctggaaaaaaaatcatattttgtactaaaagtaggttaagtatggacctaactgaatcaaatcagatttaacaaaactttacattgaccaagtataaaagaataataaaataatttaaaaagataaaaaatggatactacagtactccatgagtttaaatttttttttaccatctttcttctgtttaatcttcattgtccagaggaatatatacaaaatttttacatttaaaaataattcatatgtttaactgaggagcagattgaatttgaacatttaactggaaacttgttcactagtacctacttctcatccatggtttcactttccattgtttcagttactagtggttaaccacagtccaaaagcattaaatggaatattccagaaattcataagtttttaattgtgcaccattctgaaaagcataatgaaatcttgctccatcttgctcagcatgtgaatcattcctttgtccagtgtatccacgctgtatacattagctgcccgtcagtcacttcgtagttgtctgggttatcagtcaaaaaaaaaaacccatagtatatgtgagctttcatactatccatggtttcaagcatccactggcggtcttaaaacatatctcccatgaataaggggcgactactgtatttggcagctgagtctttctgaatgcattttgacagccttttcaatggcagtgtttatagcaaaaccaatcattatacaacacataatgatccaacagcctgaaagctataggtccactgtctacctagaaggaagtaggtaattaaatatacaagtattatgtgggaatgtggttgtgaa

SEQ ID NO: 5949 - DNA, 534 bp, mus musculus
tcctaatgtctaacttagtgaccttccgatgatactcagcagtgacctcatcagtactgtgggagtggaaagcaaataagctggtggtatgtgggagcacgctgcagatgatgggccctgactgggccatgttcccttttaaattcattgttaaatatcacccttcagttatgtacattgatttagccaatactatctctatcaaaatgggtgaattatttttattaaataagaatgtatattactttatgggataacattggatggcatgaatacaatataatgccttagacttataaaataaacttttcagaataacaaaaatatatactagagatatcaatttgtttttctatttatagatataatcacattataaagatatgttcatataggcaagcaggtgcagccaaaatattcaattcttagtccttgcagtctaggtgatagagtgccagaaatgaaacagttaattcaattatgctagcatgaggaatataaaagagctataaaaatgattaataattgatctgt

SEQ ID NO: 5950 - DNA, 969 bp, mus musculus
agggaattaaggcacaacaaagaacttgcccaaagtcacaatgaacccacactagaaaacttacagtctgtggtcttcattttacatttttttttgacagcatttactttctatatttaaaaataaatataggtgtttaaatacatttcaaaaaatatgtcaaaataattcacatttcttttaattctagaaatattttgaaaccttaacaatggatatattcagtaattattgtaaatagaaatatgagttaggaatttaatcatttgactttctaattgaggcgaatggcagtggctaacaacaccggagtagcactgaatgcagtaattcattcccttcacacaaatagctactgaaaggcagatggaggtgccagttgtgtcgggtgcaggtgattactgcccagcctggacgccaccaggttgtttttctctccaccagaaaactgtccattcactttcctaagtgccaaaagcaaaaggagaggaatttatgaagtccctagcccatatggctggtagtgaattaatctgtgtctgagcagcaggtagcacgagccagtctgtctgttggggctgttagtaacccaggggcagatcagagaacagcaggagagaggatcaactcaggctgcaaatacagtcaggaatgtggcaggaaattatttctgaaaacacactttgcagcataagggcagccatcagatgctacatgataatctatctgcactttgtacactcataattatatagagctatataagtaggtgtgaatttaaaatgtagttgtagatatatagctatcatgagattttcctttatatagcatcttgcgttaaaataattatttcaagagtacctcaaaaataaaatacgcaggcagagagattttaaaattatgaaaaagagaaattagaatattagaaaaagggtatggatctattcgaaagtagaatagcaaagatga

SEQ ID NO: 5951 - DNA, 2421 bp, mus musculus
aaacacattttccccctcattgtcatcgtaggttacatgttgtcaaagacccgtggtgtgcagaggagaactttgtgatgattagcaatgcggcctgactcaaggcacttccgtttgatgttttaatggggagtattttcgcttcagtttcaattaaagatgtcagggctaggagcgttagttcaaaaacttagaaactctgccaatcagccacgcgaatgtcatcttaaagtctgccagtgtaccagtattctcgtcaggcggcagcatctgtgttcactgggtcgcttacctcctctcctccccgctcctcctctgcaacttggtctctcacagcccacgtttcccacaccaggaccactttctactggaacaagacactgttttgtgcctgcttttacccataaagtttcttctgataattccttctcccctccattcatgcatgcattcattcacttatgttttcagtgagttagtatttaccacacaccaaccatgtaccagacattggcataggcactgggaatataactatgagcaaaacagatggaaatccttgtccttacagagtgattttctagtgaggagtcaacacacacacatgctttctctttctcaagtaaatgtagaaagtaggtgttgtctctacttattaaattctcctcattcctcagccacatatcaccttctctgttaagtctttgttgattcattctttgcgccagttcagaagggagggagttaattgcctgtcctgcattagctctgtgttttcatttgtgaccgctgtagtgctttttaccgtgtattaaaatactattcactttacagtttataaagcagtatgtcattgattatttaattctcataacaaccctggaaaatgggcattatcatctccattttacagatgaggatacaaagagaccaagtgactttacaacccagtaaatatcaaagccaggctttccttccttatatctctctcttttttatacatttgaggagcacacattgtatgccagccaacagtgctggctcatgggcaagtgtgtaagtgtgtgtgattaataaaaccagggttcttgacctcatggagttaatcagatcggtacacaaataaatgtaaaaatccacctcttaaaagtactccttaggaaaggctccaggttatggtaggattacataatagagatttggccaagtcaaaacagtcagggaaggctttctgagcaccaaaggataagagttaaaaggtgatggtggctgctgggggcaggcacatggagagtgatgcaggtggagggaatatgggggcaaagaacttaaacctaagactttctctaagtcccgaatcttttttttctcactgtgctggattcctttttgtagcttttgatcctttaaaattataagctttctattcctggaacttctcagctttttttttttttcctggacagtctagattataagctttttgaagacagtgattgtggtatacatttcattccccctggcacctagcacatggccacagcaggacttagttatttaatttaatttaatacgttgaattaagttgaatctataataaatagtctcactgtttctaccagaattttatctcaaggatactaaagtggaatgtcacagttgagaaagagaatatagcattatgtttctttcaggtacacattcccacttctgaatcctgctttcctacccactccccaactcagtcccatttcaacctggtctttcattagacatctcaccacaaatctctgagattctgtgagctggcctctgagaaatgactcaatgttaagataaatcgttttgagactattatcctttataatacagggccatttatattacgatttaacaatttacatatagttgtctcatttggtccttaccagtagagatttttttctccagttttacagatggaggcatagagaaattaaacaaaattctcagggtcccatagccggaagatgagagttgaactagagttggaactagagatctaattattctctgtccagtgaccagattctacagaggcagcattgtgaagtggtttaagaataaactctaggttctgagtacctggatttgattcccagcactgctcttgaccttgggcagtgtatttgcctgctaggcttctatagcaaaataccacacaccaggttttgctgaaataacagaaatttattgtttcatagttctgggagccgaaagtccaagatctagggccaggagagttggtttctggtgaggcctctcttcctggcttgaagaaggctgtcttctcactgtgtcttcatggggtcttttctctgtgctcttgcacacctggtgtctcttcatctcatatggacattagtccttttggattagtgt

SEQ ID NO: 5952 - DNA, 733 bp, mus musculus
ctctttccaaaacatgctgatactgaaggggtcacgctgaaggctgagggctagggcctttaaaggtggggcaccctcttccttctacccgtccttgaccctcagcagactacaggttgatctcccctttgccatgagtgcccaaggagggaacttgtgatctagcagtttcttgataatccccaaaaggctttaattactccatttccctgccacgcccagggcaggaggagggtgagcgggaaagctgtccaccttctgctaaacgggtcaggaggcatcgggagccacgtgggttgtggtttaggagcctgagctgctgatccccaggcaggcctacacaatgggagctgctccctgcagcccccgggccggcctgggttgcataacccatgaggtcagcccggcctgcggcagttgctttcccacaacggaggggccgctccccacctcctgcgggacccacagccctgggtctctttccagctttcctctttcactggcaaagctgcaggccccataaactggggaagggttgaggccctgcctctcctgaactgggcaagggtcgaggacttccccatgggtccaggcctccagcattacatcaggaggtagcctggggaggacagagcactgaatccctctggcatcagctcctctggccagccctgcacctgctctgtggggctagggcctggggaggtgtcccaaaatagcccgcaggggcccg

SEQ ID NO: 5953 - DNA, 215 bp, mus musculus
agtgagcaccttcacttttttgatatcccaggatccaagtgaaaaaataaggataaaagacagtggggaaaataacagcttagtgcagaacagggaaagcttcttttctgtttctgaagccccacaaggtcacctcctctcaatctggctatttcatggagaatccaggtgacaaagacagaagacacattttatgtctgtgtctttttgtttct

SEQ ID NO: 5954 - DNA, 1357 bp, mus musculus
caaaaaccaaatacccacctgcccaaaccaccgagagtggcccgccccacactgtgccctgccccacgctgtgccccgccccacactggcgtgggcagacactttgaggagctgagttaacaatgggtttctaaaggattagccgaaaacaattacatgtgatttatgaggatggtaggaagggatgagcaatgagcacaattagtagaggagtaatagtgattttaaaagttgttttaagtgtggcgcaatcacagcgtgcgtgcgagggctggcacctgccggccttcctgggagactgcctggccctcttcctgtggagggtggtactcagggtccgcggggaagggacactttccaagcatcaaggaggcgccaacccgtgctacggtcggcttctagtggagggaactgaggcggggagagcttgaggtatttgcctggggacgtacgggagcaggaggtgggacccggacgtcctggctcagcgcagccttttccagtacccgggaccacgggccagcctgtgtcccccggcgccaggcagagcggtcccaggcacgcgccccagggggcttattgaactgcatatcccacaaaaaccctcactgacataaacgtgccctggctggtggcccctgcctgggaactggaagtcagggctgatgtgcctggccggccgtggttgcggtggtcagggccaagcgccggggctggggggccacttccaccctttcccacacgctgctgcctcagggggcacattccggggctggctctctgtgggtagaaccaagctgcttctgaggggctgaactcagcacccaagtcctcccctcgccttctctttccaccaaaccaaaggctcgcccagcctcggctgcagcaaggaagaggtggccgatgtgtgcaacgggggccaggacatgggggaataatgtgcccttgtgcctgctctccagggcgcttcatgttccatcccatgaaataagcgtcattctcagccctgttttatagagggggaaactgaggcatgggaggttcagcaacttcccacgatgggcacctaacccatgttaggcggcagagcttcatggctcaggccgccagggtcaggggccacagtcctaaccatgaagccatcctgccttgatgaatgtggcgtcaatgggcaccccggagccagcccccggccctcccctggctgttctgtcgtggggagagttgggtctcaggctatctctgagcatctcggctggcccccacctgcccttccctgagctggctccttatggccctgagaagtaaaaaatatccctttccttagcaacttgaccccaggacataatgaaggggg

SEQ ID NO: 5955 - DNA, 765 bp, mus musculus
caaaagtaagtttttaaaaaacctgcatgcgatacaataagatttctataaataaggatattggaataaaggtaaaatacagctggaatgctagggtttaggtagagacatttaggtagtagaatgcaccccctaaagccctataatttttaccttgttctgagcttcctgagaactaaagaaaagtaagacagggttggttatatgattcatgtcatctataagctaaaaataaatcagttgatctccacagtggagatcaagattgcattagattaggtctgccatgacaaagtaccacaaactgggtggctccaaacagtagaagtgtattttatcacaattctggaggctaaagctctgaaagcaagatgttgggaaaaccaagctctctctgaaatttgcagtggagaatccttccttgtctctttttagctgctggtggttcttggcatcccttggcttgtagaagcatcatcccactccctccttcatcttcacatgatgttctcattgcaggtgtccacattttctctttttacaataacactggttattttggactagaggcccaccctacttcagcatgtctccctcttaattaattacatctgcaatgaccctgtttccaaataaaatcacattctgaggtattggaggttagaacttcaaagtgtgggaacaatttttaacccatgacaaggattaagaaggttatgagtgtaggctatgaggccagactgtcttgctgaaatccagactcta

SEQ ID NO: 5956 - DNA, 735 bp, mus musculus
actataattgcttttgaaaacatattcataaatcagcacttccatacaagaaaagtggcacatgtgcagaatgattaatctgtaatacattttacaaatatttagaaatcctctacttcagtaccaggcactgccccagacaactggtataccaccatgtgcaaacaaactatggtctctgtcttactccacctggcatgaacaagtggaaacactgcaaggtacaggccagaaaaagatggtgtgacaggagtgttaagtaagaatatcggcattgaactcagtctggatctggaggtcagggtcagaaaggttaaagtttgttgaatctatgtgtgtttaaaacttttagacaactttgtactcattgtttaactagtattagataggttcttagacgatttaagtcagttttctaaaaggagtaatataatttaaaaaatgttacatccagttcaaggactcaacattctgactaggcatttgagtaaataatttattttctctaaatcatgggttcttcatctgttttatgagtctactaatacacacctatactgcttcatagcacagttgaaaggctgtaatgggagaatggatgtaaaagaagttagtaaatcataatatttacatatcattgtaattcactataagaattatcaattaccttttgctcgattgaatatagttatgaatgaagaacagtctagtcatgctagtcattacatggtgtat

SEQ ID NO: 5957 - DNA, 1567 bp, mus musculus
cccctttaaaaaaagcagcattcaacaaaattgtaaatgttctcttgttttgcttctatcacacactttgggcttgagttgtattttggaaatgtttgtgtcaggataaggcaaactcagggtgttcctaggtcaaaagctctaatcatcaaataaattcatcaccacattggttttattcttggacactcaccccttttacctaagaatgtagtatagcatattcaaaagaacaggtggtctacagaatactgggatttgaaacctagatttctatgagatgttgggcgagatattttaacttctcttaatctctccaaataataataataataatacctattgaatgcttatatgctaggtactgttcctggtaattttcaaatgttatctcatataataatcattaaaaatcccatctctccattttgaagataaaaaaatgaagcttaaaaaagttaaataacatgctcagaatcacacagctagtacagaataaaatctggattcccaactcatccaacagtttcagttccactgcttttaatccctactacttggattctgtaaactgatggtggcaccattgttaagacacagactgggagacttgatgcagggcatgcatctggctcaagcttactgttgtcagtggaccataggtgcccagagctctaactcatcctctgtttgacctgtcaacctaacatgagtgacacagagatcaactctccaaaacaaagagtttattcaggaagaataagggattgcatttctggatatgtgtgctacggcagaccataggcatatctgagaaggcataagcaagggaagcttttttaaactgtttaatttttttttagagatggggtcttgctctgtcagccaggctggagtgcagcagaacaatcatagataaaagtagattcgacctcccaggctgaagcgatcctcccacctcagcctcccaaatagttgggattacagtgtgagccactgtgcccaaggggaagcttttaaaggcaagaccattgtttacaggagattttcaaagtcgctggtgttggttcattggtggtgctagctgttgataggtgaaggccttcataaaagaggcttaactggaaagttctggttgggaaagtcctttgtggcagttcctgttactgtcatacctgtgtgagggcccttccttcatggcctcccagttccattttcttagggtttgacatgagtgactccatctttgtactgataattttcacagacctgagagagaatcaccccaaactgtcatgtttatacctttctatgtggcccaaatttatacaatcctgcaaaataaatactgaaccagccagtaggagcaatctgcttaccaggcaatccttctggaaaccttgcaggctacaagtcccaagacagccctgtaggcacaagtcctagagcgactcacaacatctggtcgactccacataaggttcagagttccccagggggcatctcaaccagttagcatagccagacccggagacaggggctccaaaactcagtcatctctgatgct

SEQ ID NO: 5958 - DNA, 427 bp, mus musculus
tggtttaaacccttggccctgctattcatccctggcttgtgtatgacctaagaatcactatgcaaatatcacaaataggcatgtttgggtgttttttgagagtatgttttctgatctgtggacttcatttctgtgtttccaaatgaatgcatttttatatgagtatttgcaagtctttcccccgctctgccccagagaagatttcatttccaatgggatctgtaatggcataaggaaggctcctgatttttaagagacttaaaatcctgcttcaagataatttaaacttaacccttctatttttgcaatattcgattatccccaggtccctctgcccacttattttctgacttaaatcataagtgctctcagagccaattttcaaaaaattttactttgaaatttttatttgatcagcagcctcaag

SEQ ID NO: 5959 - DNA, 176 bp, mus musculus
tacactttaatttaatttctattaacctttatcttatcatatgtaaaatgatattcaataaatgacagatggctattatgtttagctcttctatgtgcattaacatctgtcaaggtttcagtagaagtcagtaaatacttactgagtcattcatttatttatcaataattcaacat

SEQ ID NO: 5960 - DNA, 750 bp, mus musculus
ttaacttgcattaacctttccttcgaggctgacaaattgtgcatctgtggcttgttcagtctaatttttcatgtcattgccttgcaaagcatacagatttataatgtcaccatgtgatggatgcaggtccctcctttgccttggagaagggtttcatcccacttagattatgcattggtttatttatttatttccagttccacttaccacctatttctaagggcctccagtgaatttatctcccagaggctcatgttttgaggatgaatggaagggtaaccctgtcaggaaccattaacacgctgctgctgaggagcctccacattgttctggcctgtctcacacagaacagcctttgcctgttgtcactaagaatttgtggacagaaaatgaagactggtgaaggaaaattaggtcaaaatagtgtgtgggaagcaaagtgacattcttgtcaattttgcctaatctctaaaaaaagagcttacagttataatttccttcgacatggacagctgagacttgaactccattattttgttgtttttgttgttttaatttataattgctcccttcccctcttccccacaaactttggataccaaaagtgagcaagtgtccaaaagttctcagttgaaacttagaccagaatgctagggatctggggagaaagtaggcttagcagggctgagtgtcccataggtgttcacagttggtttccaaaatgggtttatgtaaagaatcaagggtgat

SEQ ID NO: 5961 - DNA, 9860 bp, mus musculus
gtagaaattaatgaagtaaattgatattattttaatgggtttatatacagtcaaataaatattagtaaaaatgatttgatatacactcagtataatactgtagatgtagagctatacaatttgtttggagaacaggtatttgtcactaataaaaactggagtgaggtgaatttgtaataaaaactggagtgaagtgaatttgtattcaacaccccatcatttcaaatgcatcttcttatcattcatcccttacttgcaagagacagccttgttactgtataagtctatttacatttcttatatctaacatcagatcttctcttggtaacatcatcagaaaagaaattttgaggaatagcaatgtctgaacataagacatttaaaagaagattttacattctaaaaatcatgtccactaaattactaaattgcccttcctcaggttaaagccacatgctccttccttgtagttcccttctccatttaaagcaacattcagctcagtctctgatttaataacaacggagacaccgaaaacagaattttaattccatctctatcattaatatattacatgaccttgggcaatctccaagcctcatctccttcatctaaagaaatgatattctcaactccatagtagcttactttacagtcttgttcaaaggaatgattagcaatgtctgccaggtatattgaacatattaagtgctagatacatatttaattacaagatggaatctttatgatattaaaggatctgctgcaaaaaaaaaaaagaaagcaaaataaatcatgcactggaatgcaggatcagagcaattggacatttttcttccttggtaagaaatttataagaaaaaaagaaaacaccttctaatgctacctgttgcaaaaaccaactaggtcagttttacaatagaattttttaagacaatgaactatgtgccccaatgtggtttatgttgaggcacaaattttgctattttgtgcagaactgcagaacacttatttgtcctactttaagtaaacctcctgtagaccaagaaaccatagacctgcaaaataatcagatgtgatatgcagagtttcccccatactttcttgtcatctcttgtactcagagagtgggcacaagaggtgaatggagaaaataaaaatgaattacactccacaaaagatgagggtaacatttcctaagtaaagaaataaagtcacatttcctaagtaaagaacagcatgggaatttctggatattagcatcgtagcactcagtagaacatttaggcctcaatgcatgtggtagactgtcccactggtgcatgaaatggctgcacccctcagtattaaccctcttgtgttgtcagttccctcctacattgaatccaagccaaggaagcattagcacaagtgatacaagcagagccttgatacacacttgcacttagcacttttctgcttggaactcttagaaaccagccactatgcttaaaggaattgaagctattctgtaacagagaggccataagaagatatcctacaacataggacaacacatatggtagacagctgagggccccagctgagttctcagacctgtgccaacaccccacaaagcaaaggaatctagcagttaacccctcaagtttccagaatttataaatacttattttaagcctccaagatttggggtaatatgctacacaggactaattaattgaaacaccacctattcactttcagctctttttatgagaaattcatagttaccccaatgcagtgaattcttttaagtttatgttgctttcgtatccatttcaaacacaagtttaactttcacatatgagaagcagggctcagtcacccttgatacagttttcagttctataccacacccaaatggctcaagccattggccagaaataagaactcagaggcatctctctacctaacagcctgggctcccttgcctatgaacttaaagtggctcaagcctcaaaccctattcatatatatatgtatagttcccaacttttctctctctctctctctcgctgccttacttttcattcctgcctcacgtgacctgggcacagaggactgctcagctgtctcattgtgaggttcctgctcaggatgtttaaggaaaaatcattgaacttgttttctattgggaagtattgaatttgaaacatctgaagaaccaggggctactccaggctaagtttccccgggatcctggggcatgagtggagggctagtggagagctgcaagatcaggttcccagccccagagcatagtgaggctgagatgaactgcacatgggtcaggcaagagctgcaagggcatctgccagtataaacatgtttcccacatgagcgaacccctggtcatgggtccaacagttaagcatgaggctgtcctccaggtaagagaagcatcctgtgaaaggtatactgttaacacccatatccagctccccttcgggttcccactggggagggttgctaggcacattgttattggaaccccaatttagcaggaggctcccccaatgcccaagcactaggattttccaagcttccctccctacactttgatctcagatactcctcaagcattctttcctgtggttttcttagttttgctttgcatcatggttcatctattaagagttggcatgaggagtgcatataggggataacacaagtataggggatcatattagattcagctggagggttttttttaatcaacactccaagaaattgggttcactgttctttctcttatatcttgatatggtttggatctgtgtccccacctaaatctcatgtcaaattctaatccctaatgtgggaggtagggcctggtgggaggtgaatggatcatggaggtggatttcccacttaggtgctcttctccttatagagttctcatgagatctgattatttagaagtatgtgataccaccccactctctcttcctcctgctccagccatttaagacatacctgtttccccttcgccttccaccatgattaaaagtttcctcaggtgtcctccccagaagctgctatgcttcctgtatagcctgcagtaccatgtgctgattaaacctcttttctttttttaaataaattacccagtctcaggtgtttctttatgagagtgtgagaatggactaatacacatcccatctatttacaagggattattttcttagcgagacacttgccctgaagataataagtgtcatcttgcattagtctgttttcatgctgctgataaagacataccaagactgagtaatttataaagaaaaagaggtttaatagattcacagttccacatgactgaggaggcctcacaatcacagcagatgtcaagagagaacttgtgtagggaaacttccatttataaaaccatcatatctcctgagacttactcactatcttgggaaccacatgggaaagactcatccccatgattccattacctcccacccagcccctaccatgacacgtggaaattatgggagctacaattcaagatgggatttggatggggtcacagccaaaccatatcactccttaagtacatagtaacagaaataaaaactggaaaaaaatgttctagccctttgattgaatactttcttggttcttgatcttatactctttcaggacatcacttacagaatctgcacacttggtcatcagtattggaggaataggcaccttcccccagcctcagccagcacctgtctataggaagtaaataatacaacaaaacataaacaaaaataggtcatttgaataatcttaaagttctgtcattgaaatatttgctcaaagatcatttttatttctagaccattataaaccaagactggctgcagctatcattgtacctgattcacagctatgtaatataaataagaacttttaaaaagatttccaaagtaaaggcaaggggactggcaagttttcaattaagatgtctcaacctaatttaagattgaaatgccaaacacaaagttggtcatttggtgaacacgtaaaagagcagataataaaaagatgcttttagtaagcagatgtgcaatgttaatatagaggttatgtcattttatcaaattccactattacagtggtcatatgtttattgtaataaactgtcatcaaagttttcaccagactcagctgaattatgttttttaattcagctttttccaagttgtcaaatattgaatgtgactgtgaatttttttggccagaaagggggaaataaagagaaagaagagaaactgggagtttgaattgatttattttaagaataattcatattggttatttaagtaactcatcagttaaccacatcaacacacttaatatcttctacttacatagttaaaaatgtatattttgcttatgttaacttgaaaagaggatatggagtccaaaaacattcagattataatgctttttaaataaaatttgacaatatcaaaagaaaacaagactctaggtccatcccatagtactttactaaagaacactcctgtcagtctaatctaatttaattatgttgaaagtggattggcttcgaagattgaggaaaagaaataatatttaaattatcttcatttgagtaagatattttattttgtcatacaaggttatatgtcatattattcatataattgatgaggaaaatctggtttggatatcatatacctattagggtgatgcataactggctggtgaataatagtcacaaatttttttcagcattgacttggagatggaaaagataaataccagcatttttcaaaagctgatgttgaatgcttggttggatttatctctcttatctaagatccagagcatattttcaaacaaattcagaattctccataaatggataaattaggtttaatgatgataataatattaaggtttaaccgacagaaacttagagaaaagagaaattcatagatattgtttagctctgggtccccatccaaatctcatgttgaattatgatcttcagtgttggaggaggggcctagtgggaggtgattggatcatgggggcagatttctcccttgctgttctcatggtagtgagttctcatgagatcttcttgtttgaaagtgtgtagcacctcccacctctctctctgtgtctctctctctctctctctttctcctgctctggtgtgtgaagacatgtttacttccctttcgccttcctccatgattgtaagtttcctgaggcctctcagccatgccttctatacatccagcagaattgttgagtctaaacctcttttttcataaattatcccatctcaggtagttctttatagcagtgcaagaatggactaatatatttacctaataagaaacccacacagatacaatatgaggaataactaataatacacctaaaagaatttaagaccatcattttatgtggaatttttttttttttttttttgagacggagtctcgctctgtcccccaggctggagtgcagtggcgcaatctcggctcactgcaagctccgcctcccgggttcatgccattctcctgcctcagcctcccagagtagctgggagtacatgagcccgccaccacgcccggctaattttcttttctgtgctatccactctttcatattttatctgtacatttggtccaactttcttcttctatcatcagtctactgaacacaatcaccagaacatgttgtttacttgaaatcagtacatcaaatatgagctaataataaaaaagtgatttctcaatggagttaaaatattcttgaatacttcaatcacatgaaaagtttcttgatttacacaacatgacttataataaaggaatacaagataacttttatgcaaaaattatataaaattccatataaggccaggtgcggtggctaagtgtgtgtgtatgtgtgtgtgtatgagagagtgagagtgtgtttctggaagagattagcccttgaattgacagacagaataaagcagatggctgttcccattgtggccgggtattatccaatccactgaggatctgagtagaaaaaaaaggcagaagaagggtgaattacctttgccagactgttgagctggcccatcaatcttctcttgctgatggtgcacctggttctcaggctttcagacacagactgcagtctatagcatcagctctctagatctcaggctttaaaactactccaggagctttactgagtttctagcttgcagatggcagactacaggactgctcagcttccatattcatgcaaaccaatactttatggtaaataccctactggttctggttctgtttctctggagaatcctaactaaatcatattttggtaccaaaagagtccagatgaacagaatgttaagcatgaggtttttaaattagttttagggtttctggaattggctctttaatttgattagacttaagatgctaatgacttaatttaattactagagctagcactgtaatccatggtgtgatctggcaatatacctataaaaatatgtgcattacataatcctaatcagccacttataagaagtgggatgactgtatatgatgcttttaaataactttgggaaactaatgaatataatgttgctgactggttggtcccaacatcagtgggagatagaaaggactctaacagttaggctggttgactgaaacatggactgaaaagtggcctgctataagcaacttgtaaatgctagacatgtgttggtttaatgtagagaaatagattcaaagacttgcaaatgcaaggagactgaaatgttaagagtgaatttgtcatttaaggcctgctcacccacactgggaagatccagaagacatacctttcaccaatactgtgagaaatatatctgtgaggagaacctcagcacccttgaagagctctgtaatcacctttctctatagaacagaactcccaatgggatctacaatcactaaattagaaaacctaaatgcaatgggagtaattggattccagtgtgacaagggcagcactcaaccaacaaaggcaaggtggatgtggttaccataatggacagcagagtcaaagtaagaaagcaaaatagtctgacttgaacagacctacgacattggctaattgatcatggtgtttctaaaagggaaatgaataggaagcttactaaattcttacttgatctgtacaagcagaaaagttctaggtaaagtcaacaaaagaacatggggcatgttctatggtgaaggataaattgttgcatctggtccctggttcttcctacaagcaagaaaaaggcacaacactagtgggtctctttgtatttcagaggcaacgtattcctcatttgggtgtattactccagcatatttattgagtgaaccaaaaagctactagttttgagtgggacataaaataagagaaggctctgcaacaggtcccttctgccctacaagctgttctgccacttgggtcatatgatccagtagatccaacagtgcttgaagtatcagtatcagacagggatgctcttgggagcctttggcaggtccatagggatgaatgacagcacagacctttgggattttggagcaggactttgccatcttctgtagataaccactctcctttagagagacagcttttggcctggttactgggccttagtagagactgaacacttgaccatggaccatgtgtcaccaagttacaataaaacctaagctgtccatcattaatttgtttttacctggtccagcaagtcatagagctgcacatgcatagcaacactccatcattaaatagaagtggtatatatatatgataagatccaagcaggtcctgaagatacaagttaaatgaagaagtcgtccaaatttcccactcattctacactatcttttctctcacagcctgcttctatggcctcatagagagttttctatgatcagtggacagagttagagaagagtcaggcctggtttacagacttttctgcacattgtgcaagcaccacctaaaagtggacagctgcagtaatacagctcctctctgggatatctctaaagaacagtggtgaagacaaacctcctactgggcagaactttaggctgggcacgtggttttgcggtttcgttggaaggagagaaggtcagatgtttgactatatatgaattcatgggctgtagccaatggtttggttggatggctagagacctggaagtaacattattggaaaattgatgacaaatacatttgggaaagaagtatgtggatagacctctctgaatggacaaaaaacagaagatatttgtgtcccatgtaaatgctcaccatagtgtgatcttagcaggggaagactttaaaaatcaccaggataaaatgacctgttctttggataccagttgtctttgttttccaggcaaccctgtcatcaatggattaattaacatagtggccatagtggttgcagtgatgctggttatgaattggctcagcaacatagacttccacttatcaaggttgacctggctacagccatcaatgcactgcttccatcaaggatggtaaagtgttctgaacttactggaatagacactctggatacaggtttgtctttcttgcatggagtacttctgccaaaactcccattcgtggatttataaaatgtcttattcaccatcatggtataccacagagcattgctttttatcaaagaacccacttcactgcaaaagaagtgagagaatgggcccaagattatgaaattcactggccttcccatgatatccaccatcctgaaacaggtagctggataaaatggtgaaatggccttagaagactcagttacagagtcagctaggtagcaataccttgcaagacgggggcaagactttccagagaatatgctctgaatcaatatccaatatatggtcctatttttaccatggataggattcatagaaccaggaataaaggggtgggggggggaatgagagtagtgccactcacaattacttccagtgactcactagcaaaattttgttttctgttcatgcaactctatgtgctattcactttgaggttttagttccataaggagaacttcttccaccaagagatagaactttgattacattaaactagaagctaagactttcacctagctactttaggctcctcatgtctctaaatcattaggcaaagaagagagctaccatgctgggtgggttgattgatcctgactaccaagtgaaaattagaattctactccactagggcggtaaggaagagtagatctggaataaggaaaatctaccaggatgtctcctaatattagcatgccctgtgattaatgttaatgaaaaactataacaaccaaatatagggaagagtactaataacacagtccccttcagaaaagaaaatttaactgactccagcaggtaaagaaccatgaccacctgaggtacttgttgacagtaaagggaatatagactgggagtgagagttagcgaaaaataacagcaacaaccccgtgactaggtacagaaataagaactgtaattatcttgagtatttcttccttattttgttataaatacacacacacacacacacgcagatatatatatatcaatgcatatatagatacgtatatatattctattttatctctcatttctttacgatgtgacataagatgtgttgactttatgtcatggtatttaaggattgttaattttacatcatagtatttaagttacaggatattaagaaaaagagtaaacatcaattaa

SEQ ID NO: 5962 - DNA, 318 bp, mus musculus
tatttaagtgcaacatcttaaggagagagaaagaaggaaaggaaaggagaattgcaactataagatgctttttggtaagctaggagtggggggcaatctgaaaatactcctcgtataataagctgtatatccttacatcatactattctgattactatcacagcactgccttttttctcattctgcctattccttcatctccattggcctcatatatatagtgacattaggaatgacatgggaaccttaccagagtgtttatcatgtaaatttggcagctatcctatcaaaccatttttgttaactagtttctttaga

SEQ ID NO: 5963 - DNA, 235 bp, mus musculus
caaaattcccaattttatcttatttctagagcatattaagcatagttattttaaactctttatctgatgactgcattatctggattgtcagtacatctatttatattgtctaagccttattttgattattaatcacatttcttgttctacatatgcctgtatgattttatttaggctccagatgctacctataaaaaattgccaggataatttgaggccttggacgatggtatct

SEQ ID NO: 5964 - DNA, 1054 bp, mus musculus
ccataaagtaagtctgatgacaggtgttgtattaaatttttatatcgcaatgaacttatactcacacaaaccaaatctgcatgtttcccttgatatacacctgcaacttgttaattcaagaaactttattaagaaagcataaatttagcaacacctatagatttgtaaagccctattagcttgcttgacaatctagagtaaatgtatttggggtcttacttgcatggtttgcaaagacgtggacactacccatgacttttttcaaaaggacgtgcttgcagatagcacagttccacaaattgatgtacgcatattacctagacttggagccaaaagagttgagagagatttgggtcctgtgtggagctgaggacatcacttacctgccagcctgcttctcgctgaagtacttttttccagtcttcttccagccttggggaggtctcatccattgctgatgctgcttgcacaaactggattcgccagcggctgttactctctctccttgcaagcttttaccaaagcagcagccagggcagtccaggggcagactgtcatggagaaaatgccatgccagaggatgagggatcgggcaggaagaacccaccggggaacaaatttgggacacatggggctacccagacagatgccaactggccaagctgaaggccagctcagccatcaagcgtccagagattaggaacaaccaagctccagggccggtggacaatgggtcattcttatgcttgtggtgtaaaggtcagaagagggaagtgtgcaggcttgctctatgcttgagaaatatgcatttctatgtgtgctcccgtcttctccttgccccaatacacacacacacacacacacacacatatgctcacacacacaccagaatttgcattgttctgccaggttgcatcagtgggctggtgtatcctagaagaaataaactattttacatagtagcaacacatttcatttgaatacatctcccccaaaaagcagcgtatgaatcactcagcagccagtgaacatgaataatagcaagctcctttgg

SEQ ID NO: 5965 - DNA, 1205 bp, mus musculus
aagtatgtttttcaagaatacttatcacccaaattcttctatttttgcctatggagaggtacttggccttctttccttttttcctggaacaatggttctcaagctgtgatgcccagaccaacagcatcagcatcacttgatatattagtttgttagggctgccaggcatggtggctcatagctgtaatcctggcattttggaggcccaggtgggtggatcacttgaggtcaggagttcaagaccagtctggccaacatggtgaaaccccatctctactaaaaatacaaaaattagcagggcgtggtggcaggcccttgtaatcccagctacttgggaggctgaggcaggagaatcgcttgaacctgggaggcggaggttgcagtaagctgagattgcaccactgaactccagcctggctgatagaacaagacttcaactaaaaaaaaaaaaaaaagttagggcatataacaaattatcataaacagagtggcttaaaacaacagacatttacgttctcacagttctggagtccagacgcctgaaatcaaggtgtcaggagggccatgctccctttgaaggctctgacggggactcctttcttgcctcttcctagttcctagagttgctagcaattcattggttttccttagcttagagatgcatcgctccaatctctgcctctgttaccacatacatggcacctccttatgtgtctctggatctgtgtgtctcttctcctctctttataaggacatcagtcatactggatttagggccagtgtgacctcatcttcaccagttacatctgcaaaacctctgtttccaaataaggtcacttttggagattcctggtggacatcgatttgggtttgagggggtgggatgctattcaactcagtacacctgggtagtgcaaattctcagcccccaccctagacctactgggtcaacaagcctgggagtggagcccagcaaactgtgattcaataagcccattcggggatttggaaccctctaaagcatgaggacaaatgtcctagaaggggctgcacaggcatcttccaacttcagtattcagttctcatataaaacatgcaggtatttttccatttaaggagaaaggagggtttgtgggagtaggggctggactctgaagcagaaatgaacctgcacctgagctctgatgaccttaccagtggtcgtg

SEQ ID NO: 5966 - DNA, 1351 bp, mus musculus
gatatgctgatggtttcctgtctactgtttccacagctggataaaaaagttatcagccaaattgcaatgaacgatgaaaaagcgaaaaacaagagtcttgtcaagatttggtgcaaaacttttaccaacaaggtacgtttccaagaatattcccggggcggggagtgaacctttgcatctgaacatgaaactaaatcttgccttcaaggaaggtaaatagaaagtcaggggaaagaaatattgggagtccctgaaaaatcaaaagtgaccagtgaatgcctttagaaaacaagtccttgaatgaatgccaaatgcaggtaaacagtaggacagacagactcccttttgccccatcccagggatacattatttctggtttgttatttccatgcctcttggagaaggcttagctctgcctgccgctctgttctcatttttggagagacttgtggaagtagtccagcacgccctacgggtgttggcagcaagtgtcctctctcttactttccagacttttccagagtattccccctgctcgggcccagagcattcatgccctctgtcaggaacctacccaggctgctttgcacctgggttgtggcttgcccttgcttctggggtgtacatgtattttttttgtggggtgctaaagactggagactagaataaacaaagtagatgtttttaaatgatgaaggctgatttcagttgtcctcagttattctaagatttctaataaaggtgagaaataagtcttcaagagaaaagaactgttctgttggggccatactgcatgcaccatgggtggtgtctgcgcctgttcattcccacccccgccattgcctcccattccccactaaaagccagtgttgtgggcatttgtcatgtttgtcatccagacccagattaacgtcactgttccctcgactgctaactgcacctccccttccctctgttggacggatggcatccaaaactggaccatgaagaatgtgacctacaaggagaacatcgccaaatgtgagtggagctcagtggattggccactatgacaggtgttgtctgggggtgacctatttatccgtgtgaagtcccagtaagtgaaggaaaggacagtaggagtcaccaagcacctgccctacatcaagcagtgagcaacatgctttcacagcagaggaaactatggcttaggaactgaggtgacaggcctgaggtcccacagcaagggcagaactggaacttgaagtccatttcctttgccagctccacaccacctcagaaaagctcaacagattctagaggattccctctacatgctttgttcagattcctttagtcaataactctaggg

SEQ ID NO: 5967 - DNA, 1351 bp, mus musculus; identical to SEQ ID NO: 5966

SEQ ID NO: 5968 - DNA, 172 bp, mus musculus
agagaaaatattatatattttcaaaaagaatagctcaaaatagtattatcaagctgcaaagccccacattcttttctctttattaatcatgtttctgacattttaagattgcatctctaagatgtaataaaatcttattattcttctaatatctagaaattaataatgtaga

SEQ ID NO: 5969 - DNA, 486 bp, mus musculus
catacatagtttcataaattttttagataaaacaagagcattcaaggaaattttgagctaagaactattgtcttagtgcagtctttgtcttttttcttctctcttctcctttgtgtcaaacacttaattcagtgtcctgtttaaaaggattctccttgctaagacacccactttgttccagggtccatggtcttgctctgtccactacacggagtttgtttcaggattaagtcttggtaacaggcttttggtccctgccctagtcccctttcttgtgcacggcatcttacagtgggcccgccagttatgcagtagagctccttgctgtgcctgcacatttggctctgctcccaaattactgggcctctgacatttccaggcctataacttgatcctaattccccatctgtgtccatatggacaacttgctaacttccataatggatggagacaggtccaactgcaatcttcaatttgatctcaagg

SEQ ID NO: 5970 - DNA, 729 bp, mus musculus
tggtagcctctgcatagttgccttgggcatctgcctgccaggacctctgtctgctttcctaacacaaagccccctcagggagggttcttcctcattgggtactaattcaggcacctccataggctcttgcttctctcaagcagtgtgtgaggtattggattttcgggggtaaatgtagataactcatttttctttttttttttctttttttttttttgagatggagtctcactctgtcatccaggctggagtgcagtggcgcagtctcggctcactgcaacctctgcctcccaggtttaagcgattctcctgcctcagcctctcaggtagctgggattacaggtgcacaccaccatgcccagctaatttttgtatttttagtagagacagggtttcaccatgttggccaggctggtctcgaactcctgaccccaagtgatccaccagccttggcctcccaaagtgctgggattacaggcatgagccaccgtgcctggcctcatttttcttaaatgtctaaatatgttaaaatatgtatgtgttatgttcataataaaataatcaaataagtgttaacaaaaaatgagaattatataattagagcaataatccaattaacacaacagtacagcagctttaacaagaaattgattagacatgcaaaatttgtaaatgatattatctggagaattatattggctctgctaacagatgtctatttttaacatt

SEQ ID NO: 5971 - DNA, 642 bp, mus musculus
aattaaacatggaattggttaagagaacaaaaaaataacagaatatatatttgtttaatgaaaaccttcttcattaaaataagtttcttattattacgattgtttctataggaaaaggttggttaaagttgagtgtccagagatcaacaatattcacttcacttttcaaagtaattttcctaaaactgatctgctgtttaatatggaaatatattagaacttgggtgcagtggctcacgcctgtaattccagcactttgggaggccaaggcgggtggatcccctgaactcaggagttcaagaccagcctggccaacatggtgaaacccctatctctattaaaaatacaaaaattcgccaggcatggtggcacatgcctgtaatcccagctactctggaggctgaggcaggagaatagcttgaccggggcaggaggaagttgcagtgagctaagattgtgccactggactccagcctgagctacagaatgagactcaaaaaaaaaaaaaaaaaaacatattaggttttcttagttctgaatcattttagttcaccatggtctgagagtcagcataggtagtgctcttctctgttaaagaacaggccaagtattctttgacaatgcaataggtagtataatttt

SEQ ID NO: 5972 - DNA, 477 bp, mus musculus
gatgaaggaaaagcacgggaaagataaaggagaaacaggaaatggaagtaacataatcaggtaaattatgccaactatctttgctcagaacaaggggattgcgttcataggtaaaggaaatgagagcgaaaccggcaaatgtttgcaatggacattgaaacaaaacttaagacatgttagtatggcacttctgaatttaaggagatagtgggctaggcagtgaggtcaaggtttaaaagcagagcatttaattggcaaagcatatgtggaatgaaaaagtacagtctttgactctcccattcagacctgattattggcaacaccagaatcgcagtttgcatggaagctggttatggtttaaagaggtctggaggttgtaaaaatagactatgacactcagatgaggctcctgcgtgtattttatatttcactatccctattcttgtcctgacatctaaagcttccccttctaaaaga

SEQ ID NO: 5973 - DNA, 374 bp, mus musculus
ccattattaatggtacacattaaaggcgttgttacctaaagatccttctaccatctgatttgacttcattttgtcaacctttaagaaataattacctacacttactagttcaaaaacacatggaaaagtcacctctagttatcactcgagaatgaatggaaatgttttctaggggaaataaaatgatttacaaagcatagtatctggggtacaattttaagtgggaatagatttctgttatagtcttatgtttttatgaaaaagacagcattcagccgatgcaattctccccagtgtggaatcttaactcgcttttccttttaacagatccagatagtaatgaatttcagctcatattacaaccacagtttttg

SEQ ID NO: 5974 - DNA, 493 bp, mus musculus
gaagaattttgatgtacaaatttatttgatgatgagtcaggagaagtgatagcccaggaactgactttaccttgacaagaacaaagatgactgataaagacacaaatcaccactgcctcacaaaaaacaacagcaaaacttaaaatttttgaacttgtcacgtttgtaacctggatatttaagtacttcacgtttgctcttttaattgtcacatcactgtgaagttatagaggctttaatgctcctttttaagtccaaagggatgtttcccacagcaggcgctttccatttatgagaacttaacatgtttcctgccctaacagtttttaaaaaaggaaaaagagtgacctgtagaaagcaaaatcatctgctgccacttacccaccaggggaaaaaaaatccgttctttatattatctaactctaaataatttaagtaatttactttaacttaggccatgaaatcgactattaactatgtctctttcttaaga

SEQ ID NO: 5975 - DNA, 273 bp, mus musculus
ttaagattttctcattttattttattccaaagaatgtgttttcccttttcaagaggaacaatactaacatgttctcctataagtctccctgtaatagctacagcagaacttaaacattaaccctaaaatgttaaattgtgaattatcaccaaagaggttttaaaattatgtctcctgcacagaggattgctggtgcttacagaatagaaccactaaaacaaacacaaatttactgagttctccaattagaaagaaagtattggagattcaggc

SEQ ID NO: 5976 - DNA, 1230 bp, mus musculus
ctaaatatatacagcaaggtaggagacaaggaaagctcagttactttcagggcagctgtaaactaattatatgatatacgcagtcatttttccagactatatatttgatttttagttggaacactataggatataccacttcataagaaaagaagaaaaaaaggaggaatagtagaaaatgagggggaagaggaggtggaggaagaagaggaggactccttgagtaatgacttgggctacatatagggccatatttactataatgaaagcacataaaatatgaaagcatggcaagcatgcagaaaattatgaccagtgctcttgtcacatctgccatttcagcagaattatactcacaactctggtcttctttagctatgaattcacatctacaggtcttcttcttctttactcctcctcattatctttggaatgtccctccttttgtggttaccagctattctctcattgaatcagatcaaatgaaacaagttttcattcaggtttctgggatgtttagtcatgaaactatctgcaaggttatcagtctttaccctgtttcctgacttttctgctgtcatgcctaatcaagaatgctgactgctttgtgaatgacagcttcaaattctccaaagggaagacatctctccactcaatgcattccaatgtagcacatgctcacagagctaatcttgcctatcacggtgaattctttaggttactaagctcgtaattaaaagtcttcactaatgacatggtaattgttttaatgggtttccaatgaagtgtgaagttccctgctgatgtgtcaacaaaatatgaagcattgtgagaaaacgatgtaaagcttcatagaatgtagcattagaggagaccttaaaattatcaagggtaacctttccatattagaaaagaggaaataacttcagagaagtgatgtgtgttgctgaaggtcattacactgagtggaaactgtgggtgtcctgactcctagtactgtgattcgtttccatctcactgcctactaattttgacctgctttttatttatattgttcctgtattaaaaacctgattttatgtttttcactatatcaatggaaatatttatttattctatcaataaaaaggtgcataagaaaacaatttattacattagttttatgggaagattgcaaaggtgactttggggataaaaatctacagagctgagaatttcttggttgggtgc

SEQ ID NO: 5977 - DNA, 166 bp, mus musculus
atatatttaagagtgtttataaataataaattttaattagctaaaaatctttgtttaccttattataggaaaaatataccaatattagtatttcaaatattagttgttctaatttacctgtaagtatctgtattgaaaacaaaataatagacaggaaaattcagta

SEQ ID NO: 5978 - DNA, 350 bp, mus musculus
gaaacagaagacatctaggtattctaaaagttgtacagttccctctcactctaaagagaggtaataaaatttccaaattaaattcattagactaaaacttgaatggaataactatagagttttaatgtggaaagaaattacctttagatatacaaaatattataaaactggaagaaatcatataacataatttaatttaattcagccataatggaattcatgtactgcaacattcataaaagtgtatatgtacacacatatagacttgcacatgtctatatatgtgtatatgtacatacctatatatgcatttatatatctaatttacacaatagtttaattagtttaaa

SEQ ID NO: 5979 - DNA, 617 bp, mus musculus
gaaaactgaatagatttgagcttccaatagagatgtggactttgaggacaggtaatttgtacatagattaagtagttatacatttttaaatctgaaatactgagacaaaataatttctgtatacactgaactatgataagagatttagctttaaaaggcacctaatccaaacaagccacttgacaatggacaacagacacagcaaaatatagaaatgaggcccaagggaggaaaaaatcaaacaaacagtggagttacgaaaaaaaaaaaaaacaaaaatcttaaagataaacacaaagaatagcacattatgctattcatgttaaataatattgatattggatgttgaaaacattttctaaccctttagaaggatccagccatcacaccggggcctgtcgggggctgggggctaggggagggatagcattaggagaaataactaatgtagatgaccggttgatgggtgtggcaaaccaccatggaatgtgtattcctatttaacaaacctgcatgttctgcacatgtaccccagaactgaaagtacaattaaaaaaaaagtagcaatcctcctgaatgtaagtggcatttgctaccttggcattttttttttctct

SEQ ID NO: 5980 - DNA, 431 bp, mus musculus
ctctgaaaatagggtagaaatagggggagagaaggctttgaaaaatggcaatactttggcactgttgcaaaagataatgaatttttcaggtaggcagggtgagtggggtttttcaggtggaatgagtagctcaggctaaaagagaaaacatagttattaggtggctattgttagatcatagtgtgttagagaagcaattacaggtgaaactagagaggtaagcttggacaagaacgtggatataatttaggaatttaaaattcttactttgggaaaacaggagttgttagcatgttttaatcagcagagaatatggaaaaagtataccttttcttggttattcaaagggtaatgagaaagttacctaaaatgagtacaacacatgagacagtacaacacttacacagctggcacaataataggtattacat

SEQ ID NO: 5981 - DNA, 135 bp, mus musculus
ataagatctggaaagccctaagctgtggaaaaagctgccaagtccagtttataccaagctttggtggaaaagttatagaagttgattattagtaaatatctgccactaaaaactctgtcttggcatttgcatacc

SEQ ID NO: 5982 - DNA, 994 bp, mus musculus
accacagtcttcaaatcattgttattatagaatgcaaaaatccttaagaatatcaacattattatgagtaataatattactcatatcattagtattaaaaacaattatctaagactttactgctcattctaaattttaaggacataaatggatcatgctacacctatgattactcctaaaatgtttttcctgcattataaactaatgaacaaattttaaaaattaatatataacttatttcaatcaagtttctaaaagaagagtaaaagtcttccataaaatttgtctataatacagaataaaaaagagattttcatagctgtattataataattgtgagatgtgttgttcactaccagtaataatgcaaagtttgggttttttttttaaagttccagatcacagaaattaattgatttagtttgtaaagtaaaatatcttcctttaaaatatgtacagatatgtaataaactacaaagaaacatttctacttgcttcaataagaatatgctttttcaaatgggaaaaaaacctttatactggtaagtatatgccagttcatttcacctatactctgcctattttttttctgagaaaagaggctaacaactcttgtgaatatgtaatatgaagattgttagttatgtgaatctctacagaagatacaagaaaagaaatttattgtgaacaatcagcttaccagtcatgattggacattgtctgtagttacctaactttttctatataaagagctagtatagtgtttgtgtgtgcacgtgtgtgtgtgtgcgtgtgtgtgtgtgtagctgttagggaggagctgatagataaaaagaagctaagcatgtcagcatatgtaccaagaaaatgtcttaagaatatgtagtatatgcaaaagatgtgctaaaagatacatcaaaatacatttttatgtgcaatttccttgttttcataatggaccatgactaagctgggggtttaggaagccacaaaa

SEQ ID NO: 5983 - DNA, 1225 bp, mus musculus
ttccttccttccttccttccttccttccttcctccttccctccctccctccctcccttctttttcttttcttttcttttctttttttcttgcaattttttgcccagtctcatggacttctggccaatgcatgtgcaggttggcatatagccaaagactcacagaaaaccctatgcaaattatgaaattccttctccccctggctctctcctctctggaattgtaccctgtaaattctagtcagttcagcttccctgaactcaaattgctgtctctttcattcagtgagcatgccaggttctatttccctatatcatgtactgaaaactggctccaggcagaaagtcttggcaatggtagagctcaattcagtatgttccttattttagaaaatactattctagtgctgcttgttacctgatatctgcaaattgctggtttttttttttacatttttaaaaaatcgacacacaaaattttatatatttaaggtatacgatatgaagatgtagtatatattgtggaatggctagatcaaacaaatagcatatgtattaactaaaatacttataacttttttgtgtaagaaaacaatatttactctctttttctctcgatatatatacatatatatatatagtcacatacttgatcaattttttccaggcatttgtgtcagaaaagtaatttcagaccctgttactttcttatgaacataagtggaagggctatatttcactttaataccattagtcttacaaaacattctttcccctcaggctcaaatatgacaaccgcctacttgaaacactaaaatggctaatacctgtataaaaatatctaaagttattagttgagtttacaatgcccttcaaaatctcggtctctcggagcttatcaagtacatctgtggctttttctctttgtaagccaattttaattttatttaatcttatagtatttattgtttttcaaaaatcccttcagattttctgttctcaacatctgaaatctctacaagatacaaatttaatatatgcacaaagcatcctgtatttacaaataacactgccaaataatggaaagtccattatttgtaatgtttccatacactacaaagatattgagagagatatcattgtcatgtatcgcagtttgccaagttcccttctcagtgtctttcaaatatcatcttatttcttttatttaactacacaagtgtcttc

SEQ ID NO: 5984 - DNA, 412 bp, mus musculus
aagcagaatttcttcttctgcttgattccccatgtgttgcttgcagctggagtggaagcatgtaatctgggatccctcaatcagggaagtctatgctttatatttttggacttgagaaacataaagaaacaagatatatgaggaagaaagtatacacagttttgatcatttctgtatatggggtttaaaatagcatctctgcagccagtaacagtaacagagtttgtgtccagtctccagtatcagtactacatgtgtcatctcccctaattcactggggtgcagcctaggggatttcactggatccattcaatttctgtagctctcatgagtatgtagcatgcaaacatgtttttcatgatctcctatagagcctgtttgttacctagtattttgtgattaattctccttc

SEQ ID NO: 5985 - DNA, 687 bp, mus musculus
atattgagtaatcagcatttaattccgtgggagaaaaatcaaattcttcatgaatttcaaatgttttctcacaacttaaattacatgggactaataaagaattatgtgcaaatatgttaactcctggggtatctgagttgtaaatttagtttcagttattgttactgttctcaatttcaaactcacccttcgtgatgtggggctgacaccttccaatcatatttctgctgtgttctcttggcttctgtaagtctctcctgtaagccagtagaaggtactagaaaagcactttatgaattgaggaaaaataagaaatacactccttcctgtttattttgtcttccttgattttgcttcctgctgctctcagcatcaccgtggcaatactttttcaccttgacagtgacatttcatttcaataacagcagttgatttcagtttgcatgtttcccaacactttcagaaacaacttcatcacacaccacccccccgccgctccctcccccagccccagagacatcaacttcaatgcagggagcagtaactcctcagacacctaagtttccaacacctgagtttctgctttgcaaaatccctactccatctccaaagttttagtaaccccaaaatttaattgccccagccttagatggaaactaccttcagtagttactatccccaatactt

SEQ ID NO: 5986 - DNA, 305 bp, mus musculus
cccttttctgaaggtgtgacatttctctaacttagctcagcttttgacagtggagaaacatgggcttcctcagtttaaaagggccaccaaatacaaagaactagcagaaatgtttatatctggggttcagctgagcagaaatatatgcctgcaatcatccagtgcatctcagataaagccccagagaaagattccaatagcagaaacaaatacacaaaaaaaaaccttagtgtattgtaatttcctattactgatttgtcacttgagatattagcatattatacaaattcacagtctcaagaccc

SEQ ID NO: 5987 - DNA, 1023 bp, mus musculus
ctttagacttcagttttataagtgaaacatttaaatgtctgttttgactaacattacaagctttgaccacattgttaaaagtaatagctgaaactaagtgcttgtgtgtgctaagctaggctctgtttaaacacttattatgtactaggcattgctctaattggtttacatgtattaactcatttaatcctcacaaaagccctgtgaagggagatgcaagctgaagagccaaataggaaatccaaaggtctcatttattaatggcattttatgagtgtcatagcatttatttaaacatagagttgtcattggtaatagaaagttaaacagaaacccaactcatgaatctgaaaatgatccattaataatatatagtattgtccgaagcctcccagctgctgggaacattgggaaggcatgatatttgtcttcaataaaccattttctttgtcaggttcaccagcttattttcctttcccctataaacatattccccttgcttttgcccttgatttaataaacataaaaagataacatttagatccattcacaagaaactgtatatgtaatattttgatggaaacatatctctttggggagtgtaatgcggtagaaagtagacatttagtaaagagtaaagagtaataaaggtaatctctcaggaagtgtaatatttatcacttggacttttttccttttagttttgattacgaagatgcaggctaccagactgcagaacttgtaaaaatggatattctactgaatggaaatactgtagaggagctagtaactgttgtacacaagtaagttcaatagaaactaatcatggaatgtgaaaatacttttgatatgtttttcatttatttttgtttgagcagctgcatttaaaaaacttctaaggtaattaaaatagagttcaccctactaactttgctttctcttttttttccacacttctctctagactgctaaaaatagaacagagctataatagtcaaaaagaacagtgtcatagaaatgttt

SEQ ID NO: 5988 - DNA, 426 bp, mus musculus
agccacagttttcatagcttaagtggttagagttagagttcaggactgccagccagctggaaattgaataggaaaatacttgaaaaagaggaacgacccaaaatctgcatataaacttctctcacatcgttggataaaccagaactgtgcatgcacagtggagattccaaggaatatagaaagaaaacctgcctgtaggctgaaaatgctaagcaaagatttgaatttctgcccagcacaaggatcatgggaattgacacttaaatatttccaaatgagatttgcttttaattgaaaccccagaagggctatgacttaggaataatgattatttcctcaggactaggctaaactgaaacaaatcctccccaagaaattataaaatcaagcccacacaagttgaagatacatagtaatttagttatt

SEQ ID NO: 5989 - DNA, 1996 bp, mus musculus
agcaggatccttatgtcagtgattgctgaagtttccaacaagctaatttgtaccagagagacaatgtaaacatttagaaagggggttatatttctgttctgtctgcatatgtcagatgacaaccagagtttcaaagttcaatcttatgaagggttatattgcagacttggcctagaagtccaaaatcattaaaattttttgcaaaattatacctgaaaattctttatgttgtttattagtagtcattatggggtttacaaagataataggatataaagtgatttccaaatctggtgcaatcacctgccatttacaatagacaaaattgttattttcattaggttttaatgaaaggaatgatatataaatttttaaaggcatgtttaggttcatgaaagaaattcagattatttttgcatccataaagaactagtttgttgagttgatttaggaaccaaattgtaagacatattgcaccaggcaatttattttctgagatgaagctcaagtaactatgagcacaacatcaggaatgatgttcttatgttcccagatgtctctaggcatctttgcactcttgaaaaatactaagttccctgtacctgaagagattcatgaatcaaaaagaatgtgagcccttgagtattcaatatcccttcaaaccttagaaattgtctgtcaatgatggtgattatcatctcacaagagtatagttagcttcttttaagagacacaaaagatccctctgagttagccctagacacacattactccaattgcctggagaaatgtttagcgatccatacagaattactctaaattagatttagagaaaacatcctctctttgaagaacactagaattgaggaaaatatggtagagcatataggttattttgcctctgttactttgaagaccttaaatcatggagtgtgttagaacacagtatatttatgacaatcatgacagttcagagaaatgcgatgaggtcgtttactctgaaactgaatcaacactagtctctgctctgagacccacaaaatcagattgtctgtttatctgttttatctgtatgatttctattcctctcattttgttgttgtcctatttataaatcacctttgctaaatactaaagttattactataaggtagtgtcccaggtctgtttggtaataatgaaatgtccatggccaaatcccattgctttgttttgtcagtgtgctgcaagaaaattacttcgatatgccctctcatattagaatacctacattttacatacctattgcctatatcaagttttgaatcataccactttcaggtttaacctggccacacagcatattttctctatggttgctgaacacggaataatagtttaatgattcagataaactattttgcagaaacatttaaaatcagaaattgcagaactactgagtatctgaattttaaagggagcctcttaaccatattttgttttctttagtactcacactgacaggttgatttactacctcattttcccaacaagtgttaagtttccaatatgcagttaagggtttctgaaaacagtgactatttaatcacatccttatagtttccccaaattgcttatagtttaccctcatttagttaggtctataatatttctcaattagggtaaaaatttctattcctttctaattactgatgcatataatatatataaaaattaggtagcctcccatgaaaacttaaaattaagagcttttagcatcaaaatatcagaataaaaaattaggaaaactcatcagttcagaaagattttctttaaatacactaacgtgaataaaatgctcacagagaattactcacatctaaggatacagactttttcctaaagtgaaactattcttggctcactcagactctggagagtgtttaaatgattttgaagttcactggtcaaagtcacagttggtagtaagaatgattgtcccagaagagaatggaaa

SEQ ID NO: 5990 - DNA, 673 bp, mus musculus
tataaaaggtagggtaacattaaaacataggacaagtttggcttaaatatttgaggaacaggttttatgctagcagaggagaacatgaggacagaggaaagggtaaaagatgagaaatttataaattttgtttcaaaccctagtggtagccccacacttgcagtgaatatcgcctgaaaagccaaatgttgatagtgtctggctaaggcagtacaggaaagcacaagccttgcttcaagaatcttactgactagctaaggaaacactatgtgtgtgtgtatatatatatatatatatatatatacatatacatacatatatatatatatacacagcaatacaatttatagagtgttaagcactaactacatgaccttgaaaatttattttaaatttctccaaacctcagtttcctcatctataaaatgaagataatacctatcatctgtctatttctatgatctatctttttcatcagtattattaccatttgtcatacatggcactgggaatatctatgctacggctaattaaaagcatccaagaaaatagggtctaaacatcacctaatcaaataatgtcaaaattcactaggtcatccacaatttattgagcacatattcagtaccagtactgaatatacaaaaatgcatttacataattctccttctct

SEQ ID NO: 5991 - DNA, 1553 bp, mus musculus
atctagaaattctgagaggggaaaatgtgattttggatttacaatgacagggtaatattttatttatcttcgaattccatggacaaaattaggctcacttaaattaatttttgtaaacccaagtaagttctaaaaaaaagtaaaaaatacatagaatacttgagaatttagcagggacagggaaaaatttcccagtaagtctgaagtcttgatgtaagtgggaattagataactaattggaggcattttattttaagttaaagacagatttctttaataagtttttaaaattgatcaactttaaattaagcacagtaaatgtgtataaatatgaaggcaatcataaggattttttcacttgtgtttccatattctggcattagtatatcatcataaaatagacaatgtttttgtctcaagaacaagaataaaattgaaatctgcattcatgccaattcagcataaaaaagaataggctacagttctctcacaccaagggccccatagttataaatgtgaaattatattccaggtcaaaatttgtgaaaaatacacaaaacactttgattttacaagagaggagctttaaataagatgattttagtagattgaaataaataaccagtatttaagtaaatgtataacgaatgaataaatacatgcataatattttcaaagttctataccagtacctatttttactcttacaaaatttcctgtaaaaaaatactacatttgaaattatttcattggttttagaactggcattgaaggtacccagtagactcttaagcctttactgcttgtctcactagaaacatttatttctgacctaccaagttttcttcacatcatcaaatttattcagcttctcagtgctgtaccgtatgatggcaagacatacttggtatttccatttttgttggtcattctttattgctttttactgctaggaaggtcttgccaggcttctatacagttacaaaaaccattaccaaactttatcaaggactttccaaatggagttttcaaatactattgaccacattgctctagttaatgtaaggtcagctctgactttttgtgtttgcatttcggaagtgaggtaacctcattcaaatatatatgcagcactttctgtgtacaaagtactgttctaaatacaaaagggaatataaagatgactttcaaggaacatataatgtagtcagaaagatgagaggattagttatacaatttaaggaagggaggataactttgggaaggttttgtggaggatatgtgtttagagatgcgagctggggattcaacaggtaagagggagagagatcacaatttccaactgggtaaacagcttgaaaaaagaaacagaagcctgggcacaaatgaaaattccatattaattggaagttaagattcatatagagacaatgaaaggttaggttagaacaataaactgagaagtacgaatgtggacttcaggaggctaggggaaattacgaagtcataaaaagttcacagagatacttgagtacaaaagatacattattaaa

SEQ ID NO: 5992 - DNA, 375 bp, mus musculus
gccctttgaaagcaagggctgaatttttattagtttaataatctgggattccaattgttgaagtgggattccaatggttaatgctcattttagtcaagttctaaattcttgctcaaaattagatagctaagtatcttactagttaaagaaagaagaaaattgatgtctgtagagtgcttgctatgcctctttagtgaactagacggttagtatttatagtcgggttgtactttctcaacaacccataagtctagatgttgattaacattatcataattcacaaacattaatcgcttattccttggcactataacacaatgcatcatgtttgtcttgtcttttcttaaagatcaaactactagcaatcatgttaat

SEQ ID NO: 5993 - DNA, 534 bp, mus musculus
cttcaggacaagttaaattattttctggaaaacagccaaatggcttcagcaattttttggggggtgttgagagtggggggtgtctgtttaacaatgtaagtgctaccaatcggtgtcacagtagaacttgagtttgttctgctgacttaatgtgctgttttactatagatggagtagatttgtaatgaatcgtgttaataggctaattcaacatatgctttatgaccaattgactacttccattggtaaagactaggggggagaggactgattttaaaaatataaaaactgacacaataggtgacttaatgaatcctcttctgctacatatacatgtgtacacacagtttctttatacataatttggcaaatgtgtaaatgaactttattaattttaattatttgtagaaaattttgagagtgattgaagaatcattctcaaatcagaaacaagagatagagctcatgttgataccttctctgggctacagatggagctgaaatttcagtatcctatgtaccaaaggaaaaatg

SEQ ID NO: 5994 - DNA, 534 bp, mus musculus; identical to SEQ ID NO: 5993

SEQ ID NO: 5995 - DNA, 857 bp, mus musculus
cttctctgctaaaaccctcaatgacctctcatttcactcacaaagtccagtccttatgatggcctacaaagactgacatggtagcctaccccaccactgcctactgtctcacctcatcccgctgctattgtctcgccgctgtttcctgctcctgccataccagctccttgcttctgcatgtacctcaggacattttcactaggaagccctctgcctagaacactcttcccccaaataccttcatggcttgcttcctcactttcttcaagactctacccaaatgtcactttctcagtgacatctttcctgaccacccccgacaactgcaaagctgcccaccatctggggcacttcctaattcccttctctgccttatttttctccataatgtatgtcaccatatgacaaaagatatattccacttaatggctttatttattgtctgtctctgcctggtaaaatgaaagctctatgggaccagggacttttgtttattttttctgaagtgtatctctggctccaccaagggtgccttaccctatagtgggtgctcagtaaacaaataaatgcattggtcattctaactctgatttgaagaccttgctctttacaaacctccatttattactgtaatgtttggaggaagcgtcttaaccccagtcctattcaggcagttgactgtggcatgagaagtaaactgtgccaggaaatgcacagttcaccatcagaagccccagaggtattgctagggcaacaaagattatgttttagccagtttactggttcctcaactgtttcctctcatcattcataaatttgctgcagagattggcagagaacaaattggctcaggctgc

SEQ ID NO: 5996 - DNA, 730 bp, mus musculus
aactacaatatttgatacataatttcagtgcaatgtggtctgactgaagtttaccttcagattaaaaaactttgccttgaggaaagctgacaggtttctctctcctcatcatgtacacctcaaggccctcctaaagagaacaaattctctatgggtaaaaggcaacaaagttttcaagaacacaaaataaaccaccccagtagggttgggtcctattaatggccccatttcacagggaggaaatactctttgatttctttctctggggcttagagatgtctcttgcttggagacaagacctccacagtccatgtggagctctgcttaacaaggtgggctcagcttagcaatggcatatggcttgcctctgcttgttcacattaccaaggatgaagagtaaatagggatttggggttgatactctcaccagagggtatgcatttggctggactgccaaatcctgggatagtggcagaaggactgacgccattcaaggcagagatcatgaccctgaccatttctgtctttgacagtgactaactgtagatgttgttcttttgggctctggcttttacttttacttttggcttttacttttcccaaggctaggatcctaggatctcatagctctgcttctggctgggatcctgttccatcacagttagattatttttacattaggttgatactatacaccctactagctgtgtaatcagaaatgctcatttca

SEQ ID NO: 5997 - DNA, 245 bp, mus musculus
tatcagtttttgtttagtaatttctcgagaggaaatacaattgatccatctataatgaaactagaaaatacatttatctcacttgccactttcagtaaattggtaatgattttgtggagtaccagctggaggagaaatcatgactgttgtgctcacgctcagaaggaaaaattatcacaacccattacctaaacctactctgaatttttgtgaagagatgttagcatagatgctactcctttgca

SEQ ID NO: 5998 - DNA, 265 bp, mus musculus
taaatatttaagctttttgattatatatgtttaaatcttctgttatagctatatatttagttttctgtatatttgtcttgttacagtctgaaaagagtatattaaatcacccattactcttgttttatgagttgttcttgtatttttaagtggttttcattcatatatttcacttcttgtctttggttcataaatgtttactgtgttcatcaattttaaattttataattacacatggcactctttctcctatataatgcttttg

SEQ ID NO: 5999 - DNA, 270 bp, mus musculus
aaatctcattcttaaccactatcctgtctgcctctcattatttcatttgaaatagctcacggttagtgtaggcagggtccaataaattgtttcctagcaccatacaaatcaatccctagtaagttgttatggaagattttgtaagaatagtgtaaagctcctctgttgatattttgaagaatttactgttctcctcttttgcaaagtgaatatgcatgtgtctgcgtcagcctgcagtcttctggcccctccccaatcttttaagttcct

SEQ ID NO: 6000 - DNA, 511 bp, mus musculus
cccctcaatattgaaaaaaaaaaaagaaaagatccttgagtcttactgtaagtgccttggttttcagaaactctgaaaccaagagtttcaggagaaactctatgaataatgggaggacccaaactaatgatgctttacaattccatagtgtattcacatgcactctgtaaattgagaaacaatacatgtaatttttcaagaaaacaagaaaaccttaaaggagaagcatatgtgtaggtttcagacattgtaaattatagctaaaatttacaaaacataatatattttactgagttcaaactcctttaaaactcattttgcttttgcccaatgatgatcataccaaatatattaacatttgataggatggtgatggaaagaacctgtgttatattcagggaatttttcttcttgctgtcctactcttttcctctgggttaattgtatcatagagctctcattcacatcagaaggagtcttccatgtagaaccacttttggaacgataattt

SEQ ID NO: 6001 - DNA, 498 bp, mus musculus
agaatagttctcttaaaggatctgccttctaccgtcagtcagatgagagtctcatgacccacaaactttatttgccctcattttgagtcattcagagaggtcaatgcaaaactaaaactagtagctcattctgacattaattattgactcataatagatgagtcaaactgcctttgtgatgaaatttccacagattagctttgcattttgggggtaatgatgtaaatgtctatctttttaaaatcaacatcaggatttgtctaagagtttacatttataatcttagtgctagccactccaagaggagaacttagaacagatgagggaaacaagaacttccttctctgaactaaaattgaacttgattgctggtgtttctcctgaaaattctttgacctaacagtttcttaaattgcttagaagccaaacgttacctaaattcccttttctctcatgagctttccaatcccttctttactatgctttttcctggttgac

SEQ ID NO: 6002 - DNA, 410 bp, mus musculus
atgactttttggaaataatcattataagaatagaaagtatattttagtggtaaataaatgtggtgcctacaaaagcatccaggtgaatccttttttaataacgtaaagataatcttaattgaccctgcttttctgttcattaggtgtgaattagtaaggtttacttcagatgggtttgcctatataatcattattttagtctgagttcatttttagttaatgtagcctgaaatgtgaatctagtgagtaatgtattttagttacattgccaaaaatttggagaaattctcaaatttgcttgtcaaatggagtgtgtctctgtaaggtaacaaatttaacattttggttaaaaaagaaaaaagtatataatcataaaatttttaattattctaaaccttacaggtgccata

SEQ ID NO: 6003 - DNA, 384 bp, mus musculus
ttctatcctttgaatgtcatacttaggtgccacaactatgtttattaattctatttttaaatataactttgaacctatatacctacagcctactataatcaatggctaggaaaaaggactgtgtttattttggtatataattgggattgtaaaatgtggtaaaaatgtagtagaatagtatttaaatattcaatccaaaacaatttaaaatgtcttgtatcaaaaaagattatttgaagatacttgaaaacatattgtaagaacaaatatggttacggcctttttcatttcttttttaaatgaaaaaataaaaagctagtatttctttttgaccagtcaatgtatgtgatgcaagatatctcacagaaagaagctacttatcca

SEQ ID NO: 6004 - DNA, 288 bp, mus musculus
caaaatcttaaataatagaatttatttttatcttttataataaatatacagcaatactagattcattatttacccatacttttttcatacttttttgaacagaaactctactatctggaacatttttggcttatccatacttaaaaatatattacttgtcactttttgcaacatgaaaaataggtatcttaacataaaattataatgatttgagtaacctgaacctaaatttctttggaggcatcaatatccagttgccttagtctatttaggctgtcataacaagat

SEQ ID NO: 6005 - DNA, 343 bp, mus musculus
ttgtgtccataagttacatcatgaataaaataaagtttgtattttgctggaaagcaggtatttttagtgaccgatatattagtatttatatccatgacaaataatgacttaaaaaccatcattctctcaacatgtattacattcttatgccaatttactacctagtaatgttcaattaataaaaatattgctgcttgtatttgggtccaggaatttttaatcagtcaagaaaataataattatacaactagacattatagactaaatttgaaagctaatgtctttgaagtttccatgaaactaatgctcatgccattcaagatgagaaatttattaatttcta

SEQ ID NO: 6006 - DNA, 462 bp, mus musculus
aaaggaggcatttttttcttctcgttaatgttctttgtgaaaagaacatagaaaaacttagtattaatactgcccagtattatgccaaaactacaaactaaaagtcattcacttctgtattgaacatgtcataatgaaacaaattttagtttaagttacttggaaatctatatttgacaatatattcttacagtttgtttgttttttttttttttcaacaaatccaggggattaagatgggtatctaggaaggtgtgttagtcagctttgggctgacataaaatatcacagactgggtggcttaaacaacagaattttatgttctcacattcctgcagcctggaaattcaagacccgggtgtcagctgattcagttcttggtgagagtttgcttgctggattgaagacaactgatttctctgtcacctcgcttgataggaaaggagagagagagagagagag

SEQ ID NO: 6007 - DNA, 290 bp, mus musculus
tggaagaaaatagaaattactgaggttttagataatccaaatatttaatcaagtcaccaaggtttattgtggggaatctttattattaattaaaatgagtgatgaaatcttaatatacgacaaaagttaaaatttgcttttgcaggcagatgaatggtctaggtatcaaaaaattaagttgagtctctaactcacacaaatttacaaccctatcactttatgaatttgtttaggagattatttttaataacactggtgaagtctaagaatagctaaaatttatagtacac

SEQ ID NO: 6008 - DNA, 915 bp, mus musculus
tttgactctgagccttaatagctcttaaaattgtaatttctattttgtaacttttctgatctttataagaagttcatgtatttatactaaattctctatagatatatgaaagtatttaaagggacggtttgtaaatactgggaattcataccactaagatggacaaagttattcctaataataagaaagaagaaaatacgtttttgcttttgatatttaccttccttttctgccttttttggggtaaataaattgtttcaatacgttctattatatttagagctaaaatggacagtattaagaaaagctaatacagtcctgccattttccttaggaggaaagtaagtcccaataagctgaataatggctgagacaggtgccctggttcataactcaggtcttctccactccgctaccccttgttattccctcaaagggaagagactgaacatttctaatgaacaaataagaagtgccatcagtgtgctctagtgtgttttgttttgttggtttttttttttttttggaaagcaaactggggccacacctcaatgcttatcatacttccccaactggaaaagtgtggtcttctgaatcatcacaagttgcacattctgagccctctactacttggagcttctctatgcggatattgacaattacttcactgtgtggagccagttggcacaaaactgatcatgttcttgttcttatcaggctagaagactgcatacctcactcactaaacctgtcaaacttgtttcctttcttgttgccagtgactgtcattattttgcagcctccaagtcctaacctgctgatacagatcagatggtgactgaatagaagctgccccagtcctgggttcatgatgtacgcgtaagtattcagcttttctcagtaaaggttatcagt

SEQ ID NO: 6009 - DNA, 608 bp, mus musculus
aaatattccgtatgattatgatgcaagtggtctgtggaccataatcttgacaaccctgttataggtgattttatattagcttataaatagtgtcagagatggaagaattatgtgtaatcagttcaaaggcatggacttgaagtattggaacaatgaacattcagattatttacttctgaaccactcttttaccaatgtggccaagaattctgttattactgaaactatgagacagctttatggggaagttaaagagaaaagaaactttggaagtgaatcctagatgctccaagaatattttagttctacacacatctcacatattaataaacgtgtgtgtgcgtgtgtgtgtgcgtgtgagaaagagagagagagtgagagagagagagggaatattgaatatttcagggtgaggtagaatgttctgtttttcttgcttttgtttggaatacattaatatcctctgatgaatgtgatttagtaggtatgcccaaactgtagtttcattctttattaccttgaaagttgtattctcattcatgtactttttcttctgaaaacaaattcttttttttacaggcttttctagtaaaactctttttatgact

SEQ ID NO: 6010 - DNA, 996 bp, mus musculus
gagcttggtgtgagcagttccaccaggatactattattacacaatttccaaggaccagaaccttgaccttgtacctccaggttcccaactaaaggctagggtactgtacttactagtgaatctccaggacagtcaaatacctagaaaaatttaacttttgttggttatactagagtcacatatactttccctaatatcccctagtttgttaattcacgttcagcctacagccacatgattaggtagagcatcagcaaagagatcggctactggtacctgtgctttcaggttcctaaatgtcctcagaggagtttctgcttaaagaatttcctctactttattataaaacttaaaatatttcaaggaataactcagatagttccccttcccacttaaaccctttctcttcattgctccatttaatataccaacccaatatggtgcataacatgggaagaatgcaatgctatagtgatgcaatatggttaataatcattaacacgtccacagtacttatgtgccagagtgttcaaagagctttgtaaacattaactcatttgatccttacaaaaaatctatgaagtagttagattctattgttagttctattttacacttgaggacaccaagggccaaagagattaaatttgcccaaatctagctccacagtccagattcttaaccattaggcaacccataaatactctttatgtgaattcaaagcaaccttataaaagagaacccaagaagtagggcttttaaatcacattaaactggcagtaactgcctcctgaagtgcctatgaggacaaagtgtgaaaacgcatcagatgataaaggcctgaaccctggttagatccacatctagggccttttctgggaattccatcaactcattgcctaaactcattacaggaaattactaagcattgagatgactctagtattatgagctcttaaggtggccagccaaggataaaaccatacattcaatttt

SEQ ID NO: 6011 - DNA, 867 bp, mus musculus
ggatgtggtctgcctcatatcccacggacaccatgagctctgtgtttcaggagtcctggtaatcagagagcagctcccggtatggccttcgtgtctcctcctgaccagtgttgatccataggtgttccatgacgtggactagtataggcctctccctgcagtcagaaataggtttatgaagctctctggaaatgaaaagcaaagagtgggatcttgtacaattgttcacacagtatcagcttcctcagcgccacaaaatctgcccaataaatggcaggacctggttactgtggtgtaaagaatgactttccagctccacatgtccactggggcccatcatatgtttggccatggaagagttcaggaccgcataagagggactcccaccgaaggtgcccagcttctggcctacagtgaacctggtatcaaatccaaagtctgttatttttatgttgtgatggaccacaaggaaattcttgggcttcaggtccctatggatatcccccttctgttggtggtactagagggctgatactatctgctggaatttgcttcaggcctcttccgccttcatgtagcccaactctaggatgtagtcgaccagctctgctctgctggccgtactccatggctaagaacaaagtgtctgtggtgttgaaagagtttgatgaccttggggtgaccccatggaatagactctagagggagtctagagtctcactgctgcccagtgagaaggtacttggtgaacttcattcaccctggtgaagctgtcctggctgatgatctcgaggagcctataatgatcagtaagggtctcctcatcagcagagatggtcgtaaggccctgccacatggtaaccttct

SEQ ID NO: 6012 - DNA, 665 bp, mus musculus
cagcattttccctctgtcatatagatgataacttttctttcatctcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaagtaagttaaggaaacaaagcacaatggtgtacttttatttatttaaatgcttacactttaaaattgtctttggttttgccctataaaatcaacagaaagctagaaaacaagtattatgcaacttaaaactgttgttaatgtttcatttctcaggctgtgtattcgaaataaggatatttattgtattattccttatgcttttattaccaaataacactgaacattttaagagatacagacttgaatggtctcatatttcagaacatattttcatgaagtaaagtattagtttttgtgtaaaaaaagaaagtgataccttttaaggttggccataagtgatctgggtttcttttctgtgatttttttttaataattgatttttgagaatcattcattttaaaatcatttattcactaaatgtatactgagcatttgctttgtgataagtcctgtgctagacac

SEQ ID NO: 6013 - DNA, 988 bp, mus musculus
acaaaagtgtattttaaaaaagctttgaaaagagccacctgccagaccagattgattaagcatctaaataacatgttgaatttaaaatatatttgtgtaagatacctgtttcatccttgagaaacaataataaactttgttgagaaggttgagttttctccagagtttacttaagatgtcaggataagtaattgccttgctgctacaaatttggaacttaacattttgttgggcctatttttgctgccactccatagataatatatttcatgaaggtttttttcattggcagaagttagttccttttgttttctctgcagaaaaaaacttgttttgctctgtgataggcaggtatccaagtactaatacttttcttttcagtctagaatcaggtaatgaaggcccatcattctcaccgacagaggagatgacagtcttgctcatcccatatcctctagtacagctcaaggacaggaacaggagctggaattttatcagcaggctcaagagtcagagggcagtagtgatgtggattggagtagatgattaactctttgaagactcctctcattttatcatctccaaattgaccagaatctttaacactgttccctcatttatccctttgaatgatacagacacaatctattttgttgattcacattttcttctgctttttctgatgcagtagattagacgttcatggactatagcttgtgggccaaattcagtctatggctggtcaaattcagccaagaatggattttacatttttaaatggcttaaaaaatcataaaagtattttgtgacacatgaaaatgatatgtcagttcccccaagtaaaggtttattggaacatagacctgctgatttatttacatactgtctgtggctttttctctacaacgttgacaaagttgagtttacatagttgagtagttacaagagaccaaatggcccacaatgtcgaggttgagacaagtccagg

SEQ ID NO: 6014 - DNA, 988 bp, mus musculus; identical to SEQ ID NO: 6013

SEQ ID NO: 6015 - DNA, 1056 bp, mus musculus
gatataaacccttgccaacaagagtttatttttaagactcggacagtctgttcactgtggcaattctagcaggctccatcaaaccactaatgacatagaagagaaatgagaaagaatcgacttggagtaacttaatgatactacattttaaaccaatgtcaagcatgcactgttcccttagagatattaataaagttggttgaagaatatatgtgctctagttctatgagactccaaaagagattcctattgctaattttttcctttagcatgtgaaattgttagtcagcatgctcttgcaaggacaaaagttagatttttgttgtaggatactcagttttcttcctcccccgaaaatgttaattttagtgcttcaaggaatatagaattaaggttggtaatttgcttctttatgagacttgggtgcatggtctcacagcctgtcatagatcaggggaatagatcaggggaattctcttatccttgccacaattgaatgttattcctggaacaatacagtctccccttgggcaaggcagaactgatttgacattatcttggaataatcagttttatacatccaagcataatgtttgctcccttcgtctgttttagtctactgcaaaagtctgggggattctgacagtcttggataggtgaatacaagcagattgaccaggggctagaacttaacactattcttaataatttgtcatgacccacatgtttccctcccagcttttgtgtactatcttctcactggctcaaggttgctttattctatacaagttaaggaatgttgacattttgtcctgtttttttcaatttagagtttctgatcctgaccactgttgagctttcctacacctcataagctaagtttttccctttaagctctggccctgattttgaccccactactctagtcttgtcactgctcgtttgtaatgactattccctgttgagccacacagactgaacacctccattgtgggctcttattatttacaatatttcagtttcttattcagataagttttagtaagttataaaatg

SEQ ID NO: 6016 - DNA, 194 bp, mus musculus
aaaacaatgcttacacatgttgtttaaatgttgtttgaagttgaaatgttttgaaatggtatctgaacagcagagaaaaacacaattttaatgtcaacatacaagagacacctttggttgcatttacaccaaaacattgtaaattattatatttaattatagctcctggtttcccattttttcacagatacact

SEQ ID NO: 6017 - DNA, 1352 bp, mus musculus
aactgtggttctcaaagtgcaattcccttgatcagcagaatcagcgtcatctgagagcttgttaaaaatgcaaattcttggacatcatcccagacctactgaatctgaaactctggggatgggactcagcaatctgtgctttgcaagcctttcaggtgattcttatgtgtgataaacttagagaaacacccaataaaatgaagaaattggagacacacacacaccacagaaagagagagacagagggagagaataataaagtaataagataataagataaatcaaaaagagaagtttgaacatagaattgtttttatggcaaacaaaaagtttgattctatgttttccaaacagataaaagcaaagaaggaagcattattaatttacgtgattcctttgacactgcattctattcaagaaagaaccaacttcctttctctgttgctcttagcaaaaagatttctgaagggttatctaagtaagatatgtttatttcttatttctctattcactctttaattcatcatagttggcctcatcatctattgaaaatgctcttgatgacatcacaagtgtaaagttctctttctaatattcagcaacatgaaacccaactagttattctattctattccttttgatagatgcatattaggaatatcatcaatgcattcactcagcaaatagttgttgagcggccagtatgtaccaggcactgtgcaggacattgttgatagcatgtagaacaaaatgaagtctctacctttatggcccctgcaaactaaggagaaagaaaggcaatttattttctttttatttatttatttatttatttatttttgagacggagtctcattctattgcccaggctggagtgcagtggcatgatcttggctcactgcaacctccgcctccaggattcaattaattctcctgtctcagcctcccaagtaactgggattacaggtacctgccatcacatccagctaatttttgtatttttagtagagacggggttttctcatattgatcaggctggtctcgaactcctgacctcaggtgattcacccgcctcgacctcccaaagtgctgggattacaggcatgagccaccatgcccagccaaaaggcaattttaaaatgaagtaaagcataaagaaataagtaccaagatagatatagctgctgtgaacaaaaataaaacaaggcaaagccatagcacctggaatgtatatgctacttttgttagagagaccaaggaagatttctagaggagtgaaattttagcagaaatctatatgaagtgagagaccaagatttttagatagctgaggaaaggccatttttggcaga

SEQ ID NO: 6018 - DNA, 928 bp, mus musculus
agagttcctagaggaagtgctgagagagctaatttttaaagaatgtatagacatttccagccttgaaagacaggggaatggcatttaggcagagaggagagcatgaacaagggcataaaactgaaaaacagcaggtatatgaaagggaaactatcagtagttcagggttgctttagcatagatctgagtaggagcagtaagacatgaagggccatgtaaaagcagtaggacaagaagtttagaatttatgctataggtgattgtgactcattcaaagaaatttgtcccgggagataatctggttaaatctgtgtgtgcaaaacacccctggaggctgtgcagaagtcagattgagtagatatgagaagggagacaaggagacaaataaacaagctgctgctgagggcctgaactagagcagtggtggaagcaagccgataaagggccaatatatgagaaatatttatggagggaatctggtggtgaatgaatgaaaatgggatatgatgagaggaaagagtcaagcacaattccgagtctaaaacatggatgtctcaaaaaacagaggtaccaaaaaatgtaagatagaaaattcagggttcagggggaagatcaaggactcagttctgtatatgttgagtttaaagtgcctgtggaacatgtaggctacagtagatagatgtatacgtctgaatctatgagatgtctggacagggaaaaagaacatggaaattatatgaatataaataataactaaaacaatgacagaagttgaagttatccaaggaggttgttctttctaccattagccttaatatattgttctttttataggagtggtgactctgttcactgtttttgagaaattgctattaatattattattttgtatgtatgtggattgcacccttgtttagatatatggttg

SEQ ID NO: 6019 - DNA, 1108 bp, mus musculus
atctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacgggtaccgcacgcttcttcccccgctccccctcccccagcgcgccgcacgcgcccttcgttcctcgtgagccgcgcgctgcccccattctttctcagagtcgattccccgcgtgccttctgggccccactagattggagggaagaggaaagtaagagatcgagggggtgactggagagacccgggaagagtgggggaagggcggaggggttggaggaggagggcggcggcgtctgtgtcccgagcgcgcaggcgccgcgtgggacccgggggggaggggccggcctcccagcgctgcacgctgcagctgccgccgcctcttcattgtgtctctgttaccactcggcgcggttttcctgggaagagttttagaggactgagttggggcacaagcaggcgactggtacccagattcacaaaacgtgttatgattgatgagttctctgggtggaacgttggcttgacagctgagaacgaagatggacctaagtaagataagatgtgagggattcatctaggaagttgtgccttctacctaaaggaatctgggcagaacctttactgtattttattggtctcttttgagctttgctttatgtagtgcggacagtgagctgtccgctggtttgagtaacttcgttgggatattgggatttttgtgtgacatagattaaatgtaaacatgaattaaattgcctacacttagggggtaaatgtccctgtttttatttcacgatttaattccagaactgaaggatcatttgagttattgttaattttttttaaaaacacttttatttctagtaaaatgtttattggaggcttgagctgggatacaagcaaaaaagatctgacagagtacttgtctcgatttggggaagttgtagactgcacaattaaaacagatccagtcactgg

SEQ ID NO: 6020 - DNA, 1088 bp, mus musculus
aaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagta

SEQ ID NO: 6021 - DNA, 776 bp, mus musculus
agagaaggaggactgatggctgtaatattggcaaagaaattgaactcagattataaaagactttatgcagagtctaggggggtgggttgaaacttactcagcaatcactttggcaggtatccacaccgagtcacatgatcagaattgcacttgaggatagtttctctgtctataggactgaggctgagactggaggcaaggacgtgttagaaagtaggcgaaattgtccaggtctggggaaattaggctgtgtaaaaggacagtggcagtgggaatggaaagaagggtggtacatgaaacagacattaaagggggaacaagttgattgttagcttgaaactctcagcaggctttatcaattcttggaatgaaggaaaatttctcccttcaaaaaaccttgtatgttgcaaccacttaggatgtgaacaaagacaattcatctccattttcaaggctcagtagtcaactcagagatggagacaagaggacttaaagatgggaagaaaacgtgtctcattaactcacagttccaaaatgttacagatagctgtggggttttggtttcatttggtaaaaatcaaatgaactttttttccttatttcttctgaagaaaaaaaatcagatttactaaatgacatgttaaaatgtttaattccatttattctttaatttaaacaacacaaagttatttcaatgagacatctgattttaatcccaagtaataaaaaacaaaacctaaacattggcctaactgaaacgaagtctagtttaactg

SEQ ID NO: 6022 - DNA, 369 bp, mus musculus
aggaattaccagaaaaacactggcagcactgtcttccaaacaccactttgtacttagaaagtactttttccatttgttgctctttatagtcttctttcatttatttgtccagttgttaggctcttcagtagcttcagttgttccagttcacaaggtcctcattacagcatgagttatctttttgtttactctgcttgcttctgtgttaggaataaatgagctgaaacaaaatcatccaggaaacacatatcctggatcacgtgtccctgacaaccttctgtgtctctccagggtgctctgaagctgaattgtttaaagggttataggttctctgagataattaaatcaaaggtggtttaatggtaaaaa

SEQ ID NO: 6023 - DNA, 622 bp, mus musculus
acctacaagcccccatcaccagtcttcaaggcaccatcccctcttttttggtttggttgctccttcccatccccataccatagctcctactctcacattaatgtggaatcgcagaatgtcaggtgaagcaatacttaactgcagaggcgagcaccagcaggctattcactaagtactgcccctccacacaaaaatgatgttcattggcttctggggctcagtatcaagtaaacaaaaagggaaatgaaactaataaatagattccgtaggacatgtggaatggaactctcgcaaagtgaatgtaggatccgagtctggtcatgcttattggcaaatactaagcatactttatcctttttaaatatacatagctgttttattatttgatttagccacatgactattattactaggatttccaatcaccagagttaaatgaatatacagatttaatgtactattctgtgttatttaaagctcttcagagttgcataattagaatgttcccaagcagtcaattatgttgatttgaggatactccttgtgtaagcactggggtttaagcagtcagctactctattcagtatgtcctgatgaaattaaatttaaaggggcattttaa

SEQ ID NO: 6024 - DNA, 622 bp, mus musculus; identical to SEQ ID NO: 6023

SEQ ID NO: 6025 - DNA, 239 bp, mus musculus
tttatcctatatcccccagattagacaaccctagagaagcaaagtggccacagaagatcaatttgaaagtttttgttttaaagagaagagggatggtcatcctactttgttttagtgatgcagagaggtacagacatcaacttccagggtgcgagggtcctcagatgcagcctccgcccacagctgcctctacccgattcttttcctgtccagttccaacaagaatagcaggaatgatc

SEQ ID NO: 6026 - DNA, 1543 bp, mus musculus
gacattataccaggcactttatataaatttcctgtaaagtcagtaccattatgaactgaagaaaccagggagtaacaatgttgaataacttgcccaaggtaaagaaatctagtaagtatcaatcaatgaacaacaaaccctatgtgtctgacttttctttccactaacattctagcaatacctggattttttatgaattcaaagtaattatacaactcccctgttgtcagtattttagccatgatttacataacagaaaaatgaaacagtttagttcaaaatgaattatttttgatttagggacagtaaggaatttctaaaaatgcactaaaagcactttagtacgtaaattccatcatgactaaaaggtgccatgcctatgtaagtataattgtgctgaggtttatacaattccataagtactaaaaagagaagttttttaaaaagtcataaaaatgcaaaacaaatatgttctgatttctgagaaagcctagaagagcccccaggcaatatgtattcaagggctatgtagccaggtgttcccctctggggttgtattcaacgtgatttcttgagaattaagacagtagtgaggaaacacagaagaaaaaatttctgctgtaaataaaatcctgatagaaaaagcataccagggaattttggttgataattgtttcgctaatttattgcctctcactttatctcgaaaaataaaacattgtttggcccttattcaaataattttcactagtgcaggaattctggtaacctgatcatatatatctatctttattatgagatcttcagttgtttaaagttaccatattttataatattatatatatatatatatagtcaattgaaaaactgatgtagtcgagaacacaccttgcctaatataactgctacattgaattcatttacatcataacaatttctcagttctttaaaacagaagtttaaaagcagattcattatgtggttcattagattgaattctgtggtcagacaaacccaggttttgtttcttttgtgtgtgtgagacggagtctcgctctgtcgcccaggctggagtgcagtggcgcgatctttgctcactgacacctctgcctcccaggttcaagcaattcttctgcctcagcctcctgagtagctgggattacaggtatgtgcgacgacgcccggctaattttgtatttttagtagagacggggtttcatcatgtttgccaggctgatctcgaactcctgacctcaagtgatccaccttcctcggtctcccaaagtgctgggattataggtgtgaaccaccgcgcccagcccaaacccaggttttaattatgaccctcctgtttgctgggtgaactccttaagactctgcatgtctctgttttctaatctggtaatgaggatcctaatgcttaccttcttcagagattattactggtattaaattatattattttaaatgtctctgtctgcctgcaatggtgctgaatcaacagtagctgccttctctgttttccccaaacaaattctcccca

SEQ ID NO: 6027 - DNA, 453 bp, mus musculus
tatcgaagagtgttattcaacttcctggtgattaaattactgataaacatagccgattttttttggttttgcaggtcctgaaaaatagagaatgcatatgacttccaaatattggtagaagagccagtcaaataatatcttccatgaatcctcttacaattaatttgctgattgatagatgttcaaaatctagaaatgaatgagttgcatgtaaggaaatcagtacatgcttctgctgccatcatatatcacaatacaagcattaaaagctatattaattatagaactttatgatcttatttacatggtctgtgaatttgatctttattttggaattcctttaatccattctgattctaatcacctcaggaccaactttagtgtatttgtacaaggcgtaatcattggctagctctataagttgtccaaacaaccaaatgagatgtcgcaaat

SEQ ID NO: 6028 - DNA, 816 bp, mus musculus
ttattattgttaggattttaattgtctaacaaacaattgatagtattttgttgtttttatgtttgattacttcaaatcattaccttaaaataagagtaatttcaatggtcaggcatggtggctcacgcctgtaatcccaacactttgggaggctgatgcgggcggattggttgggctcaggagttcaagactaccctggacaacatgacaaaaccctgtctctactaaaaacaccaatagcaacaacaacaacaacaaaaatagccaggtgtggtggtgcacgcctgtggtcccaactagggaggctgaggtgggaggattgtttgagccccggggggcggaggttgcagtgagccaagatcgcaccactgcactgtagcctgggtgacagagcgggaccctatctcaaaaaataaataattttcttttaaattttctttctgaattacatgcaaatacgtttttttgtttttttttttttttttgagacggagtctcgctctgtcgcccaggctggagtgcagtggcgcgatctcggctcactgcaagctccgcctcctgggttcacgccattctgcctcagcctcccgagtagctgggactacaggcgcctgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcgcaaatacgttttgaaacagctattagaattgtattttttatggttttcacctt

SEQ ID NO: 6029 - DNA, 816 bp, mus musculus; identical to SEQ ID NO: 6028

SEQ ID NO: 6030 - DNA, 816 bp, mus musculus; identical to SEQ ID NO: 6028

SEQ ID NO: 6031 - DNA, 816 bp, mus musculus; identical to SEQ ID NO: 6028

SEQ ID NO: 6032 - DNA, 785 bp, mus musculus
tagactagtgtagaagctccacactcatcagattcttaggttgcatgtattttactgccctgctgtccctagaatgccccatatgaacccaccatgacggcgatgccaattctcccagcaggtccataccccaggcaacggagacatggaatgggaggcaaagggcacaccctttaaggagattttccagaagtcccacaaatcatttctctttatgttttgtcaatcaaatattaagtgatcatatttggttttgaaggggctgtgagtattttttcctggctacaatggggtttctgttactaacaaagtagaagagaatgagtgtgcatttggacaattcacagtatctgccatgtgatgattatagaaaacagagggactggaacaaataagagtccttttagaagtactgagaactcagtttttattggaggagctcaattgtatcttattttatgggtgagaaaaactgaggtcagttagaatgaatatctgtacctacacacttcctcacttcccatcatcctgataacataaggctcattctggtcaacaaatggtttcattcaagctgacattttcaacaagtttcatttgaactaaaactttatgaggaattcacaaaatatcctcaaaatgctctagcagtttgcatggtgtaaatatttaaagcaaatatattcaaatagataaacaccgactgtctcatctttctcgtagataaatccaaatgcatcagtggggcagtgaaaagtcagctatctttgttcagatgttgttta

SEQ ID NO: 6033 - DNA, 10876 bp, mus musculus
tttgttcttgatggtttaacactcttagaattcattctcacatatatttcccaaggtttctgatgatatagatgaacaaaacattacaattattttgaaatataaactttttcttggttcacatttgtttcctacaaacctgctgagatctgacacaaaatataggtctggagccagtaaagggtagtttgggtaggtcttgaggtacttaatgtttccctaccatactgctgcctcaggtacatttattatatggtcttcaagcaaaggagagctagtttccttggagaaaggaggggaagcctttcctggtaaagacgacttagaaaacccaggagtctctggatgctcagcattgtttaagttcacccatgtgtttccatttcaaaccacagggttccagccttctcaaacaaagctctttcagttggtaaatctgtaaattcaacttacattgcacttcttcaacccgtacaattaaatggtagtctcaccttcagcagggttggctctgtgggtgtaaggaataagcgattcctttagatttgtcatagaatagaaactctttgtttcttttactatgacttaaatgaagagtttaaagtctcaaacttgccaccttctttttgtaaaactctctaaggcaagaagcagcagccattcttccccataggtcttatcattcccactactttgcaattgtaaagggcaaccaccatttgatctgccaagatatttactccaatagccacattgtcagaaacaacaacagcttacagtttaattgatatgatgccactggatgttgtgaattactcagattctatttcacaactgccataaatctagcctgcattcaaaaacagcaccaatcaaccaaagagccttctcagggtctctacaggaacacaacaaccaaactagatattgtaatacagggaacttaatacataaattgattaaacaagtgctgagtgtctgattgaataaacagagaacactatggtaatatggtgattatagctgtggacacagctattacatttaggcctggagaagtgcagggaagaagttgggtttattaaaacatccaaagcttagatgaagacctcatgtagattaactcagaatatctgatcaggaggccttttcaactgccaagaattacagtgaaggggagaatagcgcagttctggagtgctcaaggcagatagagactgcaacaaaccactgctgctatgggcattattgtatgaacagtgtgaaaacaggaaaggaagaaatcattctccttttctctgcctttaagttctgctcgagtatctcctactattgacagaacctaacaggatgccaattagcaaatagtttgcagagtaccagctcccgagcacagagcagagtatagaaggatgaatttgaaactgagtgttaatatgcgcttggctggcacaaccactggttgtgctaagagaaccactattctcttagtagaggaggtatggcttaggatatgtttgctagcttcatacctttagggattcaccctcttttataaacactagatatttaataatatgccttgtgcactctgagatctgtgttgtctgccccctccctactttcaaaagaaaaggaatttcttttttctttgccccagtgccccctttcttctcaatttagctgcttttcattgatttctttttggcatgaactgagtgctggaaaccagctaagtagattgacttctagagtttacagggcccagactgccatgtactgactacacttttcaatgtctccttcgttcacctgtgaattggcacctgctttggcctcttccagtctctgttgctgttcccaattggcccactgaactttgcatgcagatgggagaatttcctatttgggaatgagtacttgttgatgattcatttcatggagtctctaactctctgcaccattggaaatctctttgcttctctttatgtcctcccacatggttgctgctacgtcatgtgtctttcaggagttgcactttggcctgtccctgcatttttgcatttgagacatattctgtcatgtagaagtggaagtactgggccatatagtaattttttttttttgagacagggtttcactttgtcactcaagctgaaatgcaatggtgcaatcatagctcgctgtaaccttaaactcctgggctcaagtgaccctcacaccccagcttccctactagctagcaccacaggcatggatcaccatgcctggctaatttggttttttcaattttttctttttttttttttttgtagagagagggtctcactgtgttgcccaggctggtctcaaactcctggccttaaacaatccccctgtctccgccttccaaagtgctggaattacagacttgagccactgcacttggcccatgtttaacattttaagagattgccaactgtttctaaagaaaccacacaatttcatatacaattccagcagtgggtcagggcttcagtttctccacatctttgccaatacttgttattgcttgtctctttgaggatagacataatgatgtatgaaacaatatttcatgtggtttttatttgaactttcctaaagactaatgatgttgaacttttatttatgtgttactgatcatttatatgtcttatattgagaaaaatccattcaattcctttactaattgttcaaataaattgcctttttatttctgagatacaagattttaaaatatgtattttgaatacagatctcttatcagatgattttcaaatatcccctgctactctgtgggtggtatttttgctctcctgatggtaccctttaaagcacaaaagtttttaattttgatgaagtccaatttatttatttttttgttctatcacctatgctttcagtgtcatacctacagtttagcttaatccaaagtaacccagacttactcttgtgttttttcctaagttttaggtcttacatttaggtgcatgatacatttctgagttaaaaatgtatttgtatacatgtaaggaagacttccagcttaatttttgtgatactcaatgtttccagtattacttgctaaaaaaatttctccattaaattgtcgtcacacccttatcaaaaatcaatttaccgggaggtcaagccaagatggccgaataggaacagctctggtctacagctcccagcatgagtgatgcagaagatgggtgatttctgcatttccatctgaggtactgggttcatctcactagggagtgccagacagtgggtgcaggacagtgggtgcagcgcactgtgcgtgagccaaagcagggcgaggcactgcctcactcaggaagcacaaggggacagggagttccctttcctagtcaaagaaaggggtgacagacagcacctgtaaaatcgggtcactcccaccccaataatgcgcttttccgacgggcttaaaaaacggcacaccaggagattatatcccgcacatggttcagagggtcctatgcccacagaatctcgctgattgctagcacagcagtctgagatcaaactgcaaggcggcagccaggctgggggaggggtgcccaccattgcccaggcttgcttaggtaaacaaagcagctgggaagttcgaactgggtggagcccaccacagctcaagaaggcctgcctgcctctgcaggctccacctctgggggcagggcacagacaaacaaaaagacagcagtaacctctgcagatttaaatatccctgtctgacagctttgaagagaacagtggttctcccagcacgcagctggagatctgagaacgggcagactagactgcctcctcaagtgggtccctgacccctgacccctgacccctgaacagcctaactgggaggcaccccccagtaggggcagactgacacctcacacggccagatactcctctaagacaaaacttccagaggaacggtcatacagcagcactcgcggttcacgaaaatccactgttctgcgccaccgctgctggtacccaggcaaacagggtctggagtggacctctagcaaactccaacagacctgcagctgagggtcctgtctgatagaaggaaaactaacaaacagaaaggacatccacaccaaaaacccatctgtacatcaccaacatcaaagaccaagagtagataaaaccacaaagatggggaaaaaacagggcagaaaaactggaaactctaaaaagcagagtgcctctgctcctccaaaggaacgcagctcctcaccagcaacggaacaaagctggatggagaatgactttgacaagctgagagaggaaggcttcagacgatcaaactactctgagctacaggaggaaattcaaaccaaaggcaaagaagttgaaaactttgaaaaaaatttagatgaatgtataactagaataaccaatacagagaagtgcttaaaggagctgatggagctgaaagccaaggctcgagaactacgtgaagaatgcagaagcctcaggagctgaggcaatcaactggaagaaagggtatcagtgatggaagatgaaatgaatgaaatgaagcgagaggggaagtttagagaaaaaagaataaaaagaaacaaacaaagcctccaagaaatatgggactatgtgaaaagaccaaatctacgtttgattggcgtacctgaaagtgacggggagaatggaaccaagttggaaaacactctgcaggatattatacaggggaacttccccaatctagcaatgcaggccaacattcagattcaggaaatacagagaacgccacaaagatactactcgagaacagcaactccaagacacataattgtcagattcaccaaagttgaaatgaaggaaaaaatgttaagggcagccagagagaaaggttgggttacccacaaagggaagcccatcagactaacagtggatctcttagcagaaactacaagccagaagagagtgggggccaatattcaacattcttaaagaaaagaattttcaacccagaattttatatccagccaaactaagcttcataagtgaaggagaaataaaatactttacagacaagcaaatgctgagagattttgtcaccaccaggcttgccctagaagagctcctgaaggaagcattaaacatggaaaggaacaaccagtaccaaccactgcaaaatcatgccaaattgtaaagaccatcgaggctaggaagaaactgcatcaactaacaagcaaaataaccagctaacatcataatgacaggatcaaattcacacataacaataaattaaccttaaatgtaaatggactaaatgctccaattaaaagacacagactggtaaattggataaagagtcaagacccatcagtgtgctgtagtcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatagatatgcacccaatacaggagcacccagattcataaagcaagtccttagagacctacaaagagacttagactcccacacaataataatgggagactttcacaccccactgtcaacattagacagatcaacgagacagaaagttaacaaggatacccaggaattgaactcagctctgcaccaagcagacctaattgacatcaacagagctctccacccctaatcaacagaatatacatttttttcagcaccacaccacacctgttccaaaactgaccacatacttggaagtaaagctctcctcagcaaatgtaaaagatcagaaattataacaaactgtctctcagaacagagtgcaatcaaactagaactcaggattaagaaactcactcaaaacactcagctacgtggaaactgaacaacctgctcctgaatgtctactgggtacataacaaaatgaaggcagaaataaagatgttctttgaaaccaatgagaacagagacacaacataccagaatctctgggacacattcaaagcagtgtgtagagggaaatttatagcactaaatgcccacaagagaaagcaggaaagatccaaaattgacaccctgacatcacaattaaaagaactagtaaagcaagagcaaacacattcaaaagctagcagaaggcaagaaataactaagatcagagcagaactgaaggaaatagagacacaaaaaacccttcaaaaaattaatgaatacaggagctggttttttgaaaggatcaacaaaattgatagactgctagctagactaataaagaagaaaagagagaagaatcaaatagacgcaataaaaaatgataaaggggatatcaccaatgatcccacagaaatacaaactaccatcagagaatactacaaacacctctacacaaataaactagaaaatctagaagaaatggataaattcctcgacacatacaccctcccaagactaaaccaggaagaagttgaatctctgaatagaccaataacaggctctgaaattgtggcaataatcaatagcttagcaaccaaaaaaagtccaggaccagatggattcacagccgaattctaccagaggtacaaggaggaactggtaccactccttctgaaactctttcaatcaatagaaaaagagtgaatcctccctaacacattttatgaggccagcatcattctgataccaaagccgggcagagacacaacaaaaaaagagaattttagaccaatatctttgataaacattgatgcaaaaatcctcaataaaatactggtaaaccgaatccagcagtacatcaaaaagcttatgcaccatgatcaagtgggcttcatccctgggatgcaaggctggttcaatatatgcaaatcaataaatgtaatccagcatataaacagaaccaaagacaaaaaccacgattatctcaatagatgcagaaaaggcctttgacaaaattcaacaaccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctcttaccactcctattcaacatagtgttgggaattctggccagggcaattaggcaggagaaggaaataaagggtattcaatcaggaaaagaggaagtcaaattgtccctgtttgcagacgacatgattgcatatctagaaaaccccattgtctcagcccaaaatctccttaagctgataagcaatttcagcaaagtctcaggatacaaaatcaatgtgcaaaaatcacaagcattcctatacaccaataacagacaaacagagagccaaatcatgagtgaactcccattcacaattgcttcaaagagaataaaatacttaggaatccaacttagaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatctatagattcaatgccatcctcatcaagctaccaatgactttcttcacagaattggaaaaaaatactttcaagttcatatggaaccaaaaaagagcccacatcgccaagtcaatcctaagccaaaagaacaaagccagaggcatcacgctacctgacttcaaactatactacaaggctacagtaaccaaaacagcatggtactggtaccaaaacacagatatagatcaatggaacagaacagagccctcagaaataacaccgtgtatctgcaactatctgatctttgacaaacctgagaaaaacaagcaatggagaaaggattccctatttaataaatggtgctgggaaaactggctagccatatgtagaaagctgaaagtggatcccttccttataccttatacaaaaattcatttaagatagattaaagacttaaacgttagacctaaaaccgtaaaaaccctaggagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaattttggcaacctactcatctgacaaagggctaatatccagaatctacaatgaactcaaacaaatttacaagaaaaaaacaaacgaccccatcaaaaagtgggcgaatgacatgaacagacacttctcaaaagaagacatttatgcagccaaaaaacacatgaaaaaatgctcaccatcactggccatcagagaaatgcaaatcaaaaccacagtgagataccatctcacaccagttagaatagcaatcattaaaaagtcaggaaacaacaggtgctggagaggatgtggagaaataggaacacttttacactgttggtggaactgtaaactagttcaaccactgtagaagtcagtgtggcgattcctcagggatctagaactagaaataccatttgacccagccatcccattactgggtatatacccaaaggactataaatcatgctgctataaagacacatgcacacatatgtttattgtggcactattcacaattgcaaagacttggaacaacccaaatgtccaacaatgatagactggattaagaaaatgtggcacatatacaccatggaatactatgcagccataaaaaaggataagttcatgtcctttgtagggacatggatgaaattggaaatcatcattctcagtaaactatcgcaagaacaaaaaccatacaccgcatattctcactcataggtgggaattgaacaatgagaacacatggacacaggaaggggaacaacacactctggggactgttgtggggtggggggagggcggagggatagcattaggagatatacctaatgctaaatgatgagttaatgggtgcagcacaccagcatggcacatgtatacatatgtaactaacctgcacattgtgcacatgtaccctaaaacgaaaagtataataataataataataaaaaaatcaatttaccgtcagggcaagggtttatttttggactctcaattttgctatattgacgtatgtctgtctacatgatctatatgtttatctgtcttgattgctgtggctttgtagaaagatttgaagttggaatgtgtgagtccttcaacttggttatattttttaaagactattttggcttttacgcattttcatcaattttagggtcagcttatcaacttttgttaaaaggtaagctggtaatttgatatatgtatagatctagttgggaagtatcaccatcttaacaatattaaatcctctaatctgtcaacatgcaatttcttattctttttttaaatttctttcaaccacgtttgtagttctgaatgtacaagtcttgcatttattttgtaaaacttattcttaagtatttattcaatttgatgcttttgtgaatggaattgtttcttaatttcatttttatatatttacattgcttttggtatattgatattgcatcctcttgcaatattgctgaagtcacttatttgttctaatggtttcttttaaaaaagtagattccttaggattttctatgtacaagaccatatcatctacaaatagagataatttaacttcttcctttctaatctgttatcttttaacttttacctgcctaatttccctagctagaaccttcagtacaacaattgaatagaagtagtgagagtagacatctttttcctaatcttacagggaaagtatttagtcattcgccattaagtatgatgttcccttgtggttttcatagatcgctttaccacatcgagaaaatttccttttaattctagtttgttgagtgttttatcatgaaagggtgtgagattttgtcaaatatgtatcttttgtttatagaggtgattatgtgtttttgccctgttttctattaatatattaagttagttgattttttaatgttaaaacaaccttgcatttctgagataaatcccagttggtcatggtgtataacatgttttattgtttctggatttggtttcctattttttttgagtatttttctgtatttattcataaaggatactgatctgtaattgtttgttttcttgtggtatctgatttttctatcatgaaaatactgacctcatagaatgagtaggaaaggttctactctcatctatttttggaagagtttgtgaagtattggtcacaatttttatttaaatgattgataaaattagccagtgaagctatctatctgggcctgggattttctttgcagtaaaaaatattttattattaattcattctctttacttatataggtctattcatatattctgtttctttttgagtcactttggtagtttgtatctttctagtaatgtatccattttgtgtttttgtctaattgttggcatataattgtttatagtattccttgtaattctttttagttctgtaatgtcaattgtaatgtacactttttcattcctaattttcttaatatgaattttctttattttccttattagtctact

SEQ ID NO: 6034 - DNA, 1052 bp, mus musculus
agcattgtaagtgtaaagataaataaatatatagaaatagaaatacagaaagcataagtctaaataaataaatatattctgttgccttttcatgtctccctgaagaatgattaataattactgattactagccacttaggaattattaataattaatcactcataacaattatttttatcaaaaactcatcaagatagcatgcttcattagaaacaatgagaagctgattttttttccccctaaatttaattcttaacatttttggtgacattggtagtggggctgggcataagatactttaaatcatctaataaagcaaactcagacttggcagcatctctttcagaaaacttattcaataaatacttatatctgatttgtttcaaatgatatttcatgaagattatatttcgggtatttattttacgaaaaaattttacaagtagagggattaggaatatttgagtacttggaccataagcatgattgataattaatgtaaatcacaagagagaaggatgttaatatcattcctatttgataaataaacattaagttaatatcatggggtttttagttatgtacatttaaaaaattctggacagaaatttatagttaaagagttaatacttcaagagaatgaaaggacaagactatagaaaatgtttgcaaatgcatatctgataaagggcttatatccagaatatgtaaagaacttttaaattcaataataaaacaaccaacaaccccctaaaaatggcaatagatttacatggatatttcattaaagaagatacacagatggcaaataagcctatgaaaaaaattctcaatatcattagtcattaaggaaatgtcaactgaaatcataatttgatgctgcctcatacatattagaatgtctaaaattaaaatggccatatcaagtgttataaggatttgagtcaaatgaaatgctcacaaactgttgggtgagtatgtaaaatattataccactttggaaaacatttttgcaatttcttaaaaagttaaatatcctctttccacatgc

SEQ ID NO: 6035 - DNA, 590 bp, mus musculus
ataaggctgaggcaataataccttcctacggtattgtgaaagttggcaaaatgctatacatttgaaactaatatggcatctcttaaatggtaggcaatcaatagatggtagtcataatggagcagctaatattattttattacaattattgaaaatacaatattttgaaatgactttgttggattaattcctctttgccacagagcagtctaacgtgactttgtgctgtccttgtcacatacctagcctctcacctgcccatcctcgagtcatgcccggtggaaagctatgctaatgttccagttcatttgaaaagtgggctgcagcaggaggaacagaatgatggagaggagactaagcacagatttatatctgcagtgccaacaccttagggccatcctaaggagcttttctactgagtctggaatgtgcagttggcatggtaatatgaaaaggtagtgagtgaggtttgtcagagagaaaagggctacaaatcagcaggtcaagttttcccagcatgtttcaaagaaacttaaagaagagatggccatgcttacttgcccttgtctagatggggactgaaatcatac

SEQ ID NO: 6036 - DNA, 708 bp, mus musculus
tgttttttgcaaaacttattagaaatctaagtggagatacctcgtagacaggtagataatgagagatgccatgggttttaaatgtaaaactgggagtcagaagcatgccaggtatttctgagtcatgagactgccttagatcatcaagaagtcaatgtatagacagaaaaagacatgagactgtggtcaaaaacttgggaactttaagatttagaagacatctgcgagaagagaaacaagccaagaagactgagactgagcagcaggtgagacaggaggaactatgactgtagtctgaaagccaagcagggtgtcaactttactgaatatttccaagagatcaaataagatcagaacaaagttttgaatataggacttggcaaaatgaaggtcactgatcttcttaaaaagagtgttttctatgaagtaatgagaggaatgcgagttacaagtcactagcagagagaacagaaggtgatgtattggtggcactgcatatctcttttgggaactatcacttttatcaacttttactgtgaaggagagctgaaaaatggaaagtaatgtgagtggaacatggaatcaaggaaccctgttttttgtttttaatgaaaaagatttcaaacttaaaataatcaaactgaaagggaaaaatataataatgtaggaaaaaaggtaaacataattgctggaataaagttcttgaaa

SEQ ID NO: 6037 - DNA, 2031 bp, mus musculus
gtggtatctctttatggttttaatttacattttccttatatctacagatgttgagaattttatgtgcttattggccatgtgtacatatatcgtctttgaaaatatgtctgttcagatgctctccccattttgttttcattattgtctttgtctttcattattgagttttaagttctttatatagtcagtctatcacatatgtgatttaataattagacatatgttttgtaaaaattgcctccatcttctgagttgtcttttcaatgttttgatggatgttgtacttttaacataataaataaataagtattggataaatacattaaatcattaattcttctaattatttctgtcagtcagttcaatttttatttataaacaaattttcctggaaacttacattcctctgagtgcatcagcttcattggttggtcattagttacttaggggaatagtcagtcacagcacagagatttttgcccctatgacaatttaggggaaatatgtgggacacaactcgaggaagagagtctttgttattaccagctattcacccacctctggtgcactctcttcccatactccaccctcacaaagttgctctgtctcaaacaaaaattcccataacttgacccatatgatgtttttttagattatattttaattttaaaatcaacatcaaaactttcccttgaattgatattttctcagtatatcttttttgatccctggctctgtactttgccctgagctgcttctctcagttagaattacttagataaagaatagggagaagaaaattctcaggggctagcccacttatttgctgtaaatataatcagctcagctagacttccacattgtaatgatgtcaccctgttacctctggctggttctgctttggtaccaccagtttttatgtgcacaatagtgcatatacaagcaactgtcccttcagggttaagtaggggagagaaaaaggcacaactataaagccgctcacccagtatgtgacatctaattctctgctgacctcaactcccagtgtctccattgcagacagagtcccaaatattttctctcttcctaggagtttattaccatttgtcttaggtcacaaaatacatcagtgtcttttctttgtccagttttaggtttgaggagtaaaccagcagccatggaaattcatcttgttagggctcagaagaatttttttttctttttaactatttgttactggaaatttcatcatatttgaaagattcttaccccgtgtcactgagtatccttgtcactgtccctaaaggcttactaacatttaactagcatctagaaataacctttaaaatactatttacaatgatatctccaaggattcacaaaaaacttacaacataaaatgcttttattaataatgtaagaaagagtaagtgtggaaaagaagggtttggggaaaaagtatatagagaaagacgtcttttatcataaatacattgtaaatagaatatttttaaaatattgattttggcaaatgcctatggtttttctcacctcttgttttattttatttttttctttagagataagctatcactctgttgcccaagctggagtgcaagtagcatcacagctcattgtaacctcgaactcatgggctcaagagatcctcttgcctcagactcctgattagctggaactacaggcacacaccaccatgtccagctaatgttttaaatttttgtagagacaaaaatttttaaagttttgttgcccaggtttgtgttgaactcctggcctcaagcgatgctcctgccctggcatcctaaagctctggagttacagacataaaccacaatgaccggccatggatagaaccttaactaaaggtcatatttcaggtacaaagaaaaaaaattggggaagtaaggacaataggagcttaagagaattttaggcaggatacccttccaatgtccctcgaatgttgaatgttgcttacgtacttatctagaattgtagctgtgttattgg

SEQ ID NO: 6038 - DNA, 298 bp, mus musculus
tccctattaaaaatgagaaagtaaaagagaaatatttgggtcaaaaactgcaaataggatattattcatggcatagttctgtgtgcttatgcaaagtgtatctgtattggagaattagtttagtaatattccagatggttacaggaagctagaaacataacattacatggttgtctttgtgatgtaatttttgtaattatttttaggtttcatggaagttggcaatagaaaccttaattttgaagaaacttaaagtaacagaaacttaggtgtaatctcagcaatgagaaaggaccat

SEQ ID NO: 6039 - DNA, 336 bp, mus musculus
tttgctggcactataagacaaagttaaacaggtgtggacaaggacaggtattcttagtctcgactttcaaacaaaaacttgtttacttatgaacaaaagaaaatgagttcaaacatgggtggtgacagcataaatgcaaaagcgctgaattgataaactccctcttaagggcttggcaaaactttgtatcatattaatctaaaatttttttacaaaaaataatgtatcatgtgaggcttaatatctgaataagtcttatggtcctaatccagtctccatgaaacttgattggatgataaagtgccaaaagctgaatcttggaaggtaataaaaaaa

SEQ ID NO: 6040 - DNA, 345 bp, mus musculus
gggttaagaattccctgtaccacaggttaaaaatccctgaaaaggggattaactcttcaattcaaagctagatagcaaatgtgtaagtgtctcaaaagcaaaattctgagtttgcaatctagaaacataaaaatactttaccaagtatgtgtttattttttaactaaaagtgttccttggaaatatttaaatgtcttggtaacctattttatccctgtttggttaatagagtaagttcaaaggttctattggtagcagtgacatcagagaaactgttatgatcatcactgggacacttgtcagaaagttgtgtcagaatgaaggctgcaaactcaaagtaagtgc

SEQ ID NO: 6041 - DNA, 558 bp, mus musculus
tggtcagacatttttcctatgggcatcagataaaacaatgctgtaattcaaattatgtaattccaaaggaataaagctgccaatctccctccctataaaattaaaatccatgaccacaaaccatctcttcatgttaattggtaactacacattagattcctaatatagttaatgtcctgatttattgttttcctcaataaacttaattcctcaaaatatacaaaataaattacacgttaacaattccaagatcattataaaacagaccctctcccacatttctctcagccctatgcagtggttttcacctaaggacatgcttggaatcaaggtttcttttctccatttacaatctggtactgatacgactccctcaagcatctcttgtgttaaattcttattttttccaactcaaatatggataaattcattatgttttgtctttaatgtgtcccacctataccaaaagctacgatttaaacatacatgaatcttaaaaacacaagtcataaatgtaaagccaatgtatcttgatgcaattctcttataaattaatat

SEQ ID NO: 6042 - DNA, 986 bp, mus musculus
tgtagaaatgactacacagagagcgagtaggagactatttcaagtggctcaggagagatcaagatggctggggtcaggaatgaagtgggaaaggtggtgatatggtttggatatattttgaaaataaagtcccaagcacattctttctcaatatcttatgtcagcaactttatagaaacttcacactctaaggaagtagagtttcctggaaaatctttattacttaattaagtagggaaaaatactttcaagtggtctcctgagtcccttctcatttcaccatccttagccctactggaatgccaggattcagcaactcttctgggtgagtaggtgaccaaaaacaatgatctctggttccatattcatttaggaatgttgtacttggcacaatggatttccagtggctaaaggcttatttccttaggtcaacataccatctggcagttaacaaagactttcttgataagccttaagatataggacaagccagagcaacactgagctctggaaatccagtggaagtgttgaatttatactcagtgtggagctaatgcaatcccctcctcccaaccaactcactattcaaaagaaggaatagaaataaaatagcaatgacaaagaaatacaagacctacagtttcccagaagtcagaatcacagaactttctgttcaagtacttctacaaaaattaactttgcttgctagcaagagaagttaggacttaataccaaagaataaatctttatgtgacctcagtgatataattgctttttccattaatgtctcatgtcaagtctgagatttcaataatacttcattatgtttatgtattcataccttgcatctccatcctgattttaaatcccttcagaggaagtactgtaccttgggatgcttttactcaacaggtattccacaaacgtgttaacctaacacatattttacacaatttctctggtttctcagaggatattttgaagtc

SEQ ID NO: 6043 - DNA, 354 bp, mus musculus
gaaacagattttttttaaaaaaatctgtacaccctttatctcttttcttgcctttttgggctggctagatatcctggtcctatataggatatgagtagtgagagtggaagttctttcctttcccctgatcttaggaggaaagttccccagtactcctagttttgtgatagttttcatcatgaaatggtgtttttatcttgaatcacaaatgggtgttttatcatgaattttgcaaaatgcttattctgcaccaattgatatggttatataattctcccttagccattaatatggtggagtacattaattgatttttgcatattgaaccagttttcaaagaactggtccatttca

SEQ ID NO: 6044 - DNA, 1743 bp, mus musculus
taaaatgccatatatatttgagttattttttttttactttctcttgttctgttgttctctttttctgttcataaatgagtcgtgacagtgtgttttaatctgataaggctgctcccctcctcccgttgctcttcttttgcagaagctttttggatattcttatttatattgtcttgacattcaaactttagaaaaaccttgtgtatttatgaaaaataaaatgttactgggattgcttttatttataaattaaattgaaacagtttatgtccttgtgatgttgagtctttctctccaaagaaacagtatgtcatcccacttaccttcatcttctttcatgtttgcaaagatggttttacattcttctttcttttttcttctctttctttgagcatttttgttaagtttatttctctgcatttgattatttgttgctatcatgaattggtcttcatcaggatcttctaacagattattgtttacatgtaatcaaggctattaatttaagtgtgctgctactggcatcttactaaataactttgatggttgtattaaatttgtacttgattttcatgagcttcccaagcatatgagacatcatctgcaaatatagtgatagtttctcctcttctttccaattttaatatctctaattttgtcctcttgtgaattgtaactattcactgagtgaagtgttatttaatagttgatagtgggcatccttgccttgtttccaactttagtgaaaatgcctctattattctcccattgagcctgatactctctctgtgactgaaatagatgtgtttatcaggttatataacttttcattgattactattctgagaattaatttttatttgtcaagaatgcatgttgaatttggtcaaataccattttagtgtcaatggagagaggaatattctttttctctttagactaattaatataataaagtagttgaatagatttaataatattgacctgattttgtgttctaggaataaattccccttggtcatgatatatttttctcgtaatgtgctgacggcttctgattaataaattttattattttaacattgaaatgcatgagttaaaatgttctgtagcatatgtttttctgaaatcattgatgattttagctatacatgtttcaaataggatttggatatacttttttatatgccttggcacattttagtaacactggaattatatatttaaatatttatcctgatctatggcagagggttcctggtgggagttccctcatcggttaaaatgttctgctttcttcatcattttttctttctataccttttctaagctactatactagttctttcattaatacatgatattcagtgagtcagctttgaagatatccatctactgtcaaaggagccaggttgttttacaggttcaccaagttttggctgccacaaaataagaaggcttcctgaaagcactgctgcttggcatacttcttgtagtaaccctgtcaccgtctgctttttgaagctaaactaggtatgtggtagggtgtgtgtgggtagggattgtggttctgctcccactcagttcccccatgcctctcttattaccagcaaggctttaaccccctggatgggccccttgccatgaggaagtgtacttgtgctcttcctccctgggtctgctgcagctgcactctctttgcagggatctcttctaagcttccctcattttccttctgttggc

SEQ ID NO: 6045 - DNA, 1743 bp, mus musculus; identical to SEQ ID NO: 6044

SEQ ID NO: 6046 - DNA, 507 bp, mus musculus
tccatgtacccacatttcactctccttcaagtcaaaagggaattacaaatagaaaaataatgttttgtcttacaaaccatgttacacaaatgctttatttctgtaattccaattacatgctgtaaatctcttcagatttctttctaatactattttcatttgtatttcatttcaacaaagatttcggggagactttcttctactactttgcttaagttgtaaattccaaagtgctatgattttctatacacctatatactttactcagcatattttcaaatttatggctttgtcgaaatcatttgtatgcctctcaagcctgtctttaatctttttttatttgaaaacatttagaactagtggaataatgcactgtgattactttatcccttttgattctcaggtattatcttcagattatttctgcttcattatttcatcattctccagtaagatgtggcagtcttatataaatctctgcaacaggaatttctaaagcctcttgct

SEQ ID NO: 6047 - DNA, 1126 bp, mus musculus
gaggccatatattcttgcctctttgcatgcaccataatttgatactatgctagacagtgtataaaaaacaaaagagtgaagaaaatactatctatcccagaaaaggacatggcagaaaagcacatggcccttttcctgacacattgctagtaccagggggctgagtcaacataagctgcttttgagctgggtctgagctttgacagagatttagttagagtcaattcaccacatgcttcaaatactttgagggcacaatcagaattttattttcagtagagctttgactctcagcacttgtaagactttgcctatctctttgtacgcaagatcagcaaccacccttcatactggtaggacacatttctctataggctacccaccagtttttgtgttttggtttgtttgtttgtttgtttgttctactggtgaattatctttgttcctgtgacctctcctgggctttatttatttattgccttggaaggactctcttcactctgtcacccttcccctaggctttggagagccatttctgtgttcttggtgaaggctcagtggcttcagaggaatttttctcagggctcctgttgagtccccagcctgtagaggtatgttacattttattcagtgccatgtaccccagagagattttccttatctcttaacctgtcccatgtatgtacttgaaatacaccaagacaaagggctttatttagactctccttcctccccacccgggcttaaatgcactatcctttgttcatccaatgaacgtctgcggaacttgctggtgggtgaatgcagacttatattaccaggctcttccagatgttaatccttcatgccaggcttcttgtattgctaaaagtgtggctagttttttcttaactcatccgtagagaactccttttcttcctgcctgaaagcagtcatgggcttctcctcttgtaggaaagattcataactttctgcatcttctaggatgtttttttagtgtctttgcttattctgctcagttatgataaagaaaaacaaaaatcaaacaaaaagataaaaagccaaataattttaccttgtctatcttgctatcattcttaggatacaaacaagagtagtatgttat

SEQ ID NO: 6048 - DNA, 640 bp, mus musculus
tttcaccctttttttgatattttcttccatatgcctaaatatacattcagaaacctcttgagtttacagttttagctattatctgttgacttgttactttggatgaagaaaatgtatgtcgtttatatttactccaactcctttctatgtgcgactgacacacacacacacatgcactcacacccattttcctaacaatggccatataataatttttggtaagattaacattcactttcagcattatgaaaactgtaaatagcatcatagtttagttgtataatattccataatcatattcactgtctctttggttttagttgttgttgttatttaaatttctttctctacttaccgctctcctgttaaggatttctggtttcctggaccccatataagccttctcctctgtttacacacttcttttggtaaacacagattctagtgatttcttcaaaaagagtaaatgggaggcaagtttcttaagatcttgcatgtccaatgttgtacacttatatttgattaaaactttaactgggctataaaaattctatatgtcttctcagaatgattttcctcataattttcaacgcatttctatttttttctagttaccagagttagttttgagaagtctgat

SEQ ID NO: 6049 - DNA, 1590 bp, mus musculus
gcatttggtttgcttccaagttttgctattataaacagtattgttaagaattttttttttgtatatgtctcttactgaacattagactcacacctctgtttcccactgctccacaccccagcattccactttcagatgagcatttctaacacatgaaccttggctggaattcaggggagttgcacacagaggacctgctccatagagaggccatatggaaaagcgatatgattctatgagaggaaaaggaaaaagtatcaaaatggagagaaaacaatggtgaccataagcaaaaataaataagttggcctccaccctgaaatctatcagtgttctatgatgtgggccatggatttgagaaaaagcaaaataagttaaaaagtgaggcatctcatagccctggggtctacaggggaagtagaacagcctcagaaatgagggagcaagtgtcagagtaggcagcttggaaaagcctagagaaagacctacaaccaggctctgcaagcttgggccagtgtgctcaaaaccacacttttgttgccatggggaataaggcaatgttctcttttcttacaccatcctcacaattacccttaacaaattttagtcatctatattactatggtgagactatccatcccacatttcagatatttccaggaaagtggaggtggaaaaaaccagtttggcaacactgcatgaatctaattacagaataaaatgtctgtaagtaattactatcatagatgcgtcaaaaatagacctgagcccaccagtaatttttttcaacattctaattttctgtcttaagttcacccttaggcataaaccagaaggcctctcatgagacagctcttgcttatccttctaacttcatcttccaccctatgctcacaaggtccaaatagtctagttagagagagctaatgctgatccctaaagtcatcatgattagtcgagcctcctctgttcatgccattcctactgtctaaaataccctttcccatctcatccactaatttctaagtggtcttcaagaatcattcccttcttgtaccgtttgctttccctgtgcccttcattagtcccttagatcttttctctctcccttttttccctcctctatatttccaacttcagtctaaggcatacaaaacaggccaccacatcataaatatactcttagattgaccccagtcaaatttgcttttcctcctattagattttgtttcttttgtgtgagggatatggtaaatgacatccagttgacaatccacaaaggttgatagagtagatgttgtacaggccatactctacccatcttaacttgttgggacactcatctcccagatactgagaataatgtggactgatggcttatacctgccaccttctcaggaaaatcacccttgattgacagaaagcacctttccagaatttgcctgggagggagctatgccacccgtttgctgtggtcagaaaatgacgacactttcatacactgaaggggtacgagatccctgccccttccttcaatagggcaaacactgccatcaaatggatgcttcagcatctggagggtcaggccaa

SEQ ID NO: 6050 - DNA, 863 bp, mus musculus
ccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcagggtaaggatgatctggtggcttggggatgagtgtactttttaaagttgtatcaaatgctctatgttttagtataggatttaccaatagaaatctttcacatatattatctattgtgacacagacttcaattttctgaggtgaggagctgatgattttataatctaaaatgatttatagtcacagaagcaaaaagcattaggaaaccttgggagagtaggggtgtctaaggctgagagagagaagaattcatctaccttgtgccctaaaatatatctccagtcatcatgtaagaacctaaagtagctaaagtttgaaactctgattccagttgtcttagtccatctggactgctaccatagactgggtgacttatagacaacagaaagttatttcctacagttctggaggctgggaagtccaagatcaaggcactagcagatttggtgtctgataaggactcattttctagttcgtagcagatgccttctaactgtgtcttcacttagtggagaggactagatagctctctggggcctcttttataagagcactaatcacatttaccatcttttggaacttagacacctccaaaggcctcaccttctgatttcatcactttggaggttaggatttcaacataaattctggaaagacacaaacattcagaccataccaccagtgaatttaagagtatagcacactggatttggag

SEQ ID NO: 6051 - DNA, 594 bp, mus musculus
taacttaaaaatttccatgagtttgagtgtttaaactatttctcagagtgtatatgctaagttggttatatctcacatttagcggagacagccaattatatttagcatagacagttctttatgtagaaactgaagctctgaggtagttacctataaataatgctaagtggtttctctaaccttgggtagagctctctgcagggattattagtcacctgaacttggccttaatgggcaattgtcaagaatattaagtaatgtgtaccaaagctaccaacagctgatctgcacgtggagttctgcatgtgttcagcgtctacagtctgaaaaatcacaacacatcttgtcaatttcttcccctagaaacacacacacatttaattggatcaagacctctaaatgctttagtcttgaaacaaaatagccctgatataaaggttttatttcccatttattcctcttggactgatggcttaaattctgtaaatgaatgtgcagactatcacaacagatttattctgtgtatgagttatacattgaaaacaagtcttcttaaaatttgaaactaagtttaatgtgcatattgaaacatgt

SEQ ID NO: 6052 - DNA, 872 bp, mus musculus
aaaaatgcatatgcttttatcctcgtttctccaaggtcaccaggaccaaatgttgtttctggccacactaatcaggatggcctgatcagctcatgatcaacatctcttgtgaatctctgatgtgattcctttcagacatgacctggaaatgatctatccctccacaagcaataataggaggtcctagccaattgctctacttctgcatcccatttatgatttctctggtgtttcatgaacaagatggtggtcttcttggtgggcagtattctctccaataatttaaaagtcataagattactagaaatcagcaacttatataattatgtctagaactagtcttgattaaagagatatggaagcagatggttttcatgattcatattagatctattccccattccaccccagaaatcagacacacaatatgatctgaaatgtagtatctagtttgtgctttcaaatatttggagaagtgacttcctttctttgaatgaatcagtactgtggttcctctcctgtcatagacaacctttggccattctgtttttgaccttctccagatccacaggatgagcaggaacggatcgaggaaaggctggcttatattgctgatcaccttggcttcagctggacaggtaaaaagaatgtgacccaggttttcaacaaaacctgacatagatgcatcagtcaggtgtcattcacagcataaaaggtaccccccactttcttgagaaagaatacatgaaaagaagaataaactaagaactagaaaacctgggctctgcatcagctaatggtatagcccagggcaggccttttatcatctctgaaatttagaataatagaactttctatttgaagatttagag

SEQ ID NO: 6053 - DNA, 872 bp, mus musculus; identical to SEQ ID NO: 6052

SEQ ID NO: 6054 - DNA, 4007 bp, mus musculus
tgttttactttagaataagcacaagataagtttatctttttaaagtatatagtatgaaattgtattatttactgaaggttttttctgtctataaaatacactatttagataaataaccatgctagtataccaactgttaccattacaagctgtttcaaagagaaattactttttctaagttgatcattagaaacatatgctagcaaagcaaaataagtgccaaataagattttacattttaagcaaaaagaggaatacactttaaaaataaccctcaaagttattttaaatagcccactttacactcatatgattttgcctttgggaagacacaagatggaaagtatcttcctaaacacatacacacacacacacacacacacacacacacacacacacacgatggaaagtatcttcctaaacacatacacacacatacacacacacacacacacacacacacacgttgttttaggcagatttttttttttttttggaaagtttccaattttttttttttttttttattatactctaagttttagggtacatgtgcacattgtgcaggttagttacatatgtatacatgtgccatgctggtgcgctgcacccactaatgtgtcatctagcattaggtgtatctcccaatgctatccctcccccctcccccgaccccaccacagtccccagagtgtgatattccccttcctgtgtccatgtgatctcattgttcaattcccacctatgagtgagaatatgcggtgtttggtttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatactcatttgggtatatacccagtaatgggatggctgggtcaaatgttatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgctcactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctcttgagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcagttttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctgtgttcttttggcttaggattgacttggcaatgcgggctcttttttggttccatatgaactttaaagtagttttttccaattctgtgaagaaagtcattggtagcttgatggggatggcattgaatctgtaaattaccttctgatgccaaagccgggcagagacacaaccaaaaaagagaattttagacaaatatccttgatgaacattgatgcaaaaatcctcaataaaatactggcaaactgaatacagcagcacatcaaaaagcttatccaccatgatcaagtgggcttcatccctgggatgcaaggctggttcaatatacacaaatcaataaatgtaatccagcatataaacagagtcaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattaaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccataggcagatgtttttgcagaggcaagggaagagaggaagatttaggatgtgctctggccaagcagctcaaaaattactctatcacagatgaataagcatccctaccaaacacactgtcatcgtccttctagttctgtgtaatagataataaaaaaccatctgtccattgcagtaatttgccaagagcacagcctaacatattatttcattttactaacttaaaaatgaaataataaacagtattcatgaacaaagtttattattttctgcaatgtttgaaatgaagtgttctatgactaacttgacaaaataagtcatggaaataataaattttgtggtttataatgaaaaaacaaaatgcctgtttttgactccttcaaaaaagaacaacaagaaaaaaaaaacaaaactaagattagttttgattactctttcatatctacttttctttaaaaaaatcaataaacttttttttttcagatcagtttcagggttaaagaaaaattgggcagaaagtagaaagagttccatatactttctgtcctactgcccttagttttccctatcattgataccttgcattggtgtgacacatttgttacaattgaaacaatagtggacgggcgggcccggtagctcacgcctgtaatctcagcactttgggaagccgaggtgggcggatcacctgaggttaggagttcgagaccagactgatcaacatggtgaaaccctgtctctactaaaaatacaaaaattagccaggtgtggtggtgcagacctgtagtcccaactacttgggaggctgaggcaggagaattgcttgaactgggaggcggaagttgcagtgagccaagatcatgtcactgcactccagcctgggcaacagagcaagactctggcaaaaaaaaaaaaaaaaaaaagtactgacactatagatgttataactaatatctatagcttccattacggttcactctttgtgttgtaacacatctatggg

SEQ ID NO: 6055 - DNA, 1282 bp, mus musculus
ctgcatagaagtacaagtagatgtaatccatgttagcagaatcactggggtaaagccatgggaagcaatttttttttttttttttttttgagacggagtctcgctctgtcgcccaggctggagtgcagtggcgggatctcggctcactgcaagctccgcctcccgggttcacgccattctcctgcctcagcctcccgagtagctgggactacaagcgcccgccactacgcccggctaattttttgtatttttagtagagacggggtttcaccgttttttagccgggatggtctcgatctcctgacctcgtgatccgcccgcctcggcctcccaaagtgctgggattacaggcgtgagccaccgcgcccggccgggaagcaatgtttgattcaatgtaagaaagaagttcccaaaatctagagcctaaggattgaccaagatgctctggaaacaagtaacccctcttctctagagagaagactcagtgaggtataagctttcaactttattcgaagttattagagaaatttcttggaattgatttgtagaaaaatatttccaattttagcttatattttactttaaaaagaaaaataggagagagggagctttgtactgtactgaaaatgagatgacaggatgttgaagttttacccaaggcccccagatacaacagatgctgcccactgaagtgagattccagattcaaatgcagactctacaaagaatatagtagcaaatgacttccacaattcttgaaaccttcagccaggtccaagtgattaaaaggggttgattatggcaaggagagaggattctgtgagaaggaattccagagtgctgaagatgtgtgtgtttggagtgggtggcgtggagggggtttcacctttttacctcaagctgtgtgcaagaagagtttcaaagtgtcttcttagagaacttcatgggagatacttgcatgaggatgggtaggaggtcagagtggggtctgagtgccactcaggaaatttggagggaaagggacaggctgacaaactgttctggcacagaaccaggacattttcttctgcatccccacaggcaaatgatgtgagtgttccccatggaccaggccagtccaggctaggagcaagggagagctggctggggtcaacctggggcctctctgagggggcagatggatcctagtagctacacactgtaggtagacagcttcctaagggagcatataggatgagtccaaagtcactccctagaacagagaagaattagcatgaatcaa

SEQ ID NO: 6056 - DNA, 712 bp, mus musculus
taagtgtttggccattatttgttgaatgtatgaataaatattgcgtaagattgttgcttttaaacatgttcaaccttaagaccaagcaacgaacaatcaatacttggagactttagagttacaatttcgaacccaatcaatctcattttagattttccttgacacttaggaaagtggggatggggactcttttttgccagacctgacccataactggtaatctttctcagcacccttaaagacaaaatgaactaataagaattacaacaaatctttcacagtaaatatttgaagaggatcacacttccttaggatttctacattttcagaaaggaaaggaactaggaccagtcaaaatgcaattttatctatggggctggccatggtttttgagttaacagggctgatttcagtaacccctgttttccacccagcttctaataaactattccagattcttgccttgtcccttttgaaaggccatggatctgtgaaaccacagtgcaatcaatccctcactttctgagtgacccatggaatacaaaatcacatatacactccctcactaaaaaagaaaaggctagctggggagtcatgctttctgctatacagactttttggagaatgttgaactttgccttcacatctccctgcccagacaagcctgttgcacagacagcgatacatccacatggaaggcatcagaagctca

SEQ ID NO: 6057 - DNA, 368 bp, mus musculus
ttttaaagtactaagaatctctaccttctcctatggataacagtggggactaatgtccagctgtgtccttgatgctgtgctcattagaaggagccgcaggttttagctcagtcattctgacccttggcaacatattagtgttgcctaaagaccctggccctgggccactcctagaccaattaaatcaaaacatatgaggatggtatccagacatcagcattttcaaagttctccagatgatcctaatatgcagccatggttgagaacaattatgttagctccttgctactcaaagtgcaatcagagaaccagcagctttggcattacttggaagcttgttagaaccattcagttttgttccaccctca

SEQ ID NO: 6058 - DNA, 407 bp, mus musculus
gacctaaacatgcacagattcagccttgccaatcacttcttgttttattcaggattctttcaaggtaagtgacaaggagccaactcaaattactctgagggaaaaaataggaatatgttggcttatgtaatgaaacgttcaggatttggtctgcattcagacacaacaggagcagatgttcaaaacaatgtcctaaaagatctctcctgtcctttctttcccttgttctccttttcctggtgttaatgtcaatcttcagaaagtgtttttcttacagctcctggcctcagaagaaaaagaccacttctctcttcccaatgttctcatcaaaccaaataacagatatcctttactcttctcctctccacacaattcccaacgaagagagatatatgcaagaaacaata

SEQ ID NO: 6059 - DNA, 1924 bp, mus musculus
ttccagagctgtcagctttctggctatagcttggatatcagccccacaaggacccacaaatacaaacctcaacataggatgacttactgtgcctgatacgtttttgcctttttagtccatagtagacaattatcttgactataattgtcccagcaggagctgcctctgtgtctgtgtatatgcgtgtgtattttttttttctaaggcaaaaactagtttatatctttgttcaaagatgaccttagcaggagacctttttttttttggagttgatcggtaggtcaagccatgtgctaacctggcttgtctgggtatgtctgggaagcagagcaggaccaaggctgcagggcctttatggaatttctgtgctaggaagggagatagacatttaacacaaatatctctatatcttgacatttgcgatatggcaggaaagtacaggcacctatgggactataaaactgatcctaaaacaagcaggcatgaggaggtagtgaggtcacctctaggaatgcctcctcaatggaaacatttgcactgaaccttgaagattaggtagatgagccagtgcttttgcacaccttgttccatgaaagcaagactgtttttttactgttgtattccccagtgtctgcttccttgtaggtgatcaataaagatttcttgaataaatgaaagaataaggggctcccaacatctgtttgctctcttatccctctccttccctacccagtggttcctgttctctccattcccttaccaactggtatgttatttttaaaactaaaaatactctgttttatcatattattattcaattaaagttagaaacatttaaaatccccatagatgcaaatgctagaacaatgaaataaaagctcaagattttttctgcccccaaagctctgtggaataatcaattttataaatttttaaaaaacaaaaactatttggaaggctgaagcaagaggattgctccagcccaggagttcaagaccagcctgggcaacattgcaagaccccgtctcctaaaacaaataagtaaatacaattttaaaaaggaaaaactaggcttcaccatgcaagtttataatgaaaggttatacactgaatatatactttagctatatatttcaaagacctcaagataacgttaaggccgggcatggtggctcacgcctatagtcccaacacttgggaggccagctggggaggaccacttgaggccaggagttagagaccagcctggacaacatggtaagacttcatctctataaaacataaaaaagccaggcgtggtggcatacacctgtagtcttagctacttgggaggctgaggctggaggatcacttgagcccaggaggtcaagactgcagtgacccatgttcaaactacttcattccagcctaggtgacagagagcaaccctgtcttcaacaaaaacaaacaaacaaaaacaactttgaatcagcaaaattaagcaaccaagtgtgttccccttctctaatgtcattaagctttgagtgtgtctttacagaaatttttattttcttatgtatggcatcctagattgtatgactttaacataatcccagatggattaattatcatgaagcctattttgcagacgattcaagggaatttagcccaagagcaaaagttaggtaattccttaaatctgaaatctgtcctctgaaatactactctactcaccgcttaaatggttttcagtgaagtggcattttaaaaataagtgctgcttgctttacctctgaattcccttctccaatgccattttactccctgagctgctttcttggcagtttggggcaccccttgctgtttgtgcctgtgatagtctgacttccatctgctgctctgcagccaggagcctgctgtgctcccttcagtcacatctttcatg

SEQ ID NO: 6060 - DNA, 194 bp, mus musculus
ccagtgaacattcttaaaccaataactttcattactcatgctggcatgctcagtaggtggaagccagaagtaatatacttagacgaagttgaactataaacagagtaaagttgcttaccaagggtgcacacatttgcagaacagattaggaattttgttaatatttgatatcgctatttttcaataatgtcttt

SEQ ID NO: 6061 - DNA, 2516 bp, mus musculus
aatagtttttattcttgttttatggatgagaaaagtcaagttcagagagacgtgattagtccaggtaactgcaattgtaggtaatagagctgggattttaaataggtgttcctcagtgtaaagcccatgatttctctacttcactgtagcagcagatgtgaggagttaccattaagtcctccagacctgaggtaaaccataaaatttgcccaacgtttttatattgccaagtatccaggatacacaggaatggaatggaaattttgagagaaaaatcagcatcttggtgaagctggaagaaccataaacactccacacatcatacatcaaaaaaaaaaaaaaaatgctactctgaccaactggaaaatggtttagcagttccttcagaactatactcagaaacttccttttaagaactcttttatatgacatattcacttgggatgctatcaagaaaatggatgggtaatagtggtgactcagtctatgctggttctgagcaggccacacaagcaatacagaaaataggaagaaagatttgtgtgattaatacagtaggaatcagcatatatgcaatgaaggccactcattagtttgttcctgacactcgtgtaaaagaaaaaagctttaagaaaagggttctttggtcggaagcggtggctcatgcctataatcccagcactttgggaggtcgaggcgcaaggatcacgaggtcaggggatccagaccatcctcgctaacacggtgaaaccctgtctccactgaaaattcaaaaagttagcctgacgtggtggcgggcgcctgtagtcccagtgagaggcaacagcgtgctggcagaactcacagcccttgctcgctcttggcgcctcctctgcctgggctcccactttggcggcacttgaggagcccttcagcccgcccctgcactgtgggagcccctttctgggctgggcaaggcccgagccggctccctcagcttgcggggaggtgtggggggagaggcgcaggggggaactggggctgcgcgcggtgcttgcgggccagcgcgagttccgggtgggcgtgggctcgactgaccccgcgctcggagcggcccgctggccccaccgcccggccagtgaggggcttaacacctgggccagcagctgctgtgctcaatttctcgccaggccttagctgccttcccgcggggcatggctcgggacctgcagcccgccatacctgagcctccccgcccccatgggctcctgtgcaccagagcctccccaacaggcacagccccctgctccagggcgcccagtcccatgaccacccaagggctgaggagtgcaggcgcatgtcgcgggactggcaggcagctccacctgcagcccctgtgagggatccactaggtgaagccagctgggctcctgagtctggtggggaggtggagaacctttatgtctagctaagggattgtaaatacaccaataggcactctgtatctagctcaaggtttgtaaacaccaatcaacactctgtgtcaagctcagggattgtaaatacaccaataggcactatgtatctagctcaaggtttgtaaacaccaataaacaccctgtgtctagctcagggtttgtgactgcaccaatcaacactctgtatctagctaatctggtggggacgtggagaacctttgtgtctagctcagagattgtaaacgcaccaaacagcgctctgtcaaaacagaccactgggctctaccaatcagcaggatgtgggtggggccagataagagaataaaagcaggctgcctgagccagcagcggcaacccttgagtccccatgcacactgtgtaagctttgttctttctctgtttgcaatagatcttgctgctactcacgctttgggtccacactgcctttatgagctgtaacactcaccgcgaaggtctacagcttcactcctgaagccagtgagaccacgaacccaccaggagaaacgaaaacacgccgccttaagagctgtgacactcaccgcgaaggtctgcagcttcactcctgagccagcgagatcacgaacccacgagaaggaagaaactccaaacacatccgaacatcagaaggaacaaactctggacatgccgcctttaagaactgtaacactcgctgcgagggtccgcggcttcattgttgaagtcagaccaagaacccaccaattccagacacaccaagtattcgaggggactgaggcaggagaatggcatgaacccgggaggcagagcttgcagtgagccgagatcgcctcactgcactccagcctgggcgagagagtgagactctgtctcaaaaaaaaaaagaaaaacaaaagcattctttaacacagataaagtgactgtgaaagcaagcacataaaaacaagaaatacaaataaaagaaaaaaatacagtgggaaagaaacaaattcccctcaggtgtgcgggagaatggaccatgcccattcaagatctcagtaaccatgtgtagtcaatctagag

SEQ ID NO: 6062 - DNA, 977 bp, mus musculus
tatatttttcctgttttaggattcagccaaattcagtgtcatgagttattataaaaacagtcttaaagaaaagtgctcaaatggtattgtcaaatttaagagtataaaataaaaatatctcggctgaaatgaatgtaaatgtatatggactttaaaattaaaaaaacaattaaaaggcttgcttatagtatacattctaggaactaaactgcaaaactcgtttgattgactatgtctgtggcttcaaagcagatagaccaagagaaggaaaagagaactatcaaattgcaaataactgccaactttacagcagtgtctatgagaggttctttcttaattaccaccgcctgtcctgacattgggtgtacaaattactcaatatgttaaaccactcctgcctttcagctaaatagatatgaaacacatagaaatggaaacaaaggcagactttgaacttttgatacttcatgtgaacctccattttaaatatacatttctcagctgttagttctcacttcagtttcagaacaatgtttttgacctaaccttcctaccaaatcctgttatatgaagcaagtaagtgtattccccctcgggatccttgaaaaatgacttaatttgacaaagaaataatctctctctctcactctctcttttttttttttttttttgactatgggccaatgtcaaacctgaaaaatgatactgtacccttcccaaagctaaataactggaaaagagctactaaataaactacttagagacatgctaacattgttttatggtacttttggctgtctaattaggtaggtacagtaaatcctagtgtgcaatatcagcaactataataatatagatgtctattttggttcacaaaattaagaaaaatttgttaatgcatcaaaagttgaatttagaatgtaacataaatctcaaatcagtctggcatgtcttggcaaataaaaattataaaatat

SEQ ID NO: 6063 - DNA, 901 bp, mus musculus
ttggcatgagggtggcagcctttgcactatgtgcatggctgaggagttaggatctggagggtgatgaaaggtaagttgtacttggtaaattgcattattttttctgcaattctggtggtatgattatttgccccacatcagtctgctccatatgtgaaaaggctaaaattagattaaattaggcaatagaaaaatcagtgttagaatacagattcccgagagttacactcaattgcttggttcactgagccatgttgcttttgaggtagttctgaatctgtcctagtgtcttagaggtatttcaaacagctgtcaaccaagcctataaaggtgagttatgtggacataaccttccagtctctaaactttcattttttatacagataattttaacaatgtaataaaaatctactaaatatatacttagcagtagcttataaaataaatctcatgacaaagaaagaaaacattggataagatattctatgtacataacttgaaggtttgtagtctgatttttcaataggatcaccgtcggattttcttcagcctatgcagactttttgtgtgtctgcatttggagtcagtgattatctttatgttgatgtaagaggtttttattagcaaagttattaatagaatgcttacttttctattaccctaagtctgtgcttgatattcaaatcctttccaaataaacaaatttcataatagaaatgactctcacccctgttttcagtaacatacaaccttgacaatttgtagaggactaaatgctatttagcggcacattattttctgttagtcaatgccattgactttagaaaatatctgaaaacagagatcttagttctttgcagcttttttccaattttcccacaaagttctccttctttatttc

SEQ ID NO: 6064 - DNA, 429 bp, mus musculus
tattccaactttaaaaattgaaggaggacagctgccagtcttgcccagttcacattcttactcctgaggtctggaggggctgtaaaaagtcgggtaggaaaaagctgctagggagacataacaacaaacacagagaactactgtaaagtacatgtagatgtgcccctgccatttcccagtgtttgttcaataacaaaaatacacagaagcccagttggaagtactaagtgtgagtaatgcaattttccctggggaaaagcataagctgcattctcccagcaggggaaaattaattctgagtcatttggatgttgttttccatagcatctctttgaatcactaaacttctctaatagtactgagttctctcctctggtatttctaatcatttctaaaagtttctagaaatgttggtgaagtggcatagaa

SEQ ID NO: 6065 - DNA, 822 bp, mus musculus
aagttagtcgaacatcacattcaaaaaacaatataagtgtgaataatttgctctggagaataggaaattcatagaagagaaattcacttttgccttcaattcttaatattagagtggtgcatagtctatttataaggaatatttcatttattaacttatgtgccttgatattatcttattctttcagcagataggactcactgccaagataattctaaaataaaaatcattatgaacttattaattaattacccttggaattaaagagcttcattatccctaatttaggttcgtttcaccaaagtttctaattgtttttacagacacatttaaaattgaaacttagagaactggatatccagctctttattatattcaattcaaagaacactcagtttgtgatattttgtttaaatggcaaatcttgaattgatttcagtaaaaacttcattcattattagggcttattctgttctcatctcctttttgtcagcttgatgtcattctttttcttatctattttgagattctataggagttattcaatttagcatctagtattaatcgatattttctctatcaaacatccccatccaaacttgcatgttttacctaccaggcttgctgcttgtattctctttttgaagggaactcttatttttacttctgtaataccaagaaaaaatattattcctttctgctatttgctattatttgaaatatatttactcatttcattagcaaacatttactgagcaaccaatatcttgacacaggtataaatatttttatgtgtgctttatttattcaggtttgcaggat

SEQ ID NO: 6066 - DNA, 473 bp, mus musculus
tgtaattgtcatgtttgattgttctgctttaactcaacccaaaactttctggcaccttatgctcccattttttttacatggaggcataaacaatcttatcattaatccctctgttaattgaaattctagctcttttccttaaagagtccatctacattcacagtgctaaatatcacactaacattgtagctgtaaaatgtttgattcttgccctaatgtttccttggagtttcatcttcacattctacttatttgacattttcttgttaatgaccatatgtaatttcaaattctccctgtattaagtcaaataaatgtctttgcctcaaaacaaatggtttcatcttacttccctgtttatctaccattataaatcctcaagttagacattgctaaataaagttgacttttttccttctcttttctccaagtaagcaatcaggacatttagtttgctgtttttcaggatattt

SEQ ID NO: 6067 - DNA, 181 bp, mus musculus
taacccttccctattttcttaagtcttctctacagagactttcaggttcttagctaatggaaatttgctgaggtaatgaagaaacaagagttgaatggtttagtaaaaatccacagtacttgtgagaacagtacaaacactatttgtatataaagcaaattctgagaaaataatgtatcaa

SEQ ID NO: 6068 - DNA, 263 bp, mus musculus
ttattcctagtttgctcgatgcttttgccagaattttctggcaaatgtagaatgtgtacttattgagcatctctttctttaagcagtgttttcatgaatttaaaatgatgatcatgactcatactatttattggaatggttgaataccaatcttcctttttctaacaaaaggaaactgaggaacaattatcaaaaacaacttgtagcctcatcagtaattctaacactcacagtaccttgtaaatttaataaattttactgtt

SEQ ID NO: 6069 - DNA, 145 bp, mus musculus
ttttactaagatactacatgtaattctcattaaaataggagaacttaagaacaaatttatttactgatgtcagggaaatgtaccaaaaagtggtgacacttgaatcatgaaagaacagtttattattgaatcagctcttagcaag

SEQ ID NO: 6070 - DNA, 552 bp, mus musculus
caatgtaactaaagaataaaagagctcactgcaaatgtgagcagaattattgttttctacaagattcataaatgtaaatagttgaaaaggaaattgaaactgtagctgctaagtgaagcatgttcttggaggtttctttttgtaatgctattctaaagtatctttatatcaatcaagatacaagtcctgttgaaatacattagatattatacttcatgtaaaacattatttttgtgtgtgtggtaataatctttgttccttaaggagaattctaaaatagatttatacaataaaagcattgtcccacttgaaaacactactggattcaaggtgtttctgaaggtaccttcaacaattctaaaatttataggaaagcaagggaaatgtcagtagagttagaagatgaggaaactagtaagagttcatgggagcactaatgattgcacttatagaaattcagtgcatcagcaatcaagaacattgattgccaaccatttgaagctgcctcatgttgaacaaatatccttccttataataggaaatataatacat

SEQ ID NO: 6071 - DNA, 223 bp, mus musculus
agtgccctctgggctttgtatatttaaattttctagaatagtcaggttcaacatatggcttcatgttcacagatgtacaataaatggcatttgtaaattctattctatctgaaaaatcttaaagcatatgttactcaccattctgaagttagtatttctatgcattttcatgtagcaatggtttttgataaataaaacatcttcctcttcccacaaaaaactt

SEQ ID NO: 6072 - DNA, 880 bp, mus musculus
tgtggttcaaatcttcgtttgtgtgacctttatggatacgcaaggttgacagggtgccatggtggaatcattctcctatagggccatgactaaaaacactgtaaggcattgaacttgcttaatgtgtttcttttctatttttatctctatagatatctttaacatgttaagagaaatatcagatcaactttcattagttgtgctatgtcagttttaatctaaaagataatgcataaaacagtattcctcacactccactctattacatttcattggtaatagaccccccttcaccccactattcagaatgacatgcttttatccatgtgtaactgaatatgagcttcacttcatgaaacactttttcactcattccaagtgagtaacagatattcattgtccaccatattatttgtgttgctattgccctgcctcaaacacaattcctaaaaatgactacagaaattccagatagctagttttttccatatatgaaaaaattttagctaggcttattacctaatattgtatactctgcctccttttaaggaatcaaatagctttgcagtacttaaagtattatccaaaactgattactcatcatgggttttagtgcctggtggtctggtaattaccgatatatttttaaaagactttaaaactaaattaaaacttgaaccatgcaattatgcgcaatgcatattgtaaggacagctaatgaactctatcattttgctgctaacagctgttttctcctcataaattctgttcatagattccattcatactaccacacaaaataaaaacaggaagttagaggagagcaatagaacaatataaacattttctttttcttgtagaacctggatcactctctaat

SEQ ID NO: 6073 - DNA, 345 bp, mus musculus
tagtgttattccaagtgtgtttcacagaccaatggtggtatgcacaacgacacaattgaaacccatctgcaagctgaattcagaaattaagagtacatacttcacatactttaacaatttgacattattgtggcatcaaggtatgttttaaatttcagtcaacatggtttgaagtttaagttttgaacagaagtaacttctaatgacagaaaaacatttcagagtagaaactcagattaaaaagactctagcagatggaaatcaacccattacttctttcatcaagaaagtctgatgaatgtcagctctactaaacagtatgtttcatagcacagtaaaacttgg

SEQ ID NO: 6074 - DNA, 991 bp, mus musculus
tttcctattctgctcaatgttttcagcagaacagcccttgtactctaagcagagaaaattggtcacaggattttgctgtgagcccgcaaggacctgattccttgttcccataaatagctttctctgcatatgtgctctgtgaggaacacttaaccctgtatcgttgctgtcaataaagtcttggaacctgaccctcttgattggctcactaccatttaaaccactgttggcaatcaccatgctgaatataaagcaactgagtgttcatttgtcagagttcagcctctaatttctgaggctgcccaagttgcttctttctatagtcctggagcccagatcagtgagtagcaaataaatggtctagatactctatgtgagggtggccaatattaaatttctcttttctctgcctgcaagatatactctggtaccagattaataagattacacctccactctggagcaaagtgccacctttaatcattttcagaatggaccacccgaccctccactcattaggtttatgaacaataggaaaagatcaccaggtgacagcaaaggccaaaaataccatgtctctgaagaccttcttatgaaaggtcttatgaatcaaagcaagggcatcgcagcctgatatttcacaaacagagggaagaaaaattgagaacccctagtgtttgtaataagggaaactttgaaaattgtattaaaatcagaactacagagcatttgaaaggaatatccttacattgaacactaacatcataaaatgaaattcgagcacatcctagaaactgagtgaatggtggatgtcactaggctgattcttgggttctcggcctccttatgagcctgactagccatgtcttgtaggagaaaacaagatggggtcagagggcaaaaagagagtctcttgcccccctgcaagtaaatgctaccatgaatagggtctgattataggaaacactgcctaaaggtgacttatttagtt

SEQ ID NO: 6075 - DNA, 837 bp, mus musculus
ctcctttgcagagaaaattaaaagtgtaccatgacactgagtgcccttggagagggggagatctttggaagtttgaagggtgatcctagaaggtgcttttgtacgtgattgtagagggggcagagaaaaaaaaaatggcctccacccattgtgtttctccatgagctttgtgagtgaggccactggggagtcacctgttcccacaggctggcgctctgatggaagagtgccagttaggcaggccatggaggagggctctgtgacccatgagacactggcactgcaggaatatgacgttggcagtgttttaggaggggattttgccagcttaaggccatgaacccaagaggaaattagattttaagcagaaataaaatcctgtggaaatatttaatgttaggtgatgtttgcatcatgaaggacatcatctctcttccattgaatcttttcctctttttgtccgtggcttcctgtgtctgtaatagaataatccattgtctctgctgagtgctgtctggagcagaagcttttgtcaagctcttcttgataatatcatttcagttacacttgaattcaaagctcttctctcttttttttttcctaagtgtctctagcattaagggaggaatggatccttttagttttgaccacagaaataaaacttcaatcagaacatgttgaacgctggcttcaaatttagtcaccaggaatggtctttagcccaacattaccccctagtgggataaaatagaatagatattaatgaggttatgtgggatgcatttgaatgggtgtaactagatgctctggcttgggcctgctctgtgacagatacaa

SEQ ID NO: 6076 - DNA, 135 bp, mus musculus
aaaaataactttcaaggtttcactgctaattgtgcaaaatgttgaaaacagagaaaagtataaagaagtaaacaaaaataatctgaccacccagaaataatcattattaatgctggcataattaatttttataat

SEQ ID NO: 6077 - DNA, 591 bp, mus musculus
ttcatttaataacttgcttatttatttttatttactaggtacctatattatacgtaacactatggacaaatataataaaaatcaaaatgtgacactactagaaatagcttactctaagtcaatttccttccaataattttagggcaaatagatgaattctgatattttttgttaaaataactcttcatttaaaactgttggtgattctagccttctcttgaatcttgttagaaaaggcatatgattgtggctttgaatttaattttacaaagtgaggttttccagcttcataataaactacagacctcatttccaagggaatcagtcataaaggatggagagtaaatattaatgttccagttcctaaaatgtcctttagatgtctctgtttcatatctcatgtggaccaatacagcaggccactgggaaagacattgcctgaagctggcttcctgacaagttgaatttgtcctcaaaggacaaacgaagctctttgaaaatagaatttgacaaagttaatgaaagaaaaatgtagatgatggcatgcaaatatatcattactacttcataatatttttataacccaaaaaa

SEQ ID NO: 6078 - DNA, 686 bp, mus musculus
taattcactttatttttcttgtataaaaaccctacgttgtagccacagctggagcctgagtccgctgcatggagactctggtgtgggtcttgactaggtggtcagtgaagtcctgatagggagacttggtaaatacagtctctttccagaggtcaggggtcagatagctgtaggtcttagaaatggcatcaaaggtggccttggcgaagttgcccagggtggcagtgcagccctgggctggggtgtagcagtcatcgataccagccatcatgagcagcttcttaggcacaggtgcggagacgatgccagtgcccctgggtgcagggatgaggtgcaccagcacagagccgcagcggcctgtcaccttgcaagggacggtgtggggcttgccgatcttgttcccccagtagcctctgtgcacggggacaatggagagcttggccaggatgatggccccacagatggcggtggccacctccttggagcacttaacacccagaccgacgtggccattgtagtccccgatagcaacgaatgccttgaacctcgtgcgctggccggcacgggtctgcttctgcactggcataatcttcaaaacctcatccttgagagaggcccccaggaaaaagtcaatgatctctgattccttaatgggcagagagaagagatagatctcctccagggac

SEQ ID NO: 6079 - DNA, 1055 bp, mus musculus
tgaaaaggtttgctcagaacatcctttgctggccaactgcactgactccagaaagagacttctaagtgtaatcagagagcaaagcatatgctgtctgccccctggaagcaagaggaaggaagaatccaagggagtttatatggtggatattccacccaaccaaaatccaaaactgactgttcctttctgttgcactggagttgcttgagcctctgtgtctccccctcaggctgggccactcccatgttgagatcctaccttgaaggaatgggaacatagagcttgggaggccctctgtagagaatgctcctgtgaagcagagatttcaaaggactaaaatcttcattttaaatagagttaattttgcaaagggttgcaattgtttctcatgatctctgcttctctagaaatgtctctcattctctgctgagttcaggtctccaaataactatgggtgtaaaagcctgtttcctacttgcatatttatctttcagatcattttgtaactatctccctccttttttccctcgcttcccttattcagcaaatatttgttggtctcatgctcagtcctgtttctgacatacagaatgagagtgtgatgttcttgctctttttctctcccagcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattt

SEQ ID NO: 6080 - DNA, 1345 bp, mus musculus
tcctttcactttcaagatgtttgtctttagatctcaagtgggtctcctgtagacagcatatagttggatcatgttttttatccattctgccaatctcttccttttggctggagaatttaatctctttaatgactgataaggaaagactgacttttgccacttttctatttaattttctctctgccttagagttttgtctctcatttcctccttactgtcttcctttgtttttagttgattttttttgtagtgacacattttagttcctaattaattttgatacgaggtactaggaaggatactgaatatggcttctaagggctggtcctaaccaaactacacagagaaaaatctggctatgctcagtttaggttcacctatgttctccatctctttccctgcaccacctctttggggacaggagaccaagaagcttgcagaagttcttatcttcagtgatttcggtgagttactgtgttacgaggactaggtcctcacccagagcatgatggacatagactacttctccacagaggggagaccagcttaaattatggtcaacaacactcttctttttcactcttcattgattctgtacctgtcagaggtggtgtctcttgtcacttgagtgtgtgctgcttctttccaccagcagttactttgagattgtggttccttcttttgagtctgttgcttatataatggatgggtcttgccagcccagtccccctttagaaattaccaaatctgttcagattttagttacaaatctgttcagattttagttactcatcctgcacataccagctgtccgtaccctttcaatgaaaaagcaagctgtggcttggatccttgtggagtgtcagaggcagtactctgagcttactcagggatacattttagtcatgaaatacataccttagttcccacaaattggagccttcactgccagcttctatatttaccttgtggatttggggagagcagtttttagtaacatctctaggacacacaggtttgtaaaagtccttctctctgtgcttctcctaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttct

SEQ ID NO: 6081 - DNA, 1345 bp, mus musculus; identical to SEQ ID NO: 6080

SEQ ID NO: 6082 - DNA, 1203 bp, mus musculus
tttactgggaagaaacagatataaacaagtaaacacaatgcttacagatgtgatagcacctggcatttagcagtttcccatgatgggtggttggtgatggaaatgggcatttgtgtgctatgtgtgcaccaagagccatagtaggagagtgccttgcaaaagcacacgtctttcaaaaagagcacacatacacacgttcctcatgtttagtgactccctggtttaaccatctcatgcttagatgcaacatatggcttttactttgttatttagttgtctaacttcaaagagacagtcaacaataatgctcttcctatggcaaaattaatatagcatcaagccactttcacaggtgctatgtttcttttttcctcctttttactccccaggatgaaatgggacctagaatcaaagaagcaatagtttttctctatacctgtaaaagattagcttttcatcattggggatgatgcaagcaggaaaaccaagtgcaagaaaacagagatgaagccaaaaaggacaatttctgattgtaatagctggtttctgtttcatatcactgagcaagatgagaaagttttgcagagttttagaggaacagcttctgcggttctaaatgatgacctcaccctcaatgcccttgccaggtggttagccccactgtgaaaacacaggttgattttcagcatgaaacaagccagagtatggaatgatattttcaggtgacagttggggttctatttcctgtaattagcacctcttaaccttcagacttgcccctgcccttttcaggctgttgaagctcaaatccgaagttttggacagactccttctcaactactcatagagccccatcctcccagaggttctgccatgcaagtggtaagtgctatttttactctcctcatttcttgcctctccttcagatccgcttgatattcataacagtctttcattgtgcttgagtttctccaccatatgtgggtttgtttttttatgcaatatttgttaacctgctaacaaccagcagatgttattgcattgtctcctggaatctttgagaaggtaaatgttgctccagtgctcttgtatttcatcagttggtgtcttgtgttacagaattgaaaggtccataattgtcatgaatcctcactgtaggataaaggactccagacatagggttgatgacttttctggtttgat

SEQ ID NO: 6083 - DNA, 1203 bp, mus musculus; identical to SEQ ID NO: 6082

SEQ ID NO: 6084 - DNA, 935 bp, mus musculus
ttctagttgagtacataactgagacagaaaatatgtgcatagcaattttaaggtatgttaataaaaaagataaagaatttactaaaattaaattgcaagaattctgcaaccatattttctttgcaatttaattttctgtattttaatttcttgggatatatttatatttggcagtataggatggaattttcaaaaacaatattgaaaagggctgggcatggtggctcacacctgtaaatcccggcactctgggaggctaaagcagaggattgcttgagcccaggagtttgagaccagcctgaacaacacagcaagactctgtctctacaaaaaacaaaaaaacttatctaggtgtggtagcacatgccggtagttccatctacatgggaggctgatgtgggatgatcacttgagcccagtaagtagaggctgcagtgagctgtgatggcactactacactccagcctgggtgacagagcaagaccttgtctcaaaaaaaaaaagaaagaaagaaaattggaaaacaagtctaaaatgtttaggtgtaagatatccaccttcatgaatgcctcttaattaatagtttcctctattacttaagaaatacattaattattcagaagtaaaaaataatttttcctatgaatcgttttataccaaatgcaatagttatttttcagtaaaagcaaaataattgttctacatagcatactagaaacattgagagcaaaagtaaggaccactttttgtccagcagcatttactttttcatttttatgagctcgtgaaatctacctctgtcaattggcttattttcttctgggctccacagtatttttctttgaaagtgttttactgcatttcccttcggttagtcttattgattgtatagtcaatttgtaattgttttttctaagtaaaatctttcatacatt

SEQ ID NO: 6085 - DNA, 935 bp, mus musculus; identical to SEQ ID NO: 6084

SEQ ID NO: 6086 - DNA, 985 bp, mus musculus
tggatacttttggagagagtgaattgaggcaagaaaagatagcatattgagatctaattgttctcattttgacatatataccagtcagtctatctgctatattatatagtctctctaaaataggtcttaaatgggcattgttatttttacttctgtgttatggtcattgaaagtccctaattagtgcaatgggagtgccaggtgaccaaaaggagttgttgatgggcactctgtgggtttgcaaagtgcaaacctaaaagactgagagatgagaaatgcattgctatttgtgaatttatgttttatctcacttcacttgaaaatttatgagtagcgtggcttaagggtgctggagttgtgtgttccagggcttgcccctactgataacacccttgttggcgtgaaagtgcaatgcaaattatgacagttacaaccttctgttttgtttaacctgtcagtagatttcctggctcagtgctgagggcaatggtgtgttcagctagtccatattcacctaaacttaaaaggtcaggtttctacaggcaagcctagtcaaagcctaattgatgaggagggcagggaggcagaatttactgttctgttggctagtttcatatcgttaggttgtcctgaaagcatcaggcagtcacagcccctttcatgtaagtgctgaccctagacaggagctgacaatcaaaggaggcagccacaggaaccagtgcaagtaggctattgatttttcagttaggtctaagtagtttgtagtatgggtaatgggtgacagaggcaggtatgtcattatcaatgagctccagaacagtagcaacaaccctccctcatatttccttcagcactgacagtatgcatccagaggcggtcaataaatcgcccaacctttaactgacaagtgacttggaggtttaggttgaggagtggaagttacagagctaaacttccttacttgaacttgtactggatctagcaa

SEQ ID NO: 6087 - DNA, 985 bp, mus musculus; identical to SEQ ID NO: 6086

SEQ ID NO: 6088 - DNA, 1000 bp, mus musculus
cctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaaca

SEQ ID NO: 6089 - DNA, 585 bp, mus musculus
atatatataaatgtaaacaaataaagaaataatctttatccttaccgactataactcacttataatctaaaatacagtggaattgatttgttttgattgagaaattcagttagttaacaaaggctgatttcacacctgttgtgtggtctacagtgtagactctgctacttgaagactaagaaaagactttctaaacatgcatgttgctagtaaacactaccttctaacacctttaccaaacagatgactgcatgggcctttaaaatatacaaattatgttcaaatgaataaacaccacagaattaacctattttagtaaaacaggtttattctacacaaacattttatatctgctgtaataaatcatactttatgccagctgacatgttgtgagctgcctacggggagcccacatggcaagtaccagaaggaggaccctggccagcagccagcaagagactgaggccctcagaacaacagcctgtgaggaactgaagcctgacaaccaccaagaatgagtttggaaggatcctctcccagttacgtcttcagataagactgaagctcctgccaacacttaaactg

SEQ ID NO: 6090 - DNA, 456 bp, mus musculus
gtgggacataagcagagggttgggaaatagtttgaccgactgggtttgttctcattcttgctctatgacagcactataagaatacatccaggctagcctgctggaggatgggagattgtcagttcagatatggctgctgacctagctggcagccagtgtacaccagacctgtacatcaaaccactcaagatgagaatatccccaccaagcctagcctaaatatctggccgtagattgatgagctaaatgaattcttattatggtaagttcctgagatttgagatggtttgttatacaacagggaactgataggcttattcttcaagaggagcaaaacagggatgattgctattctcttcaatgggttgaggaaagaagaaattatgtgaacatttatacactaataatttattctgtcatatttcagtcagattaaagcaaacagccaaaaacaag

SEQ ID NO: 6091 - DNA, 175 bp, mus musculus
atgactcacatattagttcatctttaaggccaatctggaattggaggtaagaacaacccctttgatttcaattttttaatttgcattcagtattctgtacaaagacatctacgactaaaaactaagcttctttcacttgcctatgtgcaattggagtcagtcttaatgttgtaaa

SEQ ID NO: 6092 - DNA, 1632 bp, mus musculus
tttaagtagaaaaaagaggcttctttacttgttttcagtatttcaaagataactttatggaaaagattaacagagtacctaatgtagaaaaataattagccacaaatccaaattaactcatccaatgtaaattgtaatatgaaataattattttcttgggtaaataattattttaaatcttttcagtttcaagcccttgtgaggagtacatatgcagaaggaaaaaaagtaataaaatataattctgactctctaggaattcatgttttctttttttttttttttgagatggagtcttgctctgtcgcccaggctggagtgcagtggcacaatctcggctcactgcatgctctgcctcccgggttcatgccattctcctgcctcagcctcccgagtagctgagactacaggtgcctgccaccacgcccggctaattttttgtatttttagtagagacggggtttcaccatgttagccggatggtctcgatctcctgacctcgtgatccgcccgcctcggcctcccaaagtgctgggattacaggcgtgagccaccgcgcctggcccatgttttcaaattactccaacagtgtgtcatgaataaggtactatggggtccagagtgagaatgtccaactctggctggggaagttaaggatgtctttacagaaaataggtcacgagaactcatcataaaagaatgaatagtggtttgtaagatagagaaaaagaggtaggttgacctcatccaaaaaaacaaatcatatgatcaaaggcagagacatcatgggtgacacaaatgtctttggagacactacaaaaagttggagtcactggagccagatagtgtgtgaagaagaaaggatccagatacaactaaaaatcacagaaaaatggataccataaaagcaaaacaaaacaaaacaaaccaggaattcattttcacctgggataaaaaatgattgcaacttaatgttgagttgcatattcatgatatgctaaaataagacaatgctgttatataatatgaagttctaggagaacgccggaacaaatttgagaacacatcattttttaaataaaatgtttaaaaattgcattatatttgaatgaatgtattatatattacctctaatatctacttatctgattaactgagtatcttcaatgtatttacatttttacattgatcactaattcccaggagctgtggtcagatgtgtaaccagctacttcttgagcaatagaatagcaaagtgattaaatagctttcttagatgtacatttctattgtcctctgatacatagcttttttaattttaaaatgttagacagaaggctgcaagtaggaaatactttgcttggagaatgacattcacaagtaagatgctgcagtcttttgtgtaaacttcagtgggattcagtaggtacttggtctgaagtggccaggaataagatataaatatccttgtttttgtttctcaaacaacaaactacactggcagagacacttctcatgagtccagagatcaatgagtattaggggatactgctggaaaatgaacaggttaccagttctttgggacatgacttcaaatccttacccagtctcaaactttataattcataaaaa

SEQ ID NO: 6093 - DNA, 687 bp, mus musculus
aatgtatacattaggtggaagaaatatctttgattaagttaaagaaagtatatgtgtcttatgtcatctatcctaaatattcatgcatgtcttgttttctggtaatttttagaagtattgcttttttacaaaatttggaacattattagaactgactggctagacttcatagctgataaatgactatgtcatttagaagcatacagagaaataaatcaaatgatatattctgtttgtcaatagatttgaacatgatatacaggaaaagggctctggctctctacctttgcaatggacaagattctcccttcttacctatgtgctgcaggctccaattcaggaaaaaagatcctatttccatctctgaaaggttaactaccacctttcaatgagaaacgtgcctctgtcaagagagtgccaaggaatggcctgagtgctggtatccacagctgtagggggttatgcagaaccagaaaagactgaccggagggagactctgaatgtaaatggtcagattgtgtctagaaaattctatagttaggttgatttttttgttttggttatgtttagagagtgtccagtggtatttaccagtcagctacaattcagagtttaccgagatggcaatacccaaagctctgaaatgccaaatcactggaatagtgggaattttggaatatattgcct

SEQ ID NO: 6094 - DNA, 365 bp, mus musculus
aatcccagcacacctagaatcatagatggctccttaaacaaaatcacgcagggcctacaagaccaatatgatctgacctgaatgtgcgctacaaccttcttcttgccactgtgtcatttgtttcctatacgttattcatactgactttctttacactcctcaggcacaaagaatttatttcttccacagattttgcagttgcccctcattctgggtgagtgtccttcctcagatttttacgtcttcagcttttttgtaacagtgatatcttagctcacataacaccttctccaaggagccttccttaactattcagtcctatcacactgaaaattgcccaggtttctttcttggcacttatcact

SEQ ID NO: 6095 - DNA, 132 bp, mus musculus
ttttccatattacaatcttgcttcttttggatatttcttatgtatcaccccactttcccctttccccactctcttgccaccttgcctgtgtccaggctttatcctctttgaaatgcccttcaacttatttct

SEQ ID NO: 6096 - DNA, 211 bp, mus musculus
ggcaatgaacatattaagtataaatatacacacataaaatatttcagataatgttaagtttcactatggaaaataaaagagagtaatgggacagaatcaaggtaggtgctagtctatttagaaacactaaccacggcagagtaattacaaaactttacttgttagaacggaaaaaacttgagacattgtttagtcccactccatctttttg

SEQ ID NO: 6097 - DNA, 223 bp, mus musculus
atgtcccaactccaggcactgaattggaagataacacttgtaattcaactaaattgcatggtaaatactttcaatgtgctagattacacaatatgatggcacaccttccgtatcatgtttaaacatggatcttaggataatatatcagactttttgaaacactttttaaaccgaggattattttgctaataaggttgagtcacagattcttcttatcctaatg

SEQ ID NO: 6098 - DNA, 1296 bp, mus musculus
cttgcagttcggtatttcccagagaagtttttaattaggaaatataaaaacacatctcagagaatgattttaaaatcttccatcctccaaaatgaaaaatggaagatatatttcttcaatattgccaatttatctgagattagattattatttgaaaacataaaatgtttagatattttatgagtaataaacaataaacaaatgtctactgctctacacagtagattaccccatttcccctttatttcaaggttaggggactaaaggatatatcacagaaacaaggagctttctcatggatatacaagaatggagtaagtttaaaataacttcatggaaaattgaaagattagttgacaaaccaagctaagagatgtaaagaatgattgacaacaacagtgatgctcagttgagaatgaaaagcacaatttttatgtaatgatatgaatgtacatgtttatgtgttattatctccaagtaatcagcaatccttattcatgttataatatccaaactcatacattttaaataatcctccaaaatgtttttataatttgtcaaagaaacaagatggatcatagaagcagttgaatttacaattttgctactcagaaaaaaagaaatatcagatgtatactatccacccactcctttgcagagatttttttttttttacaaaaacttgtttttaataggttaaacatattatggtgtctgtgtaagtagttgtaagctcacgtttaaatgtaaataattacttggaattttatatgacatatcacacttctgaaacttgcaacagtgtacaaccaagtttgggaagagaaggaaggcacctggtgattcccaattggtgaatggaaaagcaaggcttccaaaaattatattcagccatgtaaggccatataacgctatggttaagaatatgcagactctagccagactgcctcgagtaactgcaataccatctttacttggtcaggtcacttaggcatgtttcacgctgcaatattctcatctgtgaaagagaaattatgacaatacccattcaacgtgttttatgaacattaaatgagttagcctgatcagtcatttaacaaatattacataactgctgtccaaaatgtttattaaatcttttgtctcctaacagaacacaaaatatataaacaccaccacttggcaataataacactgcttttattgctattgaaaagaactgtgattttgttgccaatatatgcctctctctctctctctctctctctctctctctatatatatatatatatatat

SEQ ID NO: 6099 - DNA, 312 bp, mus musculus
tttctctcatgctggtacacttatttcaaataatttatatcttcagtgtctgaaaagcttcttgacacgtgtcaggcttttatattcttagtgcctaaaaaccactggacacttaatttatgtttctcataggaatggaagtaaagaaggaagaaagtgctacactatttcctaaaccagactagctggtactgagggaagaactgtgtttcctatatatggatttctcagcctccaacacattatcagcattaagcaaatgctgtgttcagagtacacaaatttgtggaaccagtaactacagtaataaga

SEQ ID NO: 6100 - DNA, 556 bp, mus musculus
taaaccaaatattttctgtctccaaacctgggttttatccctagaatacgattatgcaaaacaaatgtcacagtgccccaagctatctgaaactatacgttcgtttcttttttattggttacatccatctgttaaaagaaatacatagagaaagaaaatagaatatccccatgtaattttgatctcttgagggacaatgtatgcacaaataaacctaactaaggcacatcattgtgaaatgtcacaacactaaaaaaagggctgcaataggatatctcaaagactaccctgaaaaaaaaagataagtaaaacatttaacattcttttaaaaaaacattgccatttcttgaaaaaacagtcttttcttccctttatttctttctctatcatatggtacatttattgctttactttctcattctggcctcaaacacaaatttactgtgttattcttataataattcaatcttacagctaaaaaatatccgcttcaaaaactgatgtttttccaacccaggctttctgtaccacaatgactgtcactgtctagaagatg

SEQ ID NO: 6101 - DNA, 737 bp, mus musculus
cgaaaatgtttgagggcagttagcatttaggaagcatcctgaaaagtgactggaagccagatataagtaccttcgctacacttacttttttccttataagttgttggcaagtgagtaaaggctaaaataaagcaaaagcaagtgacagcaaagctcttctgcagccctgaggcatacatgaaagacttttgaccctaagaaaagaggctggatgggctgaaaaccattttcaacttggcacagtgaaaaaacaaacaaacaaacaaaaaaccccagtgtagatttgaagtctgagcaaatcagtttagttaacctaagaaatataactctgttttcttaaaggctaggttttctgtaaatgttagttcaatacaaaaactgatattttgaaggagtatttttatcaataaacaaagttaacaaattttggagctagatccttttctgtgtctaggaaatgaattatttcccaaaagattgctgagaagagaggactctgttcatacagaagaccacacaacaggcagctaggtctgaaagaccacactgagagggctccagtaacatccacttacgattcatcatttttaccttcattcagtaaacaaatatttactgagcacctgccgtgtggccagtcattgtacctggcctaagattttagtagtggacaagaccagaatcttctgacctcagagaatttacattctggcaggacagagatggagggagggagt

SEQ ID NO: 6102 - DNA, 737 bp, mus musculus; identical to SEQ ID NO: 6101

SEQ ID NO: 6103 - DNA, 394 bp, mus musculus
gggttgtgcttattcagctgctcattttgcccttaccctcacttgggtcctctctaggtttcttgaggtggaaactagattatagcccttcagcaattgtatcaggcacacaatgacagaaccaggcatgaacaaggagagactccacagggtatcatggaaggtggtgggggtgggggtcagttagctgcatttgagaaaaagtcccatgcggttttttttgtgtgttctgtttatttgttcttttattgttattcattaaaactatcagactaagaagtgatgaagtacttctggggtccttctgcagatggacctacagcctcagctactggaggcaagcaaggcttagagtctacattgcggatgctatttatatcctaaaatctattta

SEQ ID NO: 6104 - DNA, 120 bp, mus musculus
ggtattttattattggttttagaatatcatttttattttacaaaacaatgatttaaaagtgtctatcaatgcttctcacaatgaagtaattgaactacttttgctaggatattttatttg

SEQ ID NO: 6105 - DNA, 361 bp, mus musculus
ctttagctatcacctcccccacaccctcactgatctgaccttcttctaccccaagtcctaggcaagcactatttcctatttcctacagatttatctgttctgagcatttcctatgaatgcactcatacaatatgtggctttttgtatcactgagtataataataagtgtatcacttagtaatatcttcaaggttcatccacactggaacatgtataacttcatttttttatgtctgaataatattccactgtgtgggtaggtcacatttgtttatccatatagttgttttttcatttctatagttgcagttatgattactttagaaaagattatggtgtgagaagaaaatagaatttcatg

SEQ ID NO: 6106 - DNA, 810 bp, mus musculus
cctgtccatccctttgtggccctctcctctttagccggatggaaggtgccctctgctctctgccaagccctgactgattacaatactaaacacagcaatagtttgtttagaaataatgtctgtgcctgcctctttaaattacagacccaagctctcttccaaagccatatttttccagcctcttaaatgagcagatgaagtttctgacaggttggctctgggccacatcagatgaagacacgcagcctcctgtttagtcttctggattgatcgtggtaaagcagcactggcctttgggaagaacagccttcctgttcaggaaaaatccacgtttgcatctgtccgctcttttttgcttatgaaatctcatttgccttcctctgcagtggagcacaggtgaggaaaattgacctctttgtaatttggagccaaaccattcagaaagtataaatcattcattaagatggaaataatttacatttcttgattggcccatagcagtttgaagcaaattaggttgccattaagcagctgtcttggaggtttgtaccagggctctgaggttccctctgtccctctgagaatgtaaaggactccttgagtaccagggccaggctacatctggcctcactcactggagcatctcagggagaactactggggagcatgaaaaaaggccaactctattgatggtaaaggcagcacataataaatattcactttcgtcttccttccttccctctctatcttccctaatttgaaaggtaaagaacagggctaggggaaaggaactctcaaaggaagagagaa

SEQ ID NO: 6107 - DNA, 1143 bp, mus musculus
ttctttatttctgttttctctaaaagtaagccactcttacttttaggcacccagtggattagatgtcatcttttttatattgttcctaatggaacatgaggatggcttttaagaaggtgccagatgtgtgagttctttattgctgagcaagtgttgcttctgtttctgagtctatcaaaagggttcacatgaagaaatacagctatcatttatatgtgactagcagaatatatttaaggaacatattcttttttatcagaggcaagccttaagatataaatcaaaagattataatgaaaaatatggcatgaaataataaattaaaaatgagaatagtttgttgattctaatgtatcttcaggagttggaatggcagtttaggagaggaatgagctaatataaatgtatattttaaaataaatatgctcaatatgcttgctttatttttttaacaggatgaaagaagcaggagtagaccataggcagtggaggggtcccatattatccacctgcaagcagtgcccagtggtctatcccagccctgtttgtggttcagatggtcatacctactcttttcaggtaaagacacctacagttgtttagtttgaaataagggatgcatacttattagtaaatgattaaaaccattgcttatccaatgtgataattcaaattattcatttaacttataaaataaattaataatctcactggtttggaatatgattcaatgtgcatttgttttttctatatcagaatttttaaggtttgaaatactaaagctatgaaccctcagatatcaaagccaacctttcctttgttgctactatgaaagaagtcagaaatgttagcatgctgtacaatagctttagtgatcaatattattttaacaacaataaatgtgctacaatctgtcattagaattattttttaatctcatattttatctcctatattatctcatttaagccaccaaaaatctctttaccagatgaaaaaaacaggatcagagaggcaatttgacaagtttcacatatttagttgacattgaagctaggatttgatataatctctgattcaatgcctttgctctctcttctacattgttgttcctcccaattaagtgtcccatattgttaaaat

SEQ ID NO: 6108 - DNA, 1143 bp, mus musculus; identical to SEQ ID NO: 6107

SEQ ID NO: 6109 - DNA, 1143 bp, mus musculus; identical to SEQ ID NO: 6107

SEQ ID NO: 6110 - DNA, 204 bp, mus musculus
gggcctttgcgttaaaatacttgcttcctcccaaaggctttgttaaaatttcaaatgcctcagtaaaaaagcctatgtttgctttctatgaaaatacgtttaaacattacataggtcttaataagttaaatgtaataatagagcaaaacctaaaaataggcagaatgtattcagactgtagtcaaagaacaaattgaaaataca

SEQ ID NO: 6111 - DNA, 483 bp, mus musculus
tgcatttttaatgaaatgtaatttcttgagctagagattcaaagaatctcgttttgcatctaaaattatgttcttcaaagttttggtagctaaatcggaaagttctatagcccaagattcttgttattaaaagaacaatgactttgaattgccagtgcaaatatatattttttctgctgaactagaaatatcattctttaaaaagccatgaaaaataaaagtcaatgctgaaggtattttattatatataacctttagttaataagaaaccaatgtttgttttgctaaaacataaagtccaaatttcgtgattgttttgcttgtttgtttaatagcaaacattgaaagacaaaatacatttttaggatcaaaacatgtctacccgctctatatactaggtcatgcacaaattgtttttctaaaggtatcaattatcccttcttaaaaacttacgtgtgagagttaatcttaaaagtcaatgtt

SEQ ID NO: 6112 - DNA, 257 bp, mus musculus
acagtttacaaaaatggtaacattttattgtgtcttaatatgatggagttgtatctcattaaatatttttaatgtggcaaatccttaatagaaagtagtatcatgtacaataagccaatggattttaatatatataacatcaagataacactataagaaagagtgaaatgaaggataagttcaaaaatagtaatgtgtctgtaataaagactttgtaaacaaatttgggataggtttttagataaaatgacaggata

SEQ ID NO: 6113 - DNA, 1175 bp, mus musculus
tcaagcaagggggaaatccagattttatatctccttccacttgaatttctggataagaatgagagaaatccgcaaaatccagttacgttaaatagcttttacgagtatctttttggaatgctgtcagttgtaacttcgttttgtctgccaggtataagcatggaagattcaagctgctcctggctgtaagaagttaatgtggaattttgctgcttgaaatttaaattgggctacaaaaattagctcccactggtggaaacaactttctttttagtatgagaagttgtttgaagcttttttctcccccaaagtctcatcgtgatcaggctttaatattgctctcaaaccaacctttaatttaataagcagagtaattttgttcaggaaaattttccatgacatttgttgaattaaatgtacatactcagtattccatcccagcagcaccacctattgttgtcttgtagcttttctactaaacttcacaagaatctaattcactcatttctctgagtatctctgtgagatattcaacatacattttacaggttataagggttaagcattccagttgtgttgtggtgatgtttctaaagtcataaatctgtaaataaaatgaatgcaggatggtagacttttaattggtgaaaggacactgaatagagaggcaaaatgctttaaaatatttatggatattaaacaatgtttggaaaataagattcaagttatacctgtatgttttaaaagttctactcactacacactatgattctacaattaacagcagaattgtattggaataagataagaaagactaaatgatattattttgtgccaattgttattgtaattagaatattatgtattgatttattaaatataagtggctttttttccagcgaggttttaaaatccacttataataaaaacataggatttgcatttacaggtagaaaatgaaaatcggtaagtgtcaagatggggtccactatgtaattttttcagcattatttccagaagagaggtaggattgggaattttagtctttatttgatatttacatatacttatatgaacgtgagtcattgcctgtgttttctgtaagccatctttacttcaaccatgtaaaccatacgaagcattttaggaagaatgtaataagcaccatatggaga

SEQ ID NO: 6114 - DNA, 594 bp, mus musculus
ggcaggtgcctggctgcagaggctgaggagcactggggtggtcctaagctaagtgtgggtctgtttgagaaattggtgatgctggtgacccagagatgtctgcttgttttgcatgcagagaagggcatagaggagaaacttaggcaccgagggccaagggcagaatcagtggaggagagtaaggagggtctccaagactacacctaaactctagaagaagagggctcctcttctcatttctgctaagaacacaacacattctaaggcagtgaggatggaagagaacagcttcgttttggttcttttgaggcttgtagttgtattataagacagcaaggaatcaagggcaatgagacaaaacttagaagatgccttgcaatcctaaacctcagtgaagtgtgaaaacaactaaacctgggtttctgaggactagaagaaacatttggggttggctgaggattgggtttgcatgcatcttaatcaccagagtaagatataatttggtttggtttcatgctaaagttttagttttcggtacttcgaattaaagggtcagatacagtctgtcagctaaaaaagaatatttgttaagta

SEQ ID NO: 6115 - DNA, 473 bp, mus musculus
gaacaaagatccttcttcatggctatatatcaaataacatcattttaaatttgtatctattttgaattgctggtaatgctgccatcttgttgctgtactacaagatgaataaagagcctggaaatagtcaacatttattagcaggattttcaaaatatgttcttaaatttaaacttcatcacctttcatgtgccacttattatctcttttattatctacctcacctaaattctctggaagctgcttggtaaattaaaaggaagatattgagcatatcaataattttttagagcaagcattaaatccagtggtgtgtagtaatagatttttttatgggagatattatttagctttcccttattgcttctagttatttgtgttcaagaaaaatgtttagagaggttcaatagatgtctattgtcccccacaactctgacccccatactctaaaacaagaatatctcaaatctagg

SEQ ID NO: 6116 - DNA, 734 bp, mus musculus
ataccagttcatcatttggggtgtataacattttccacttcacagtaatagactttctgtaattttccatttttctaatatttatgggttcatatatggtctcccaaatttcatctaccttattttattattccatttcgttactcgatatttttcaaaaaacaacagaagcaaatcacttcatatagaaaaaaaatcaatggccacattctggttccttgaaatcttggtctacttgattcaaggcccatttcatgcttgtgaagacagacagccctacataaatacctaagaatcaacgcaggatctataatatcatggtcttcctagactttggttgtaccttctataattactaaatttattccacatggtaaagtcacagaaaaaaatcattagattcatcctcaatttttttttctttccagaagaagaaatgcttttcaaaaataaaaaaaaaaaacttcttacacaaagcatttatgagagcagcagtctttaaaagctcactcattgaaacattcccactatttctttacttcatataacgctcaaatctcccacagcactaattccattttattctttccttctcatactttcatatctcaccttcgtcccttctttgcccttaaaaccctaagttactgtcttttgtatttccagacaaattcatcatcttcttttccagtgctcatctttattttctatttgcacatccgagttcatcaata

SEQ ID NO: 6117 - DNA, 1259 bp, mus musculus
gtgtacatcctcccatctgtaatcagcctcctccactaggggtacatttgtcacagctgatgagcctacactaatgcatacatcattatcacccagagtccatagttatgttagggttcactcttgacattgtatattccatgggtttggacgaatgtataatgacatgtgtccaccatgacagaatcataatgagtaattttaccaacctaaaaaccctctatactctctttgttatctatttctacctgctatcacctggaagtcacagacctttttactatctctctagttttgccttttccagaatgtcatataattggaatcgtgtacgtggccttttcagattggcttctttcacatagtaatataatttaagtatcctccatgacttctcatggcctcatagctcatttctttttagcactgaataatattccactgtctggatgtacctcatttattcatcacctactgaaggccatttcagttgtttccctgattaatttttacatgatttctcaaagagcaaatacttcagaggttcctggctaatttataatattctgtccactaggacaactaagttgaagcaaacataacctatagtgaatactccctcaaaggtaattactattctaatttctatcaccatagatgggttttgcctgttcttgactctcatataactgaaaacatatagtatgtaaacttctgtaactggctttttttcctctctctatatatgttttgctctacgtgatggctttcagagtggtacatgttactgcatacgggaatacttcattcttttgattactattagtaaggattatggggttaactttgggttattatgaacacaactgttaagacttttaaaacttatcttttggtggcagaaccactcatttctgttaggcatatacctagagcttgatttcctgtttcatatgtctacacattcaggttaagtagacactgccaaatagttttttaaagtagttacataaatttagatactcactagcagcatctgagaattccagttattctgtatctttaccagcctttggtattcgctattctcttaatggtatgaccctggaagtcgaataatacctcattatagaaccaattcacatttccccaatgagtaaagattttgagcaatttttcatttgctcaatttatttatcggcctttgcaagagtcttttttgagaagcatctacgtgtttactttttactattgatttt

SEQ ID NO: 6118 - DNA, 415 bp, mus musculus
aaaaaatgagtttaaaaaatatacaagacatatttttgtgttattccccaatttttatcctcttgttttccttcacctaatgtacacacactgttggatttgttgacacatatttgttttattttacattattaacaaagttcttacccgtatatgtattacttgatttatttgtttgggagaattacaaatgtggttgcatgttccacgcatttttctttgactttcttttgttaaaattgacattactttttgttgtcttattttattttattgagactacgagttttgaaatctattctggtcatttaagttgtttcagaaagatattttaaagaacaatactgcaaaaaaaacctttttttttgataaatgttccctggagataatatgacagaatttcaccaggatattt

SEQ ID NO: 6119 - DNA, 1040 bp, mus musculus
gaaaattgtactgaaaaagtaagagctgttgaatgtatgatatacaaggaagttagcaaagaaatctaaggaacaccgggaaaacaaaaggatattttgtgtctctctcccaactctaacattagccctaactctgagacaatgaggtttctgaagcctaccatgtatataatggcttcaggagtagctttcactacaacttaattaagcttgagtgaggctatgagatcaatgttcccttggtagtggcatgagcaataggtaattcctatcatggtcagtttcactgctgtatcttcaaacacactctaagagtattttgaggttagaatgacatttactttgcaagttcactttttcttttcttttttttttttttctttttacagctactctcatcttgtaaagaaagcgaaggctaacattgaatttccaaggttttggaatgacctgtgtcagaactcttctggcatgaaatattatgcattattcgtaatgcccaaaaccttcaaaattcaacaagcatgatttaatttcaggtcagtagataaaattagtatgacatttttggcattgctattaatttcaataataaaagaaacacaattaattatatgaatattgtcagaaaaatccatttaagtaatatatttaagaaatccaagcatatatgcttaaactgtcatttgtgaaaagcaagtaaaaagctttgtgtgtttatgatctagtaatacttaattctacaaacttttttcttttttatgtatttaataatctgactagaaacttattttgtcagagttagagtggatgaactgacatttcagaatccaatctcttatgctctatcttaaggttcaaaacctttgatcaattatacaatagcagcctcgaagatcaaagaatccttaattgctagtgagcaaatatggggaagctgaataatgctggaccgaggcattcataacacgaagttacaggagaaagagaataatgatggaataatggtggaatatatttatttttccttttttgtgtgt

SEQ ID NO: 6120 - DNA, 2027 bp, mus musculus
gcctgcagctgtgaagaaaagctctcagaattctcaaagacaagagcacatagtctgagaggttttgccactgacattgctaaatttgaaaactccaaaattctttctgcaatgtgtgaagaggactaagactaaatattataattgttaataaacagtgaaaagaaaataaattgtattatctacatgtatgaatatatacacataatccctgactcagcatggttcaacttacaattttttgactttactgtgttacaaaacactacacactttcactatactccttgaatgacaacagggttacatctggaggaacccatggtaagttaaaaatatcgttagttaaaatgcccttttgacccaggatatattcaatgtgtaatgggcataactccatcatcagctgaggagcatctgtatagccgtccctctatccacaaaagatatgttccaggtctcccaatggatgcctgaaaccacaaataagacagagctgtctatattatgacttttcctatgtttacattccgattatacagttcaatttatatattaggcacagtgaaaggtgaacaacagtgactaatattaataatagtagaagaaattataatacactatcataaaagttacataaatgtggtctcctctgtctttgtctctcaaaatgtcttgtggtgtacttaccatttttcttcttatgatgtcgtgagatgataaaatgctcaagtgctgagatgaagagaggcaaatgatgaaggcactgttatgtagtgttaggctattgaccttctcacaacaggatagaagggggatcatctgccttgggagatcctggatcatggggccatgatgtggatggttggatgtcaggagcagaccacgttgatgactaatgggtacaaacggtgtggataccctgtgtaccacagggtacacatgtcccagggacatgtgggaagattcatgtcccaggcaggacagagcaggatgctactcagaacttaccaatgtaaaacttataaattgtttattctagaattttccacttaatattttcagactttgcctgattgaggataactgaaaccatggaaaggtaaaccatggataaggggagatgactgtatctacgtgtgtgtcagacagaatattcatttggacacgtgggcagaaaatggcctttcccagccgcatgcagtagctcatgcctgtaatccctgaaggccgaggtgggaagattgcttgagcccaggagtttgagaccagcctaagcaacataggaagacttcatctctacagaaaaataaaaatattagccaggtgtggtggcatgtgtctgtagtcccagttacttgggaggctgaggtgggaggatcacttaagtcagggaagttgaggctgcagtgagctgtgatagccccacacactccagcctgggcaacagagtgaaatcctgtcccttccccttccaaagaaaggcctttcccatgaggcaacagcagttagttattcccggtaacgatcaggacggagagccacacttactgaactattaactttagacacagaacttccttgagttgcaaataacatgcttcactaaagcaatgcaagctgtcctggtattttcttttcctctcacaatggccctgtatacacattaatctgtgatcttcatttcacagcgtcattctgaagcactaagccatgtgccaatgggacagtagtgactcagttctgtatcccaatttatcagcagggcaatgctcactatgtgtcctcctgggcttgaagggaaggaagccatctaggagacgtcctccctcatcatcccttgctcatgtttccccggccctccctcacgatacctgcccttccttcccactgcaataatattccccgaggaagccctagaaggcttttgggttctgttgacaattacaggaataatttattttcaaatggatgttaatctgatagaagtagtcaaattttccctgagctcaggcagaaacaaactt

SEQ ID NO: 6121 - DNA, 935 bp, mus musculus
atagatattttggaaggaaagatggttttaatcaagaaaaaaaatcctctctcttttttttttttaagcttcgtagtgcctagagtactgctgaagcagaatatctctataataacatccttgttgagtggcaacttggcttagatgggaaccatggatccacccttccctgttgagtgaacttagacaattcacttaacttctctgaggtctagctttactcttagaaaatgaagatatcaataataaactacttcaaagggttttgtgagatttgagtgagttttgtaggtaatgcatttagcctagtacacaaaagacattcgatacgtgttgttttatgtttatgtaaggcaagttatgacatggtcacagttgtttggcatctaggaactagattgtggagatactgaagataattggctgtccagctatacagttaacacttattaatcggaagaatgacggtgactcagtggaaattaattcatcctcccgtctcactaaattatcgctgtcattttcttacatatatttgcaaaataaattaaatgattttaggagcaaaagggtggtttagtgtgcaatgcaaagttttaatattttgtataaaattccaaaaaaaatgcctgacaataaaggccactgaatagcataaaggaaacttgtagaggaagctaatattttctctgtgagtgttggttattcgaatacattctttacaacatttgtggaaagtcttttcctgagtattttctgcctttacagtttgtctctgaaatccaaattatctttcagatatttatttcatcctttacataattttaacactttcccaacttttctcctctatataaaattttcatatgattttcccaatggttgtcaaatctacatcatattttcctctaggcttttttcttcggtgttttctt

SEQ ID NO: 6122 - DNA, 222 bp, mus musculus
tcacccttttcaaacatccttctaatctctcaaatttattttattacaaccactactttcattaacttctctgtagccctagtcttcattgcactctgtctatcattcctcaaaattgtttatgctaaccttgaaaataccgcttccctctattttctataattgtaatttaaattttcctgttagttttcaacattattccttattgcttgatctttaata

SEQ ID NO: 6123 - DNA, 192 bp, mus musculus
aattaaataaacctatcagagaagtatcaagaatgaaaatatagagggataaaacctattgagaggttttttaaaaacagctagattaatgctttatatatttcaagtcacaaaagattttgccatgggtatttcgttctatttctcacaatttttatggaactcacgagttgctggggaaatgcttaaaga

SEQ ID NO: 6124 - DNA, 1230 bp, mus musculus
gttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttg

SEQ ID NO: 6125 - DNA, 1067 bp, mus musculus
atagttaatatagattcgttcaggtgataaggtctcagtatcgcaaataaatttgtatccaaaatgaataagcatagttctgtttgtctgtaagtaggcatatcttttgtatcataaaaatagaacatagtaaattaatgttttaaaaaagtacacccagcaggatagatttaagaatcatatttatattaaaatgtaaaagatttaactctgggttattttcaatttgtgaaatttgtgctatgtaatttcaaactctttaattcacagaaagcgaatgaagagcaccatcgtttacttaaaggagcaccatttaagttaaatcttcacccaagggactattttgacgctaatccttatttttctgaggaatctttaccaccaattaaaaaagaagagaagaagaaaacaatttcaaatacttttaaaccgtcttctcctggtaaaaaggtaagtttacaattttaggatgaaaaaattaagtattataaagaaatactgtctcttgctatcaaatgattttttttcccatgtaaataataaacttttgtttgtatggataccaagaatcattggacccatttttacaaaattacatgaaatcaccaagtatgaatagtgtaggggataatgaagcccttgtcatgaagtaattattagtctcttcaaatgtatttgaatttataattttttttttttgagatggagtctcactctttgcccgggctggcagtgcagtggcatgatctaggctcactgcaagctccgcctcttgagttcaagcaatactcctgcatcagcctccagagtagctgagattacaggcatgtgctaccatgcctggtgaattcataatgaatttttgaagtgcttctctagaccctaggtctagtttttcttaaaaccataaaaagccaaaccatcttttagtttttgaaatggtaattaaaattaactatcttcctactgcagaagttaataagtgagaataaaaattaaaatgctccagcagtttataaaccttagtcaatactttttttttctgtaaattgcctcttcatttttct

SEQ ID NO: 6126 - DNA, 1018 bp, mus musculus
catggtcatgaaaaaaaacgtaaactatttttactaacatttttaaagtgaagaagaaagccttattgtataatttatagtggattctaacttcattgccaagaataatacattatagtttcttagtcattttcattatttgtaagagtgttaaacaactcctaatcattttacttatttttaaagttaataaagcaatatatgtaatatgtaaaaacattttccatgtaaagttaaatttagaaagtgtaaaaattggtgtgtcactgttcacccttattccgcccttgctccctcaagttctgatttcccagtaggaattccataaaatagaatagcttattagaattgtagttgatatgcaattaggtaaaatgttaatttgagcacaacacatctttataatcttgaaccttcctctattactatagttttattattatttattagtatgttttttcatttattcagatattatttctgtctctcaatgtggttttataattttcttgatataaattccaagaacctaaaatcattgctttatcaccttttgatgcttttggacttgtcacccaggtgaaattcattttgaactacagataaagagatacttgttatcaataattgtgactgtctgagagttcactctctttacaagctagctgtttagcctgttccattttcatgactgtttcaagacagcaggaggttctgggtcagagacaaagaatagtttattactggaagcaatagccagtcacttgactctgggtcccagaagcctaaacacagggcattgtgaagagagccaggtgacacttgcctgccaagtagactgtggtacagcacaaacgaagctgtgggaatctcctcttctcatcgcgggcattcaacattcctgctctgcttcagaaggaggagctctatttttcaagactaaacaaacctgctcttctctctgtaaggtaatgggacctgtatcttccaaggctctgtggtatatgaacgtcctgga

SEQ ID NO: 6127 - DNA, 802 bp, mus musculus
ctaaaagagtaagaggctgcctgtttattaaaagcagcattctattaggaaagcatgtatgtactgctgctggtgcctttgcagactttgagtgtgtgtgtgcgtgtgtgtgtcaaactgtgggagtcaactgcagcacagaaatcaccacccagagggggcttctccaagtgcgcaagctcagcagaggaagcctcagccctgcggaagctcagggagggtgaggatggaggctgggagatatttcctcacagctcctcttgtgccttctctctcttccctccctacttgaccctgcccactccttcagtccctcattgtaacccactgtcttttcaaaggtacatcattcttacatttggattttaaaatgtgtgacgaaagctagaatgcaacccaggagcaggagctctgcactaacaggagagggctccttctggtttccatgttccacacacctttttcattaggccaaaagtcaccaagggtgcaatgggagctggactatgctgtcccctttgacaacatgatttcacagagtgcttcctgcgccgatgcagagaactgtcgccagattcgtgagcaataatggtatgaacagccattaattagagagggagattagcttaaacaaaaggggattgaatttagacccactcattatcttttccattgttagctctattgaactccattgtggtcgggataagaacaagagaaatggggattgtgtggagtatgaatcaattaacacatatatgcctgctgtgtgcacacattgccctttaagagataaagaaaa

SEQ ID NO: 6128 - DNA, 593 bp, mus musculus
caaagtcaatattcctacaggggtaacagtttcttgcatttttccctatcataacattttcatatcataacacagtcataaaaataattaattccacaaggcattcatctcatttatatcttgattgacatttgaaacccctaaccaagatccataaagaattttttcctcccctttctcaaattttaacatttagttctcatccagaaaataacataagggttctactatatttgtaggtttaatcagccaattgctttgcacacctgaagttaagaagaattgatcaattcctaatttctactggagcaaaaactatgatgaaaaatcaatagtttaaaatgtttaaatcactgtttaaaatactaccttatagagcaaacagaatgtagggattctacacctgacacacaccaactagaaaaaaaagtataaatccccattcagacgtatgtgaaatcactgcctttgcacagaccattctttgacgggcatttgtgaagcccaagcccacagcaaaggtcaggccttctctttgccttcaaatgttagcaggacctcaaaacaaatacacagcttccatactgagccaa

SEQ ID NO: 6129 - DNA, 3718 bp, mus musculus
tgcttcatcttacatgcacagtcaccaagtcctatctcttcattcttagaaatgtcttttggaggctcactttaccactttcactgctcccacactaagccaagctttcatcatctcttgcctggcctattaaattagcctccagccttcggtccttttgaatttcattctgtcttctttaacactattgcaataaaattgttagacatcaatttcattatgctattccaattgtttaaatacccagagtacctttccacctaatctaaactcttcatcctgacattcaaggatcttcacaggtttgagccaacttacctattaggccccatttctcactatacaaaaaggaaatcccctgcctcagttagcttcatcggcccatcacactaattcccaccttatcttatttgtcctggactgccttcctctttttctacctattttaatcctatgcatccttcactgctcttctcaagtttctcctccatgaagccttccttgacttttctatcttatccctgacttttatatgtgcatattttccttctttgctactttgtagtattcactgcctttgggacctttcattactggtttcttatgcataagtctcatctcttcattgaagctcctcaatggtaggcaagtgcagtgtcatatgtactacaggcatacctcgttttattgtactttgctttaagacttcacagatattgcatttgttacaaattgaagatttgtgataactctgagtcaagcaagtctatcagcatcattttccagcagcatgtgctcatgttatgtctctgggtcacattttggtaattcttacaaaatttcaaactttttcatgattgttatatctgttacagtaatctgtgaacaggaattgatgatgttatgactgtaattgttttggggtgcaatgaatcatgcctgtataaggcagcaaacttaataattgtgtgtgttctgactgctgcactggccagccattcctccatctctctccctcttctttggcgtttccattccctgagaatcagtactattgaaattagggccgggtgtggtggctcatgcctgtaatcccagcactttgggaggccgaggcgggtggatcacgagatcaggagatcaagaccatcctggctaacacagtgcaaaccccatctctactaaaaatacaaaaaaaatcagccaggtgtggtggtgggcacctgtaatcccagctactcgggaggctgaggcaggagaatggcatgaacccaggaagcagagcttgcagtgagcagagatcatgccgctgcactccagcctgggtgacagagcgagactccgtctaaaaaaataataataataaataaataaaattaggccaattaataaccctacaatggcctttaggggttcaagtgaaagggggagtcctgaatctttcactttaaatcaaaagctagaaatgattaagtttagtgaggaaggcatgttgaaattgagataggccgaaactaggactcttgctccacatggccaaattgtagatgcaaaggataagttcttgaaggaaattaaaaagtactgctccagtgaatacatgaatgattaaaaaaaaaaaagtgaaacagccttattgctgatatggagaaagtttcattgattaggataaaagatcaaaccagccacaatattcccttaaaccaaagcctaatccagagcaaggtcctaactctcttcaattctattcaggctaagagaggtgaggaaggtgcaggaaaaggtgctagtttaaagctagcagaggttagttcatgcagattaaggaaagaagccatctccataacaaagtacaaggtgaaacagcaaatgttgatgtagaagttatagtaagttatccagaagatctagctaagataattgttaaaatggctgcaccaaacaacaggtttttccatatgaaacagtcttatattggaagaagatgccctctaggccttttatagctagagaggacaagtcaatgcctggcttcaaagtttcaaaggacaggctgactctcttgttaggggctaatgcagctggtagctttaagttgaagccaatgctcatttaccattctgtaaatcctagggtccttaaacattatgctaaatcaactctgcttgtgctctgtaagtggaaaaacaaagcctggatgacagcacatctgtttacagtatggtttgctgaatattttaagcccattgcttagatctactgctcaggaaaaaaaaagattccttccaaaatattactgctcattgatgatgcacttggttacacaagcactatgatggagatgtacaaggagattaatgttgttttcatgcccactaacacaatatcaattcttcagcccagggatcaaggagtaatttctgcttttaactcttattatttaagaaatacattttgtaaggctatagcttccatagataatgatccttctgatgaatctggccaaagtaaattgaaaatcttctggtagggattcatcattccaaatgccattacgaacatttgcaatgcatgaaaggaggtaaaaaaaatcaatataaacaggagttttgaagaagttttcaatcctcattggtgactttaaggggttaagatttcagtagaggaagtcacttcagatacagtggaaatagtgatagaactagaattagaagtgaagcctgaagatgcgactgaattgctgcaatctcatgatcaaactagaatggatgagaagttgcttcttatggatgagcaaggaaagtggattcttgagaaagaatctaatcctggtgaagaagctatgaccattgctgaaatgacaacaaaggattgagaatattacgtatacttagttgtcaaaacagcaagcaggatgtgtgaggggattgactccaattttgaaagaagttttgctgtgggtaaaatgctattaaacagcatcgcatactacagaaaaatcttttgtgaaaggaaattgagcaatttggcaaactttattgttgcttattttaagcaattgccatagccacctcagcttcagcaaccaccaccctgatcagttagcagccaaggttatgacttgctgaaggctcagattgttgttagcattcgttgacaataagctacttttaaattaaggtgtgcatactgtttttcttagacataatgccattgctacttaataggctacagtatagtgtaaacataacttttatatgcactggaaaatcaaaaaaattgtatgacttgctttattatgatattagctttattgtggtctggaacagaatccacaatatctctgaggtatgcctgtagttggtgtgcacatcagtagctgtcagagcattagatagagaatgacttctaattaatatttgttgaatgcaaattatgctgtcataagaatgcatacagaatgcataactcttctatttcctaataatcagtccaacatttggcctgaattttctctagccttcaagactttggacacttgaaagtaccaaattgaaatggaaggactgtcaactttgcttgggtttcatcctttctataagatgggacatttaccttctcgtttcttgacttattcacatgccttattgaagtcatgcattgaaacatggaacaaatatcgaacgtatgcaaattacttagcaagtgaaggtttttt

SEQ ID NO: 6130 - DNA, 1348 bp, mus musculus
tttcagaaaacaccagcccacgtgggcttaaagtgggctggctgcttggcttacacagagacatttgaaagcagatagcggtttgaaacattcatgtgagattcaaaacagggacaaaaagctgatggggcaatgagggagggggtttcagaaagttagaaaccattgataaaatcttgacatttcttagggaattcatgcttccccatgcaaagtgagtggagaaggaaactagaaaatggttccagcacaaatgaggggttaaccatctccccatttttaaatcttcacaggacttccctccaaagtttacataatcctagattatttctcagaagtgttatattgaagtacagcattattattttgaagtaaaactcacaacgctagagtttgaatttatttagacctatgatgatgtttcatttcttttgtcaatatcgccaaacatgtctaaattcatatggacagagaaactgaggaaccaggaagggttacacacaaatcagtgtaagcaactccacagcctagagagtaccaagggagagggcaggatatggtgttagttgtcccaactcagggtctgaggcagggcctcaggaggaggtatagtcctagatgcttcagagaacaggaccagagctaacgaggaggaatgacagagaggcaggtttcagctcaatgcagtcgagaatttcccaatagaacaagatgccctgtgagttgttgagtgtcccttcctcctgctggaagttttcaagttcagactggatggccattaccagagattaggaaggggacatgaggtttgccactctgcttcgatgttctgcccctgccaggggcccagggtgcagatgagggagaggcaggaagtgtttgtggctgtgatcctgataggaatcttcaaagacccaggcgctgccctgtatcagcccaggcttctttctttactctcttctggtcaacctgtcttcctcggctccctaagccattctgagcccactggaactttttacacttgacttccacttgggttaagtacctgcttcctgatgtgcgaagtagccttttattcgttttggtgttaaacagacctctttcaagttagaatatgctccctacttacagtattctgggattttgagaatgattccgtgcagctactgtctgactttctttatcattctatagcctctcctagatttcgtcttccaaaccatgaccctcatgtatcaaatccttttcatactaaaacctgttagtcaccttgatagttttgctgtcctttggatcttttccacctctttttgtgccttcttcaagtggaatgcctggaacctttggc

SEQ ID NO: 6131 - DNA, 1884 bp, mus musculus
tcttagaggaaatttaccaaactaaaagcgaatacatttaacctatatgattgcatttgctggtgaaggtaccaaatattaaattttggacagttatgaggaggaacctgaaaatgggtcgttgctgcttgacctctcggcttcttttatcaaccctcctcaaggctcccaactgaaagggatctgtttctctaatagtcctcagtataaattgctttgcatcatagttaattatatacacagttcctttactagattaaaagttcatttcagatatgaatgatgtcttatacatctttatctcctccaaagcactggacagaaaagtcttttacttctatagttagtagctgcattgcatttgcaaaatatacttaatataaataaagtatttccctttaatatagtccccttttatgaataaatttattccttacatcaaagcattttttgggtgtgataataaaattgattttggatgatcacccacaggtgtcaaacttaattttctttgtcctttctggctattagcataccacatattcatatatagactttctaaggaagacccctctaaataatccatattttacttaataatatcctcagttgtatgttaagctaaattcaagagttaagcatgagagcaaaaagtgaaagaaattcaattagaaaattcaaagagatgacagcagacaaagaaggtctaaaattagttgagatatgaatgacttcatatctcatcattctaatgtgtgggccaggatatacacacttacaaagagttctctgaccaagccaaataataggccaaagagttgatctcatgaaaaaaaaacttaagaaggcaaagtcatacagcgtaagtctaatacaagattttagaagttctaaattatcgagtctttttttcttttttttgagatggagtttcactcttgttgcccaggctggagtgcaatggcacgatctcagctcactgcaacctctgcctcccgggttcaagcgattctcctgcctcagcctactgagtacctgggattataggcacacgccaccacgcccggctaattttgtatttttagtggagatgggggtttctccatgttggtcaggctagtctcaaactcccgacctcaggtgatctgcctgcctcggcctcccaaagtgctgggattacaggtgtgagccaccacacccagccaattatttttttctttaattaaaaaaattgtttttttgagacagggtcttactctgttgctcaggccggagtacagtggcacaatcagggctcattgatgtcctgggctcaagcaatcctctcacctcagcttcctgggtacctgggactacagctgcatgacactgtgcccagctaattttttttaaatttatttttttgtagagacagggtctcactatgttgtcctggctggtcttgaactcctgggctcaagtgatcctcccacctcagtcttccaagagctgggatcacagctgtgcccacatcaagtcttttcgttttgttttgttttttgagatggaatttcgcttttgtcacccaggctggagtgcagtggcgtgatcttggctcactgcaacctccgcctcctgggttcaagcaattctcctgcctcagcctcctgagtagctgggattacaggtgcacgccaccacgcccaactaattcttgtatttttagtaaagacggggtttcactgtgttggcgaggctgagtcttgaactcctggcctcatgtgatccgcccaccttggcctcctaaagtgctgggattacaggcatgagccaccatgcccggcctcacatcaagtcttttaaagaaacaatagcaaagattcacattgtcttttagtttagtaa

SEQ ID NO: 6132 - DNA, 1202 bp, mus musculus
tgaaaaaggcatacatgtatgaatgtacacgtgtaattagttcattttagagaatacagtcctagatcagaatgtctttatttttggctgttatctaggacataaaccaatgtaattaggaacttaattactcctttaatgagagtggtgactacaatattccatggggtaccagcttagattttatgtaagctctaattaaaatgtaaacatattttcaaagtatagcaaaattgctctgcaaatccatttgttcccctcttgtttataaccacccatttttattttataaatatccactaaggaaaatgagtatacagcttaactgttaagtgttatttgaagttagaaccatcccacaatcagaagaaggaagaggaaaaggagaaggagaaggagaaggagagacctggtggcataggagaaagaaaagaaaggggtaagggtgaaagaggaaaataaaagaatggaaaagggagaagaaggagaaggagaaaaaggagaacagtacaggaacttgtattcatccaaccattcatttattgtggagctattatattatgtattgcatactgtcctaagaacaggaacaagaccagattctatattctcaagactgtctgtggagtagagggatacgtacaggtaaacagctacgtttaatacagtgctaggaaatcagaaaagctattggtaaatcacatagaaatggtttttctccagaggtgcaagggatccaaaaaggcttcatggacgatttgataattgaatagatctgagagtggagaaatgaacataattgcagcatagggaatattttagaggcaattactgcctgaaatgaagagggagccatatgaacaagtgcagaaagtgacggaatatcttgctgaataagtttgtcattcagaaggactaaacccgaggagttatcagaggtacagctggaaagagtggggtttgcactacaaaatatatatattccccttctcttgcatttctatacactttctcctcattgagagatcttgtctctaggtgggtcactcttgaccaaatttatcagttcattcttaaaaggcttccctttctttcctctctggcctaggcttgccatcttaatactattcattgtcttacccatgttgccagagcacctactttggattcttacaacgattactcttacatctctcaacata

SEQ ID NO: 6133 - DNA, 663 bp, mus musculus
cttcctgtgtcctcattatgatgcaattttgggtctgtgtagctgcacctgttcttaccattctccgtcattttgtggaatgttgtgggggatttggatttaggtaactgccattatccttggctgcctaggagtcttcaataccagtatttcaaaagctcttagaaattgatacttataaaccctaatagaaaaattagcacatgacatacatagggcagttttccaaagaagaaatacaagttaccagtgaatgcaggaaatgtttttcaatgtcattagtaatcaaagaaatgaaaactataatggtaaaataatttatctcttttcagaaataatatatctgttttcaaattggcaaagatttcaaaaaaagaaaaaaggaaaataaaagtacccagcatggtccagatttaagggaaattagtatatagtatactgctgacagccacaaacatcatgggagttaaagtctccgaatgtctgtgttttaaagacacaaatggaaacatttatgaaagctgtgtccaggtgactcagccccctcacccccagcttctacctcgtgtgggatgtgagactgggcgagatattccacctggtagcctgtgcttgctcagcgtcagtggccattgctgccatggacagatcctgcgactcaga

SEQ ID NO: 6134 - DNA, 867 bp, mus musculus
gcctttaatagactccagagttccaaagatagttacctcagacacatcctgccattgcagttgttgttagctagggagatgtggcttcctgctctgccgtgttcccagaacaccgcatgcaggcagccttttatgtggtggtggttgtttatgttgtgtcttgtgccttctccctagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaaggtaaagct

SEQ ID NO: 6135 - DNA, 1166 bp, mus musculus
cacagctgcaaaacaaatgggcatttgataaaacacatcaaagtttatgagattcaactaaaacagtgggtaggaagacacacagcagtttagtatgtgtgaaaacagaacacgtcagaatctgttgggtgtacctaaaacagtgcttagagggacatttatagtgttagatggatatagtaaagaaaaagaaaaatgaaaatcaattatattttctttttaggaggttagaagaagaaaaggaaagtaaatctaagaaaacagaagaaaataataaaactaagagaaaaaatcaataagatagaaaccagagaggcaatagaaaaaaatacacaaagctaaaagttgatcgctcgaaaagttaataaaattgatatgtcctcagagactcaaaaaatgttagaaggcacaaattactaatttcaagaagcaagaagggaatattcctacagatcctccagacattaaaaagaataattcacatatgttatgtccattttcaaatgtgtacacatcacattcagcatgctcaaaaccaaactcatgctatcctcattttcttttcatagtagtcctatcccctgagattgtttttactcttttattgtccttctcttatatttacacatacatttatttacttatgtattcttggaccctaatagctagcaaatatctaaatagtggtgagtgtgtttggtgatagtcactacagaacacaaagatgactaacatacacagagtctcgttttacacaaatatctagttcctgctaagatggtgaagttgcacaggcttctggttctgtccctcaaaataaaccctgaaaatagacagagcttagagggcagcacgcactccagtgtggcagacagcatccaagtggtcacagcgttccacaccctcggaagtagagttcatgcctgtatcctggaggctggctgggccacctgacctgctttccctaagggagctttagtaggtgtgacataagcaaatgcttgaaatgtgcttgcacctggggctttcgctctcttcgccactgtgtgaataagcctgggctggcctaccagggacacatagtccagccaactggcagcaccactgctagacatcgaggtaagccatcctggaccctggagagatgccagcgacccctggatgag

SEQ ID NO: 6136 - DNA, 924 bp, mus musculus
aaaatttatattttaggtacaacaaagaagtgaacaaaaacatcaagacagacgtttctcacctgcatcagttctgtgttttctgcatttggaatttcccaaactgttactgtttgttaattggatagtctttacttattcaagttttatcagttttttttaattgtactcccttaaattgtttgctctcagactagagctaaatctagatgaaaatgtgttgtcaccaaacagtgaaataaaataaaacacaaaaagctctttatggcccacagctggccatgcttaaaatctgggttgtgtgattgcatcaactccattcatctgaaataaacagagaagggggaagacaaagagggaaaaaaaccaagaaactctcctctcacagaaacagtggctcctttcccttcagacgattgtatttatgtagaggcccagttatcttaaaagtattccctgtgtttgacaggaagaccagagttggattacccactgattgtgaccttttctcgtacagcagcatggttacaggacaccatcacaagaaaggcagcccctatgctggcgaggagctcagagcatgagctacccattcacccaggaggtgctggaaaaattggtggccacatcagtgggtgggccagaaaaaacactaagcttccctccatcacctcttagagttcgttaggattttaaatgcaaactccaaaggccgttcattgcatgttgtgttttagtgaatgctggtgatcgcgggcgcctattttagcctaagaaaagaagaggtcagaagccatatggacatgcacttggccctggcaggtggaattggaaggcagaacttcatgttcttccctatcttaaagaaagattatttgtagctcattgtaatgtctcattgttctcatttgttttgctaacaca

SEQ ID NO: 6137 - DNA, 501 bp, mus musculus
gagctcctgaaagttcacgaacaacatctgccccacgaaagacacaggggctgatggagaatagctactgagagcacccacaaaggagcattagaagatgtgggagcacccgaggatgtgggaacacccatgagggagaaccagaggtcctgaagcatccacaaaagagcactagaggatgtgagagcagccacagaggaggaacaaaggatatgggagcacctaggagggagtatcagagtatgtcaaacccccagaagggagcatcagaggatgtggaacccccaggagtgagcatcagaggatgtggggcccccaggagggagcatcagaggatgtggggcccccaggagtgagcatcagaggatgtggggcccccaggagggagcatcagaggatgtgggtcccccaggagggagcatcaaaggatgtgggagcacccaagagggaggacaaatgatgtggggcccccaggagggagcatcagaggatgtggggccc

SEQ ID NO: 6138 - DNA, 1682 bp, mus musculus
tgaggtcaggatggagagaagcagacagacagagacaacccactggtctggaatcctaaaatgagaagaccctgtttttgagtgtggctgtgaggagagaattttcaaaggtgactttcaaggatttgcatctgggtttttggagacagaggcattatgggcagacttgagttatcctgcaagacaaacaggtttaagaacataaagaagctcttggttgatttgaaacttgtggagcttgagatgcaagtagaagatacgtaggaagataggcatgtcttgcaaaaggcaagtgcggagctggagttaagagacacacttgaaacttttattggaatgagtgctgttgcctcagctattgtgcaaacttggggtttctgcagaggatcacaggaatgagatccctggctctgcactctttagcctctggacagaggtacatctaaggggaatgtcatccatggggaatgtccccatggtaacatggaaacccaagagatagcattcgactatctggagctttttacccacacattctttacatgtgccaaatccattttagttttacatatggccctatttgaagttgcattggaaagcaggcttaaaaaaaatgagaactctttgagattaataaggagtgaagaacattctccctatgggactcgaagctgcagttgagtttcttcctccctgtcctgcctgccgaacactccccaagcaccactagccaaactcctgaaatgctaccacggaaacctctgatttgatttaatgcaatttgcgcaattgacccttgaaaattaattttgccatctcataatgaatacttaacagggacttctgtattcagaaaactgaagatctattttccatttggttattgtggataagccttccacagacttccatttcaaggctcaaaatatttgccgaagtatattttaatggagacggtattagaattttaaagttatccaaaattaagctactcaaaagttatgataattttaaagaaatgctaaaggtttttgcatagaagcaaatatgtaatcataaaagagaggttctcttttgtaattgtcaactctggtacctgaaattattcatttaatacctgttgtgggatataagattttacataaatgttatgtgtagaaaaaacagtatcttaatcgaacatactttctgtaaattgggagggcaacacagagattccaaaataaatttcatttgctcaataagctataaatacacaacaattgattttcccattcctaaagaaacctttctgatagctcagtggttctcagtcagattcgttggagacctgggaaaggatctgcacagcacaccaccagtgtgtgctggtggtagctcttagtggctttggaagatgattttggggctagaactcatgcatgttccttccttgggaagatgaagtgagggaggtgccccagcctgcctgtgtagatagagcatcgcttactacaggtccctccaaaggcatgcctgatatgtcttcccagccaaactttgcatttttatacataaacggtctaagacaatactttttgccttggtttcacatcccaaatatggaatggaacaagtggaatgcatatgatgctaaataataatgctttactgaaaaaaccttcagagtctttatttttaaa

SEQ ID NO: 6139 - DNA, 1667 bp, mus musculus
gtgacagccgtgtgtggctcctcccattcttcatctgtacaaatggaagagtttattgtgtcactgttcttcaaagataactttcattattgttgtttgcttttgttgttgctgttcataagtcttcagatcaagaagtgtcagatggagagactacagaaaacactgacctttgattgacagtgattaggcggtgttttcttccactagagcatgagatacgtcacacagagggagagaaatgaagatgtatggccaagagggtgcactgggataacttgttttgtcaactcttggctctctcttcctggaagaagattctccctccccttcttcacatggtcagactggacaaggagacttgctttggctagcagtgtgagctgacaaggtatgtacactgcatctgagcagatgctttaagaacgttggtgtgggccgggcgcggtggcttatgcctgtaattccgacatttagggaggctgaggcgggcggatcacgaggtcaggagataaagaccatcctggccaatatggtgaaaacctgtctctactaaatgtacaaaaattagctgggtgtggctgcatgcctgtagttccagctactccagaggctgaggctccagtgagcccagatcatgccactgccctccagcctgggctacagagtgagactccatctaaaaaaaaaaaaactttggtatgtttgtctcacctctgaggctccttgcctttggccatgatcaggacatgtctcaagtaggggctgctccttcagcttttatcctgaataaagtttcatgaagccaacccacagggaatgtaaaatgtgaatgagaaataaaccagagatttgagggttgagggttgtttggaactgtagcaaaataaatatagtgaaaactgacagattctggaattacctatatagttgagtacctgcacaacaagagtaaagcaatgttgtgcctagaaagcatcaggtcaatatggccaaaggtttctttgtcaaagtttaaaagatctgagaaggccaggtgatgtggctcatgcctgtcatcccagcactttgagagaccaaagtgggaggatcacttgaggccaagagtttgagactagcttgggtaacataatgagaccccatctctacaaaaattaaaaatcagctggtcatggttgtgcacaactgtagtcctagctactggagaggctgaggctggaggatcacatgaggccaggagtttgaggttacagtgagctatgattgcacaccacaccccagccacagcaacctagtgagaccctgtctcaaaaaaaaaaagaaaaagaagtttgaaaaacaaagggttggcagcatataaacaaaacatctagactctcttgggtagtctagactgaaacgtagactgaaatgatgatgtggcctgccctactgtttggctgtaatcaccgtgccaaaagaatttgtagtgcttttgaatttaggaaaattctggcaagtaggacttacttgcattctatgtaactatactgtgtgctgaatatgattttctcagggagtaatcaaaacagatttctttgaagatgaagcaaagttcagaggttttgttacctgaatatctgtacatttagaatgggatgtctagccgtaactgattcgaaggttat

SEQ ID NO: 6140 - DNA, 2383 bp, mus musculus
gctttctgtggctgtcaaggactttctagagaaattggtcttgagcttgccatttcgtcagtgctggctctgtgctttgttaactccagggagcttgaagcctgtttttttgttgttgtttgttttgttttgttttgttttgttttaacagatttggacaaaacagaatccagtggtagtgacagtgatgatggcagccaatgtgattaactgaagcatcatttttatttattttatttatttgcttttgcttatttggtcttaaataccaagttgagatatcattcaatgagatttcagacagcgttaaaagtgaaatggcaaattccgtgggattccatatgactgatgagacatgattatttgtcaaataaagcaaaatagaactgttctttgtggtctcttcttcaaagtagcagctctgaaacgtacctaaacccaaaagtcaagcagtgtgttggtttaatagggttcctataacaaagtgcccctaactgcatgggttaaatgtgctggaggcaggaagtttcagattagcgtgtcacagggtcgattgccttggaaggctgtgagggacaatctgtcctaggctgccgccctcgcttctgctgatttgctgtcaatagatggcgttccttggcttgtagaagcatcgcctcaatctctgcttcatcttcacatggtgctttccttgtgtgcatctatctctggatccaaatttcccctttctgtaaggatctctgtcatattggattaggagcccaccccactccagtatgacctcttaactaattacatcagcaatgaccctgttgctacataaggccgcattctgagggactgggggttaggatatcaacataagaattttggtgagggggtaacaattcaacccagaaccggcagcatacccgtttccaccccatcccacaccaagtagccccaacagctgctgagccagcagccaccctgccctgcagcacagacaggggaccagccacttaatatttctggttaaaaccaccaaggaggaaggtcctgagtctccaacttatcagtggaagacaggaagagaggacagagaagggaagggaacattctttaagataaaggagggatgggagaggagataaggaaagtgtagtgggtgagatggtggccccccaaaaatctgtccaagtctaagtccccagaatctgtgagtgtgaccttatttggaaaaagagtatttgcagatacaattaagttaagggtcttgagatgagatcatcctagattatccaagtgggctataaatccaaagctaagtgtccttgtaagagacacaagaggagatgacacagacgcagaggagaaggccatgtgagggtggaggcagagatgggagcgatgcagcctgatttggtttggatgtttgtcccctcaaaatctcatgctagaatgcagtccccagtgttggagatggggccttgtgggaggtatgtgggtcacagggacagatccctcagtaatggcttggtgccttaatgagtgagtatcactctgttcgatattgcaagatctgattgttataaacagagcctggcaccttccccccctccctcttgcatccttctctccccgtacgatctctgcacacactggcttcccttcaccttctgctgtgggtggaagctttctgaagcccttaccaaaagcagatgctggcaccatgctttatgtacagcctgcagaaccatgatccaaataaacttattttctttacgaattacccagtctcaggtattcttttatagcagtacaaatggactaagacacagccccaatccagtaaatgtcaggagccaccagaataaatgccaggcctcccctagagccttaggcgggagcatggccctgtctgctgataccttgatttcagacttgtgacttccagaactgtgagggatacatttctgattttttatgtcaccctgtttgtaataatccactgaagcagtcacaggaaactaatggaaaggaaaagaaagaagtaccattttcaggggccctcagggtccccagtggtggcccaagggggcactaccctgaaacccctgaagtcctacatttttctccagctctgctctggcctgactcacatgaggaatagcagaaccaccagctgatcctgtgctgtagtctccagtgacagtttcctttgagcaccaccatctttccctgtccctgtccaccactctgctcctggatctgtattcaggcacatgctcacctgaacttgaccttagcaatgtgacactggaaggaaaacagatgctgcataagctctgtttaactaatggaattttgtaaaaccaaacaaacatcactgaatcttcagact

SEQ ID NO: 6141 - DNA, 621 bp, mus musculus
tgagtgtcagtcaggataaactaggttacaccttggaaaaaaacaaaacaaaacaaaaaaagaaaacatctaaatcttggtgattctttgtgacaaaagccatgaataaatgtgctttcatagccaaaatatagtgtctacatattcataacagcaatattaaatatcatatgaagactaaaactgggcaaaattattacagtatagcttcaaaacagcatagcataaaagactgcagaaatttatgtcttttcaatcatgctgttgtatagattagctcaattcctgctggttctgctaatgtgtaaaaacccattttaaactggagttcaagctggaataatctcatgattcttattggtctcatatatcctctatggctctagttaggatgatctcgtggtttacttagtttttttttctcatataaaaatttcaccaaaagtgttctaggctatgaaagattaagtcttggaataaaatcaaagattaggttcacaaaaataataaactattgacaaggtgtaccagtcattttgttaaagacgtggtcaataattaggtttataaacttttttactaactggtaattgaattgaccgaatttaccaggtgctttga

SEQ ID NO: 6142 - DNA, 159 bp, mus musculus
cactgattcagggaaataagaaagaaatagccaaccaaagtaacagattaaataaattacattttgttactaccaaatacatacagctactaggtatattaatatttgacaactaaggaattttcataactttcttcaataaagacatttattcataat

SEQ ID NO: 6143 - DNA, 582 bp, mus musculus
agagatctatattgtctgaaatccaaaaggagaatccaaccctttcccaaacagagggatattaaccaggcctaggtccatcagtgccagcctctctcagcagctcatctccactcgatgcccagaaagccaattgatcacgggaattctgtttttttcctgcaaaaggtgaggcgaaaatgagtgtatgtatgtgtgtgtgtgtgtgtgtgtgtgtgtgtgtgcatttagttacattactaaaatgttaatcaaaatgaagttaaaaatggcctgattggtccccctgataattgggccattttgaggagcagaggagaaaatgcagaaaatagctctttgtaaactaaataaaggcaagcagcagtattattatcatttacctgtagacattcaaggtgttttaagtttttttgactaaattttactagatttatggtacatacccttcagaattcaagaaagctttcagcatttggtgttcagagttcagatcttttaaactgtcctggagaatgaacttgttaacagaaagttacacccacacacattcactcttgaatatgtgctatggagtgtcta

SEQ ID NO: 6144 - DNA, 684 bp, mus musculus
cgcccatcctttgccgtcaagaaaacagtactaacgatcataactgctttaaagcctcttacaaaaatctctaaagttgattccacaataaaatatttaccagaaaatattcaatgataaaaaaaggcagtcagtacacacaggagattggtaaatgtttaggctttaaataaatgaacgagggtgtcaattacaaataattatgttagataaaataaggctgtgagcagttcgaatgtttcatatggaatcatacctctgcacaaagataaaaaaacggagacatgactgaagaatccgattaaagactttggggaaaaattgatgtttattttgagcaaatctttctttaaagtggtctttctagttagctggtgtatcttgacagtcatttgtggtggttgcttttgtttaagttgggaggcatatttatgctcagcaatcactacaacgtgccaaattttgaaatatattgggcatgacttaaataaataccacccccaaaatttccacaattataagttagaagattcagctctaaaactccagatttgctaaatgactccttaacactgagtgcagcagcagctgagcagttttcctctctctcctgcaatctgtatgtgtacctggcggccatattttcttttatcagatactgttgctggggcaaccacctccttt

SEQ ID NO: 6145 - DNA, 790 bp, mus musculus
ataatcttaggcttgattgatattttccttgtagaatgctctaggtgcatgacaattcctgtgtaacatcataaaacacatccttgttagtgcctggggatttactgttaatcatttcatttctgatttgttttaactgtatgtggtattgaggttgggggaagaaaaatgaagaaaaagattttgaggacaaaaaacaggaggtaaatgaagatttattaagaatactattccaaggatgttaaagtaagtaaaatgctataaatattcatagcatttgacattcttcaaactaaatattttattagaataatagcatttctagtattaattatttcctatttgaatataatgattcctaggctgggacatgtgctattactacccaaaatggtacttggctccaaggatatatcatacattatatattgaataaataaataaatattgcataagaaaacaaaatgcttacaattttataactggaaattaacttattgtggagttctttatttgcagttaagtataaatataatttagagattattttattaaggataaaataacataataatttaagataaaaataacactgatgaagtgattatattttaaaattaattttaggaggaacagttgaggaatctgcaaattactttgagctactttttctttttatacttgacttacctggtagtggagtgcaggttttacaactggctgttgcataataaatattcactatttcaggtttcagtttaacaacactctaagactctattaaagtttc

SEQ ID NO: 6146 - DNA, 275 bp, mus musculus
attagtaaacattagtaaagtttaacatgacatgtaaaaggaagaaaatgtcatttgtctgattgtgttttcagatgtcttattcatcttattcatctccagctatcctgtatgccatgaagtttttgactggtgacttaagcattagcaggatactgtttttctgaactcacttatatatcatggctatttcctactcctaaacaatcttcatagatatgacagcatgccaataatcaataatattcatgctggggagtaaaaattaaaaaaaa

SEQ ID NO: 6147 - DNA, 280 bp, mus musculus
actctttattccacttaatagatttatttgtaattccagatttatctaaatattttaagtttcttcctataaagaataaagggtttgatataaatatatgttataaattgtttacttaaataacatgatgttttagaaattgcttccttatattatctttttaaatcttcttttctttaaaccaacaagcacacttgactaggaagttatctttaagtatgcagggctcatgttttctaatactttgaaattgttctcatagttcttcataattttctct

SEQ ID NO: 6148 - DNA, 233 bp, mus musculus
acatgtacaactataatgccaggcttatatttttcttaattagtatctgattatcacaggaaattaaaactacatgatgaacttttcacctaaaggttgaaatttggataaaaattatatttagacatgtagataaaattctttttaatatcacatgcaagagagaattcacaattagaaaatgtttttacatggaattgttatcttgttgacatcatatactatatcatatt

SEQ ID NO: 6149 - DNA, 320 bp, mus musculus
ggtattatggcatctgtgaaaactctaatctcctctctaccctctctcaaaaacatgcctgacttcccccaaaatttttgtataagttatattgtgattagacaggataattaaattgtgctgcaattatttgtctttagcatattgtggtccattttgggggtgcatgggaggtcagcaggagaaaatcacagcaggggagttaagtatttaaaattttgagaacagttctcttccccaaaaaatcatgcatagcaaagactttcagagatatacatatgaatccatgtaaaaaagacaccagaggaaatatgtaagtt

SEQ ID NO: 6150 - DNA, 406 bp, mus musculus
ttttcatatagattataattatgaatgtttattgatgtttatattttattttctacaatactttatcttttaaattaattatatataccacgtaaagtttatctgaaagaaattggtttattttaatgttgtctgaaaaaaaattgttcttttcaatagctcttaaatcagtaatttatattacttccagcacatttcatcctaacaccacctgggaagtaaaattttctggagggttggctttcatttcattctaaatgtctgattgatgaaattaagcatgtaaacatttaaaaagctgaattaagggttcgtgaaaaaaataattattcttttactgtgtccctttagatttgttgcaagatgaagcataaagtctaaaataaacatttataactgctgaatt

SEQ ID NO: 6151 - DNA, 348 bp, mus musculus
caagtcactcctttgtgtacccagccatctgctaacaggaagctgtactctcactaactacaaaagaacttacatactttgatttattctgttgctattcaacaatcactctcatctctgtaacaataatacactaggtatataatgaacatcagcaaattaaactctctgagtcattttattcacttcattttttcattcatattgcaaagtaaatactataattaaataaaagcaattaacttgacgcctagaacactttcagttcacttgcatgagtttcttcccacgttttttttctagaattatttttatataagacgcaatataatacaaagcatattcaat

SEQ ID NO: 6152 - DNA, 568 bp, mus musculus
ttccagcctattcaaaaaagccccatactaaactctatttttctctccctctcactctttaattatctctctatcttgttctctccttatttctatttcaatctccatctctctctctctcttttgcttacaagccaaatgcaaaggatgttgtaattacaagattgaagggatcagttgagttcttgagttgctgtgcagaaaatcactttcagtaaaaatacacagaaccgttaaatgagcacaaaataaacctcacttatcttgaattacatcaatgagacttgaaggttgtttctctcttatttattagtgaggaataacttttgcttatgatatttagatggcatatgagttatactgatgagattctttgaaagtgctgtgatataggaagaatctgctatatttaggaaggaaatccttaatcagaaagtttcaagataatgtatgtgtttgtttacatgtacaagatgcagactacacggaacgaagagctgagttattttacagcactacatttcaggtgccaactttcttatctcctctttctttgttaatttttttg

SEQ ID NO: 6153 - DNA, 528 bp, mus musculus
tgaagggttaagtgttgtcagcgatcttttctttaggctaatttagatgccctcatgattttctgtatatatatgacttggagattagaaaacaatgattcagcgcatattcagattagcaactcaaatagatttgcgtacattagctgaacacctacgtctgtgaatagttttatctatctctcttcagcaatactatagtatcttcaggatggatttttgtattttagcttcccttgttgcctctgaatttatcaacgaaacaacaagttattcattaaagagagtcaatcagataatttaccaggccaaaataatttgtagatagttcatggcatatgaagtaaagttaaattctccacctgagcttatagagacttcataatctgcctacttcctcttttctcattcttatgtagtattttcgattcatactattttttttttctcaattcctggagcacaccatgctctttctatttcatgcttcacatttattttttttttcacttagttaaaatgcttttt

SEQ ID NO: 6154 - DNA, 710 bp, mus musculus
gggagcccaccaaagttgtaaactgtggggtacattgctcttttgatgttactttacatagtagaataagaaactagttagccatggagatatataatatatataatagtgtacattatatactatagtgtattaatatatatattactatattatgtaaatataaaataatatataccatacaaatattaatatatagtattatataaaatatattttatatatcagtatggctagtttcatctattatatgtatatattatctctgtttctctttatatgtaaatataaacatccctacattacacatattactacatatttattttagaaatatgtgtgtatttatttattcatacaataattatgtgtgtgtgtgtatatatatatatatatacacatacgcatacatacaaatatcttaaaaaggtaaagctttagcccatgctatttgttttaaaaactgactcacaacaagccatctcaaaactagttgcttaaagtaagtataatttattatcatagatctatggataggctgaatattaactacagtagatggatattagctggaaggtgtgttgatgttaaccatgcttgtttactctacagaaattggatgttattttttgaatgtgtttttcctcccctttctgtgtcacgtgaacttgatctgacatgtttttctcatagaagcagcagaggcataa

SEQ ID NO: 6155 - DNA, 545 bp, mus musculus
agataaggaaaaattattttaactacttttacataagtaaaataactgtactcttattaagaaagtacaatgtaaatctaaaatacaactaaagttataattttcagtcagaagattttagttgatattttgaatattcttgatatatttccctctgcagcaagaaatttgcttctccatagtgcttgcatcaaatttagtatagctataatttatatgtggatacacaataaaataattatctgcattcactgtataataaccagaatctcaaggtctaataatgagtaaaaatcagtcaagctataaagacaataaaggttttaattaaggaaacaaacaatcgtatataaagtattttaaatatctacacacatatgaagactttccctttatttaaacaaaaatgattggatgttactagtttaaaatatgcttaaaactcagtacataatgtgtatatatacacatattttatatagcaacatacccactcaaggctaaatgaagaacaaacttaaaaggaacttattattgataaaata

SEQ ID NO: 6156 - DNA, 1513 bp, mus musculus
atcaagtttgcaatatgacatgagggttctggtatgtactttgtcccttggtatcaagtttatttctctaaatagtttatgtttttaagtttggttacctgtcaaaaggggaaaagaaaattctacttgtaagtatagttataaagtagaaatcctgtagttatgtatgtaacgatcttataaaatataatcagactgttgtgattgttttatatatcagtggacatatatttctagtaacacatttatacatgtaaactttaaattttaattatttgcagttctatgtatgggtatttcactgaccctctgggtctaataataataatgcagttactaagttattcttccagttcttttccttaagggttagttgcattttctatgtgatatatatgtatatattcaatagagaatacctgagtcaccaacagtctaaatacaataaaattgtgcccacattgtaatgcaccactttcttcaagcccagtgccattgtgcacctattcaattttgacataacattttatttaaaatgtggtaaattagtatggtgtgatgtctacaataaaaacttggctatggttgcttcatataatttaaggcaagttttttaccctgttaaattttatgtttataaatatactttgctgacattatgttcatgctggaaattgagcaggaaaactacatgctacattttcagcaattgcttggactattttacataaacatatctacatatcactatatatatattactatagagatatatcactagttatctgttactatttctctaacaacactgtaggaggaattattgcttattttctgccttttgtttgctggcataatcatagaaatatagcgatggagaaggaggtatgttacatatcaagacctgcatgtcctagttttttttttaatccatgatattacccagtgttctctaaacatgctattatctctgcatcataataatgcatgttaaaataggaataagtacagcaaaaactatgatgaaaacaataaacaattaaaaatacattagtctaattgatacatgcatttgagaataatcctgcctcttaataaagatgtaccgatttatgtagttcatgcatcccacatttataaaacttctgtgtgttattaacaatatttaattgaattatttttaaaaaatgataatttcagtatatttagatagttgtgcaaatacattgtttttaatttttatgttataaaagccatttatgatggttattctctcacatagaaactttgaaagaaaaggaaaaaaatgttacttgtttgcagataatggaacaagttagatcattactttcctggaagttaatcgatgcattctcaatcataatgatatgttgtcagcatattgccaaggaaatgacacacatataatgtaaatgacaagaactatcaatgcatctcaaaatgtacagctaagtggtaaggcataaaccagtattcctcattgctacatatg

SEQ ID NO: 6157 - DNA, 221 bp, mus musculus
tgttacccagtcaagtcaatgctggtatcataattaacccaatgtctcagttatacaaaaataaacctcaaaaatatactcttaaagtataacaaacatcaatgaccttaattcttgcattgagatttaattaagagttaatgaaaattcttccaaagaatgaggcctcaagttgaacttagtgtagagacaaatctcacaatgaagttttctccaaatca

SEQ ID NO: 6158 - DNA, 311 bp, mus musculus
ggcttaaaacaacagacatctgttgtttcacagtcctggaggctaacagttcaaaatcagggtatctgtaggtctgtgcttcctctgaaacatgtagggaagaatccttccttgcctgttcctagcttcgggtgatagccatcaatcatcagcattccatggtttgtagatgcatcatttcaatctctgcctccatcttctcatggagctctccctgtgtgtctgtcttcacatgattatcttcacatggccaccagtcatattggattaggagtacatcctactgcaacatgaactaatcttaacttgtg

SEQ ID NO: 6159 - DNA, 1131 bp, mus musculus
aaagaagaaagcaaagaaggcaagaaagcaagaaagaaagaaagaaaagaaaagaaaagaaaagaaaaaggaaagaaagagtaagcttgggatttaccatacatgcagaccaactactgacaggatgaacaagatatattagagacttgaagggaggtataggccagatatcaataggtttttaggtcgagggtaagaaatttggattctgtattagttagctctcactttactaaaaaaagatatctaagattggataatttacaaagaaagtaagtttaatgggctcataattccacaggctgtacaggaagcatgaggctggcatctgcttgacttacgggaaggcctcaggaaactttcagttatagcgaaaggcaaagaagaagcaggaacatcttacatggctggagcaggaacagatgagagggggtgaggtgacacacttttagacaaccagatctcatgagaactcactcactcagtatcacaaggatagcaccaggcgatgatgctaagccattcatgagaactctgcctccatgatccagtcacctctcactaggccccacctccaacaatggggattgtaattcgacatgagatagggcagggacacagatccaaaccatatgagattcccacccaaaaatcttcatttctctgtgaaacataaaacaagttttctttctctgagggatccaaggtgtaaaggaataagagagataccctgtgaaacagtaaaaagtctagaataaattctcagggaaagaataaagctgtcagaaagagatgcaaaaggattgctaagtactattttctccagtgatagaggctgacaacaggaactgaggagggagatgtgatggagggaagctttgagattggcccaaggtagaaactgcatgcaggacttcatggtgaagaaaaaactataagcaaaattatctgaaatgatgggaattttactgtataagaaatataacaagtgcaggtggacttattagcaagtgagtaaaaatggtagcattactaaagatcagttttaggtcaggacaattttcagtgaaattttccattttcacttcagctgtaagtgagttgtgccagtagagttgtaatggttttaaa

SEQ ID NO: 6160 - DNA, 1069 bp, mus musculus
gacatcaagttagagacaaatttagattgatgcaggtagttagaaaacaatttctaacaaatagatatctacaaacttgtttgtgacatgttctctgtacgtacataataaagttgatattagatccctggccttaaattgataacacctggtcctgtttataactttccttgccattaaatgttcaaatcttttaggaaaatattttcctgagtgatttcctgatagggacccttttgtctccatttctgaaattaacactttaattttggaactaattccctattctctggagttatctaaataattgaagtcaagattacttaattaatctgaatattgtattagctatcattatactactctactatttcagctgagaaaatatagctgttgagtcaacccacaggtgtaaccttgttcttttctctctgatttatataacagctgcactttttagttcaactccacacagttcaaaggcgagtcttctatagagtccgctcttgctggaggccattacctaattggctaccctcttgtccagatctatcaattctcagacaggttcttcacaggtgaagcaaagtgtaggcatgccactattaacagagagactcaggcaaatattattgaggttatgatcaaaagataaagaaatacgcacactgttttttctgatgttattctctgacaggctagataagacaggagcagtacaagtgatttcaaacgatctctaatgttggatttttgctgctgctgttactgctattagcggtagtagcagtgacagctgaggtaccattagcatcttagtcaaagtcacatactagtaaagggaaaactctggaatttatttatcaacaaagattaattgaataccttttatggaccagaatctgtgctaagattacaatctgcaaaataatacagggactaccactgggccctccaaaccacaaccactcaaagccacaataactaatttacagatattgagtgagaaccacagttcattgcactgctaaagcccagctatagatagatgagtagtgaagtaaggtaa

SEQ ID NO: 6161 - DNA, 799 bp, mus musculus
aatcactgaacaatgacagccattaccaaaacataattatttctaaattttccatagctattttttttcattcacaaaatagactggttcatttatgctgccgaatcttatgatacttgtgcacctttatctctttgatatcattcaaattcattggatggtaaagcacttactgaactgaaatcaggatccaaggtcaaaaatatttttgaaatacaggaagaacatttatatattttttttattattgggcttcccagagccaacagcgcattgtactactttctgtgcgttgttaatttccaagaggagctacactgctatgaagtgccttccgaatatatttgaccaaagaacttttattgtttttataaaatatgtattaacatctcttgcaaaatgaggatttggcagaactctgttaaagaaataacacacaagagagtaatggttctcagtgctccacatctcagccaccccctgggctatcagcaaattggtgccagagactgcatctttgctgtcactttacaccttgcagttccttctatataaagaaaattcccttgtgactctctatcacagcctccactcattcaatcttagcacttcactctctacaatattatttgtgtgcactaatttatcatattccatgtccccctgctaggcatgtgtaagcaccatgcaggtagagatgtctattttgcacactgctgtctacccagcactagaggagggcctggcattcagtaaatatttgaaataatgaaggactcctgcagaagatgtggttaat

SEQ ID NO: 6162 - DNA, 860 bp, mus musculus
tgagtcctcaattgacctcaatggaccaatggcttggtacagaaggaatcagaggcgaggacatgttcctgctgcagtgggaagtaagacagagcaggactacggcctgccctactggaggaaattgctcctagggccttgtctccaggagttgggaaaggggaaagaaaacattgcccagtcttccaagtctctgggcaaaaagtcactgagttggaaagaagtacctcatacagatgggaattcatattttagaaggccttctgtaaccttcttatattgtttcaacgctcctaagaaaagttttgatgatgtatgttattaattccttttcataaaaagatgtctcaagaatctaaataaatcttaaattttgggggggaaatctatttttatgtaaaaatattacactgaaaacaatttatttactgatgtgtcctctttagtgacctaaaagatacactgagccagcatactttacatttgtattcagatgttgcttagttgtctagcaaaatctgtttgactactttaggtacaatattgctatttcaagtagtgggatttgtagtcagaactagttccttctgagcgtaccactcatcaaaaacaactctgtacacaaaacagaaggaaaatctttcagcacattaaaagtcatgctataaacataggcctcagaaaggaagaaaggtataaaggaatgagagaggacataagaaaagaaagacaaaaccctaaatccacttacttcttaacatttagaattcaatacaatccattacatttgatgattcaagtacgctaagatttttcagggacatattttgtcgcttagtgcaaatatacttgtaattttt

SEQ ID NO: 6163 - DNA, 436 bp, mus musculus
taatatagaaaaataattcttgaaagcctactgtgtggcagagactgtggtaggcatttgaagataattgtaagcaagatgtccttgtcctcataaagcttaaaactcttcatagaatcttggttcatgttatataactgttcacctgtttttttactgtcctgttttagagtgaaaatattagaaattacagagctacacagataacgctctagagtaaatgacatctcatccaaactactgagagtttaggtaagagtgatgggaaattaaaggctaggtaagtgatgggatagtgaataagaattgagggatccttgaagtgaccgtaagatgttggggaatatattctgagaatatacttatgacaacatagtggcctgttgagttatcagcatatttggctttattaaatttgtactgactcctttaattt

SEQ ID NO: 6164 - DNA, 872 bp, mus musculus
tttacatttcattaatataccttcatattaatttttattctttgatctagtgagttaaacaagaaattaatcctgttacagtagcaacattttgttgacttctaaagacaattatattgagcaaccagaagtaatagcttgtattttatccttcacaggtggaatttttgtgattcacttttacagagacaatctgatgaatattcctatcctgaactagtgaaaatggtttggtacaaaggtgttacatataggtaaggcacctatgttggcttctatgttggagttagagctgtttattgatgtcacagagaagatgggacgagccttatagacagactctcagaagaggacacagttctgttgggccaactgtgctcctgtgtttgatcctgagttttacaggtctcaaaactaatgttattagtgcacacaagggtcctgtgactcactcacattaaccatttttataagacttatgtggtacctccaaagccaatgagggattggtttgctagtgaatgtaacattcatatcagttatttaggatactccttccaagcattggaggatcaagttgtttgaaatagtcaaaacagaattgcttgagcatggaattagagaagttagatcacctaagggagattttagccttcattcacaaagcaaatactcattgagtggccactctgtgccagcactgttccattgaattatccataccccacaacaaaggacacccttctagtgactagaatactagtgttagccagattgagagtttcacttccatgaacaatgctagaagagcactgctaaatttttggagagcgagggggctctccttttcctatgtgaagacctattccttc

SEQ ID NO: 6165 - DNA, 924 bp, mus musculus
gaaaaggagacagagcacaagtcaaaagtctcatgctactaagtatttatggttgagtcagaggactccacattcacagaaacaaataggtttcagtatgtttttccctggaatatccttctcatccacccactttactgttactgaccacttcattacttgacaagtcttttttatgaccctactcctgggtcttttccttgtcttttctcaatattttattaatatctttgtaatatacacttctgtatctaacgaagtgacagtgtattcctcaagaaaaagaaactcattatagccacctccatgcccacagtgccgaccatattactcaataaaatatttgtcaatagaatgaaaaattaagtaaagagaacacaaacattataggtgtctattcatgtcgttttctcactttatctgtgggttattggtgttcttattgtttgtatgagctcatattaaagtgctactgttagtcggaaggatttgttgtaactatttcccagatagcagtatattaatttcccaggtagtagtatactaactctatttatgaagttttaatgtgtatttatgacttgtgagagtttatactttattacttttgttaccaaattgaatttcaaacagcaaaatgtgtagtatttgtttcctgggctattggtcctgtaaattggtaaacaaatcatagtatctagcaagttaactcttctaatcattgctctctgatcttcatggtcttccccttttggtctttcctttcttcttccctgtttttcctctgtcttgtattaataacatctgtcatcgtttcctatctctattgttggtagtcatggctaacaccatcgggtacaattagaaggtggcagtattaaatcataaaatagtattagaggaagatgtaatgaactgtagcaa

SEQ ID NO: 6166 - DNA, 794 bp, mus musculus
atattatgacgaaaaaattaggaaaaacaattcaatgggaatgttatcacttctttggctaacacatagatttaaaaagagaaacaaagaatgatgatggagaaataaatatccttattgttattacacattttctgagtaaggagtttgaacggtcagtaggttatctgtgcctgaagccagcctgctgctcatgcaggtgattagtctgagagcccagacctgtaggttagtgggaagaaagtgagtaaagcgctttgatgctgaatccagggagcccttatgtatgtatgtatgtatgtatgtatgtatgtatgtatgtatgtatatagtatggcatatgaaaaattccctttttattaattggtcagtttatgtataattcctattttcacaaattattcctagggaggcaatgcaaatatgattgctggaataggtgtctatcaaacagtagagaatttaaatagttcaggagccaaaggattttctcttggctgtctttttaaattcttcttttttaaatagcacatgcctccctgattccaatcagggataattttttatctgtaaaataatacagagattgtcatatggctgtggattcaggagaagtcagttactaagtcatccaggaacatttgtgactctctacatcctccatactttgtacctgaaattactccttaggaaattatggccccacatctcaattactgtggtgaataattttgaatcccaggacattccactgaagtttgctacaatctacgtaataaaatacattattatat

SEQ ID NO: 6167 - DNA, 988 bp, mus musculus
cagccttatcttaggtgagaccgtttcggcttggaaacaaacaaagctctctctcgatgaactgggttcatttcatatttgtgtaataccctggaagaaattaggtttcaataaagtccatttttgtcactgcatgtagcaatgaatatcacacccagcagggcacagtggcacctggctgtccagaccccagtgtagcacaaaccatctgggggtaattacaacaaggtattctttaaggaccagatgggagcaaggaacagaagcccctacccctcccagtcatttacaacataattcctttcaatgatatacttaatcctcccaccagctatgcctttcagcttgctgttgtcactgttcctttatgtaaattcagacgcaagaccgggaaaaagagggggtgagacagaaagtacaagaaaaaaagggaaagggtgagagagagcgccactggtgcctctagggaccaaaagaaattattcatccctaaattgttttcaccacagcgagtacagtaacaaatttttttaaaaaaaagaggactgaaattatcctaaagaaggtcaatgcgacagccctgtgtggcaccagctgaggtttactcagccacctgttagctagaaagctctctgcacacgcttatgatgcatttaaccagtttaaagggtctttattgacaggccagccacctccattcagcaggctggagccataggcctgctttgtggtcatatgtggcacacaagccttaattcaattacgctgtaagcctatccaatctgcatcactgccctttcacttttgtgccatttgtcttgcatattgtaaagaattttattttgaagagggaaaggcaccctacaacccagttgtctttatttttcatgtaaggttgtgccgcaggtgcgccgccacctttcaactcccgaaatgcattcatctttaagcgatattttagagggaagcagtatttattgtttggtga

SEQ ID NO: 6168 - DNA, 1372 bp, mus musculus
atcaatgacattaaattccttagcatatataaattttaattttcaaaaaaactcatttaacttttaaaaaaatcatttaattaaaaaaattggtgagctgcagtctgtttatggttttatgttaaactatatagtaagcctaagtaggagggctatatagagaacctgaaacaaagtttgttcaatgccattcaagtgacaaccacaaagctaatgatagtttaaacaatggctacacaccaccatattgctggagattattacaaggcttattaagaaaaggaagacataggtgaacacttagtagttaagctgagcaggtagaaaccttttttctttaaaggtttttttcttcaaatttttttaagttgagaactatctcagtgctgtaggatatctcacatttattaaagctggagggaacaaccaactctatttctaagaaatggccactttaaattattcaacaacatttagctcaaaaaatttcagttatgatgaattttatacattccgctttcactcccccacgtctccccaatcttctagtttgaacagaaaaacaaaggacagcagggtccctttcgcctcaggcaacagtctgttgatggatattgtagcagctgaattgctccccattcacattctaaaccctttctcctaattgtcgtctgtatcatcaatgtcactaactgagaccactgccacaattctacagccctttggagcaatattgccttggctttttctcctggggcttgcttcttgcttggtgcaatctgtgaagccacttagcacaggatcttgttgacttataacaggtaccagatgatgcatccagacctctagcctagttttatgctctcatggcttgtgtgcctgccactagtgtgtgtgtgtgtgtgtgcgcacagatgtcagaggatagatgatgcttctgctgccattttcatgcaagagcttcaggttggtgggaagaaattcaatagtacatgagaaaatctgatgtctaagagaaatcgtgttcttgtgtttgatggctttgtgtactcttttttaaacccagcccagaattctcacgaagcatatttatactgctatatcactgtgatgctttaggaaataaaatgtaattgcctccctctttccactgatttccttgatctttaaatactctaccttgtcctcacagttcataaaaataagtttaaggaaaaattattcacatgaataagttatatataaggatttggaaagaaagtactcccaagtggctattttttataataacaatttttattaatagcaatagtgttatcttggtgagaaaataaaatttattttcccataaatttatacagaagatttcttc

SEQ ID NO: 6169 - DNA, 208 bp, mus musculus
gtaatcccaagttttccagaaatattttataacaaagtcacggtgactatgaaatctcaatcactgccagattattcgtttatctatctatctgttcattttttcaaatgtgtttggttagagcataacaacttttttatatttgtctctgtagttcaagaaagaaagggacttaaatagtagtagcattgcttactgcacatcacca

SEQ ID NO: 6170 - DNA, 994 bp, mus musculus
tcagaacattttaacagagaatcagttcctatggtggagcacttattaatattagttcataaaagtaaaaggaattgtctttattctcagataatccatctgctcttttgctttatttgaggctacagacattcatttaataacgtaaactagtgtgcctccccaagttttattttagtaagctagggattttctaaaactctgatttttttccactgtcaaaacacaaaattctcatcaggatgtatttaaaggatattttcatttcataacaacaaaacaaacaaacaaaaaatcccaaaacaacaagctatcttctttggagtttcaaatggcacaacaaagttatttttcatcctttccaacttctatgttcatttaaattcaattatccaaccacttcactctagatggagaaactgggcagttaggggaaactcttgttttaggatgagctattttttctacgtcaggaacagactgaaagctttttatgcttcatgaacattctgcactccttgaaagaaagaagtatctgtgcagagtatcaggctgaaggatgcttctctcacatacacctgctccgttttttgatgcactggcccacaaatcacctcttcatctttgtcaacctcaaagcctctattcttctccagtgacctgaggctgatgcaacaaaagaaggcaattcttaagaaatgtcagaggccttttgctaccaaaaataacaccctgctaaaacttgatagctaggaaactaaaaggtaatgtttgtgctggtttttatggagggcatcttaaaaataagacaactgaagcattgttaattccaattcctgttaatccaaggaatggggctataggtaccatgttctacgaaaaaggcagaagacggtataattatggagattatggcagcagaatccccgactcagaacaccagcattgcctcactagctgccattcaccccttcagcacccctggttcctgttt

SEQ ID NO: 6171 - DNA, 521 bp, mus musculus
gaaataaaagtcaacatgaaggtggtctctcaaggcagttaaggagttaagattagatcagaattccttactcacttaccctaagtgtgtccttccacaaattacttgatctctttagacccaattattagcatttacctcctggagttgttttttaagtgattaaatagtaatatgtatgtattttattgttattcctggaccactgttagtcctcaataaaaggaaagagcagctgcagcagtggaatacagaggggttagaagccctattgctattgattaagaagaaagtcggaggttaatatgtggatgccgcaggcctagaccacactttaatagatccagaaagctaggaaggcagattgtgcgggtaacagtttggggaggagttcttttctggtaagtgtcccagaggaagtatgggcatgaggggataacagagaaagtacaggaagagggaacaaataggaagaaagctggaaaggatgtgtaagcatcaatctatgtcttctgattgtt

SEQ ID NO: 6172 - DNA, 1065 bp, mus musculus
taatcatcaaaataaatgaaagcgtgtataggtcacttctgttttctgtataagtttctcagaacatgctctgtatacactggttattcaataaatgtcagtcagtcagcagcatttatggagtgctgctctacttgaaatgctcataaaggaaagtgaaagtccccaggggaatagacagttttcagattgtttttctcttgtgtttctggttcaggatctacacagctcagttgtcagcacagatggaaaagtggctgtccttttcctatggagctgttgttcacaagtcaagcaatattccatcaatacatcactacagatgtaccacttgttaaaatattgacgtactggcctatccatttgaatgccacctgtttcctccccgctgggacctcttgggctgctccacaatttcacaaccaaagcagtaattcctggcttggtagagagcctctagaactgcactacagcactgccaccaacgttcattctggttggttagtgtccatgacatactccatctttaatatcttaaatgttcctcttgtactaaacattatctacacagaaagttaggggacattcaagaatgatgcctcaaagctgatacagtcattgtcatttaaaaaataagaagacattcaaagactaaatgaactggtacagtgatccttttacggtgaactattggattcttctcctggtcctagggcagagaccaggcctgaatcttgtttgtatcctcgttactaaacacaggcaagggaacagtgaatgttaattgaactaaacggaactgaatgtagacttcagacttaaaggagagaatggaagctgagatggccataccagaaacacaaactaaggcataccagaagacagtcttttcattaccaagtggctgccagctgagggtcagtaattaactgacaaaacacatggtgctacactacaagttaagtaaaacaggaagtagtttgatgagcagatattgatggatataccttgtcactaaggtacatattgctttcaaggtgtacattaactttcagtgcatagctc

SEQ ID NO: 6173 - DNA, 488 bp, mus musculus
aaaaaacaaaacaaaaaatgtataagaaaggaacaaaaggaagaggagagaaagggaggaaggagcccctaattccattagttggaagaaactgttgtaagagaggaaaggaggaaaaggagtgcatttcaaggccaagcaggataccgcggtagagctctaagagagtctgctcatttctctacatctcatggatttgggagagcctccccaagcaggttcctcctgcctttggggagagcctcagagaagcaggttggccaagatgtaagagtttttgaattttgcttttcaactgctagataacagccacatgaatgaaggagtttaccaacttaatcatgctaatcccctccacccagagtggaattaagtgtcttctttccaagagagataggagtcctccaatcctcccagtgctcagatccttgtctgcaattgatcatcgccaagtctgatatgcaaaaaacaaacacaaaaaattaaag

SEQ ID NO: 6174 - DNA, 438 bp, mus musculus
ggtacacttacacagtggcatgccagatattcctattaccactgaaatttaatgcttatcttgtttccctcttagattctctgagtttttgtttaaaaaaaaaaagttaacccaaacatattgagacctacatctcctggcaggaatttctacaaatatagagtgaaggacttttagattcaaatcattttagctacctaccttagaccctgtggtgttctaggaaggcttatttttatagtgaagaggctcaagaaaagataataaggagacttagcagcctaaaacaatctcatgtcaactacaagatgaccatggaacagcctatacacactgccgataagttggctcagcccccttcaatccaactcatcctttagatcaccaagaatgcacctttgccagaagtgaaaaaggaacaacagccaacatgtacct

SEQ ID NO: 6175 - DNA, 273 bp, mus musculus
ctttccctggctaatttgatcctagcagttctaaaatttttggtctcagaactcctttaaactataaaaattattgaggaccccaaagagttcttatgagtagaggcattatctataaattgttactgtatttggaattaagctaagaaatcttgaaaataattcttcattgattgactttaaaatacaatacataaataatgacaatacctaaataacattttatggaaatgactattgacaagacaaaacatattagtgagaagagtggca

SEQ ID NO: 6176 - DNA, 2288 bp, mus musculus
gtaagtatatacaataactctgaatcctgtcccacatcccaattctgactcttttttcattactgtcttgaactcacagagctgccagctaccagaactcagtagaatccttcccagaggtcagtgctccatggagagcagagtccctgaccagagatcatcttggctctgtttggaatttgttgctgtagaaatagcagagatatcaacaaactcatgttcctggggctggacaggctgatgagcccatctgcagggcaggaatagccagaagagaaaattgagcaagaatctaatgatgacctagaggagaaccaggaaacagaggacctgaaaacaacatgaatttggaacgtgaaaagcaaatccagttactcaatacagtaggagagcctacgtgagacttggtgaagagcagtcaggcttcccaagaaaagactatgctcatgcctcagagaagtcagacctctgctgcatctgctcacatgggaccttcctcatgtcctggtaatcacaggagctttaataaacatatgggagtctgtagggagttacttgtgccttctaagtttttcctatcctggcacaagagggggagaaaataatccaaccaaagagaagtaaagagtaataactatactcttcttacagcccctaaacagatttgctgaaactttgagctcctagtgcctatctcctttccctcagaaagcccctaaggcacctcccattctctccttcaccaccaaaaaacaaaggattagagtccataatggactcaattctaaagtattattttctatgtatcacaattatcagaaaattgaggagcaagcacaatttatccttctggtgatatgtgattttctttcttaaaacaaaacaaaacaaaacaaaacaaaaaaacaaactttgtcagttctaggacaaaggaagagtaattaaacttagactttcttaagaatacatgtaaccactaaaagaatagaaatggaatgtataattaaaagctagtagctgggagcggtggctcatgcttactagcactttgggaggccaaggcaggtgaatagcctgagctcaggagtttgagaccagcctagacaacatggcaaagccctgtctctactaaaagcacaaaaaattagccaggcatggtggcatacgcctgtaatcccagctactcaggaggatgaggcatgataattgtttgaaccctggaggcggaggttgcagtgacccgagatcatgccactgcactccagcctggacagcaaagtgtgactctgtctcaaaaaaaaaaaaaaaaaaaaaaaaaaaaaaaaaaaaaaaaaaaaaaaaagctggtagaggagaaaattatgacagagaaagcttgatcaatttagtaaagcaggaaaggagaaaaaagcaaagaaaataaatgatgcaaaataaggttaaaataatacagtaattgtattgaacatgaatgaattgaatctaccagttaaaggacaataattgtaaaattaggttttgataaatttggacatatatcacttataaaatacacacctaaatgataaaaaccaaaagtagataaagaaataaaagacatgccagacaattactaaggaatactaatatcaaccaaagtattgccagagataaagattgattattgcaagaaaaaaatggacaagtcttcctaaaaatgagggattttttctttttttttgatggagtctcgctctgtcgcccaggctggagtgcagtggtgcgatcttggctcactgcaacctccacctcccaggtttaagctattctcctgcctcagcctccctagtatctgggattacaggtactcaccaccatgcccggctaatttttgtagttttagtagagatggggtttcaccatgttggccaggctggtcacgaactcctgacctcaagtgatcgacctgcctcggcctcccaaagtgctgggaatataggcatgagccacttcacctgactaaaaatgagaggttttaaacatttctcagaaacaatggatttaacagaaaaagaattattaaagttacagaagacttaagaaatccaattaatgaactttatcttatgaatgtaatgcacctaacaattagataatacacaatatatttcaagtatatatcaaacagattctgagtacagtcttccttatcttgctaactgttcccaattgttgatattcctctaagctggtttacaatgaagtgaaatggtaggatatataatgactacagcttcagaatttcaata

SEQ ID NO: 6177 - DNA, 548 bp, mus musculus
ccctgggagcacaatgcccatgtcgtagcaggataggaagcagaagatgaaggacaaaaatctcaggtttctcctatgaaatactagatactagaaagcactggaaaaaatatactcagcagtgttctgaaaatgtgatcaggacctcctgcttcagaatcacctgcagtgctcagcaaaatcaagtgttcagcgcttagcccacatctccagaatcagaatctctaaggcactggactaagagtttgcattgctaatgagctcccagaatgttatatgtaccctgaagtttgagaaccacaggggtacaaagtgtgatgaggaatttttaaaaaattacttcacaaattttatgtataatacataaacagcttaaggaattttcagaaaatgaacacccatgtacataaagaaggaatgaatttttacccaagtattttgtcttaagaaaactagtttgtgtgtgaaaacccttttcagatatgtgtcattttttgaagaaatacaagaaagcatgaaggaatgaaatttaaaactaaattcaaatt

SEQ ID NO: 6178 - DNA, 1004 bp, mus musculus
acagaaatcacaggcttttaaacatggcccgaaataataatgaccctggaagattaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcaggtaatatttttcaaaagagtttactaaaaatctgtattataaatactggagtttggggagtggagctaactttcaacatctgtataataaaaacttggttttagtaattctggaaatgctatttctctctgagtgcactcagtaatcatgcagccatattataattggcatgtataacccagtctctatgcttcatgcatgtttagaaaaaacctcttttgtgcaatttttcgcaattctaatattttagagggatattaatctctaattaacactggattgttttttact

SEQ ID NO: 6179 - DNA, 1004 bp, mus musculus; identical to SEQ ID NO: 6178

SEQ ID NO: 6180 - DNA, 1275 bp, mus musculus
accaataccacttataaatatatcgactgggcgcagtggctcacgcctggaatcccagcactttgggaggctgaggctggcggatcaggatgtcaggagatcgagaccatcctggctaacacggtgaaaccccatctctactaaaaaaaaatacagaaaaatcagctgggcatggtggcacgcatctgtaatcccagctactcaggaggctgaggcaggagaatcacttgaacccgggaggtggaggttgcagtgagctgagatcgtgccactgcactccagcatgggcgacaagagcaagactcagtctcaaaaaaaaaaaaatcttctttgacattggttgttattaactactgttgactgtttaaatttgagtgccttaaactggaagtgtgatataatacaaagaatttagactttagaaccagacagccttgtgtgaatctgggctctattgttttatacctatctgaccagtgagttcagcttctttatttgtgaattggtggctgtattagttatcaattgctgtgtaacaaattaccacaaacttagtgagttaaaacaatacacatttattatcacacagtttctctgggtcaggaatctaggggttatgtcctcagctttagggtatctcatgagccacaaagtgttggcaaggactagggtctttacagaaggcttgactggggaaaaacctgtttctaagctcacctattactgaacaggatttagtttcttgcatgctgttggactgagggccttagttccttgttagttatatcagaggctgctctcagtttcttcaatgtgggcctcaacaaatgacagcttgcttgcttcatctaaaccaattagggaaagatgtggctagcagatggaagtcagaatcttttgtatgtaataacgaaagtgacatcccctcagtgttgaggtattctattggttagaatcaaattaagaggaggggagcaagggaatggatatgaggaagccagattattgggctcatcagagtctacactgccacaggggcagagtatatttacttcacaagatggttttggagattaaaagaagcaatatgtattaaagttttttatttttggtctgatcttaaactacctttctggttattacctgttagtttttttgcacaggaacaaaatttgctattgctattattactaatattgtttactatttcccatttttttctggttatctagactttgtggaatgcatttcttctatttgtaatgattacctcca

SEQ ID NO: 6181 - DNA, 1215 bp, mus musculus
atatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtcc

SEQ ID NO: 6182 - DNA, 812 bp, mus musculus
gcaattatcaaccttggctgctatgtcagttattgctgaatagcaagtttccccacagcttggtggcttcattcaccatttgttacctcacaggttttgtgggtcaagaatctaagtacagcttagattgtggatcctctagctgtgggtctctcgcaaggctgcaatcactgaagactctccacttcccagttcactcacatgattgttggcagaatttagtttctcatgggttgttggtctgaggtctcagttcctactgaccttttggctggagacccccccttagttccttaccgtacggcctctccatagagtaccttgcatcatgggggcctgcttcaagggccagaagcaagagggcaggagaccaacagtaccagtcacatgaccgctgtagactttagtagtggaattatagaagtggtatcccatcacttttgctgttttctgtttgttagaagcaagtcactaggtccagcccacactcaaagaggggattacacaagagcaagaaaaaccagagtcagggactatcggggttctgcctaccactactgcacattagaatcacatgggcatgggggaggagcacttaaacacccatgcccaccctgcaccccagaccatttaaattagtttttatccatgaataaggtataacttagatatagtaacaaaagtacacagttgtttaattaccacaacaatcataatatagattatttcaataacccagataattcccttgtacccttttatagtcaatccacttccctactccagcccctggtaaccactaatctactttc

SEQ ID NO: 6183 - DNA, 227 bp, mus musculus
aacaatggacaaaagatctgaagggacacttcaccaaaggaaatatataaagacaaataagtacatgaaatatattcaacatcgtttgtcattaagaaaatgcaaattaaaaacccaaggagatgccactgtacacctattagaataactaaaatgaaaatgactgaccgtatcaagtgtttgtgaaggatgtgaagcaactggaatcctcatatactactggtgag

SEQ ID NO: 6184 - DNA, 1114 bp, mus musculus
taatccataatcacatttttgatgagtcataagcaaagacctcttgaatgaatgcttactttacttattgccaggtactgagctgagtgctctggctacaaagataaatacagtgtagtgatgagtgggcagaaaatcatcagatgcctccacatggtgtgatgatttctatgtggaaattatagacacacaggatgtgaggaaatatgtgcaagaaagtaatggactctggttgagggagtgaaaaaagaaggcacagagatggtaatggctcagctgtgcctcttcaggtgagtttgccatgtgagaaatggaagaaaggcaggcaaaaaaagaacaagccaagagtcccagcggagacttggccaagtgtcctgggctgctggaacattcccctttgaaggtacaagccatctagtaggatgttcagaggtaaaatggactgagaaaaatgtgaattaatggctctccctcttctatggttcttccaggggtaaaagctgacttggcagaagctgtctgatactgtgggtcatcctgaccttgagactgcgcaacgtgccctggcagattcagagtgtgtcctgctagaacccatgtgctggactcatttccagtgagtaatgggctgaggtcaaaggctgttctcgcaggagcctttcagggttatgtttatatccaaccccattctttgtgctaacagaaaactagaatatgtaggaactggaaatccccatgccacactctagtcagtactttcactgccttccccactgaacaattagtaaatacttctactattttgttctgattgctgggaattttatccccttctccctcctccaggagagaatgagtgaaaattagcaagtaagatgactacattcattgcctgaatgctagaaagtgccgcatgcccccagattacatttgtggagtgaaggctttgatctctgcttcctacatgtgtctgcgaggattggtactatggtactaacttatttcttccctttcattttatcctgactgactgagacacatggactttgactttccaaaacctaaattctaacttgtcttaagagtcaaaataagccatggtctaccattctat

SEQ ID NO: 6185 - DNA, 289 bp, mus musculus
tcaggaggaatatcaagtagtacaagtttagtagtgcattgtaaaaacagtattttcagaaattatttcatggcttattcatttatctggcaaacacatattgagtacctaccagattctaagaccttcattgtatattgaagatagaaaacagattatgtgatagtcattaccctcatgaagtttacaatctaattataccattaaaaattagcatttaaatattattaaataagataatcatagtgcttttttaaacggtaaaacatagtttttaagtaatttttaa

SEQ ID NO: 6186 - DNA, 328 bp, mus musculus
ttattattaatgtggctgtagtcattattattgctgctgctgttattatgggtgtggctatgtgctggaccaaaattaatacagtcaacatgtaaaggagcactgagggccatggttccacagtacaaccagccatgagatctacgtcgttccccaaagcatgagaaggcacggcagacttgggaccagaagagacgaatcagcaccccagctctgtcacctccctaaggtactttacctggatctcaacttcttgactggcaaatgggaataataaagcctgctatataggggcttttgtgaggattgaatgagctcctgtttgtgg

SEQ ID NO: 6187 - DNA, 1362 bp, mus musculus
atatctgcttttttagcaggaggcttacacttgcagcatgctgttatgtaaatctttatcacaatcatcagcatttattgaggacctctgttctacggcaaatgtcaccaaacagtaccaagaatgaatgtgaaggaggccacattttgcagattccgttcataactctggcaatctcagaccacacacagactgccagtgcctggtcacaccattgtcctgccgtcacccactccccttggaaggaattgccttgatatgtggaggctggcaccctgctcagttggctgcagggagccttgtagcacttagagggatgggcatgtgggctagattcctttggataaagtgataggcacatcacactctggtgtgcaggctctgacatgccacagattagcaggcatgcctctggtaagaggcatgtgactggccttttggtccatgctatgaaacccttgaattctccctgacattctgtacagccatttccacccagttagggcctatttttttttaatgcttcaagtgcaaaaaatgaaaatgcataacagtggctatggctcactgacttttgaatgcgatgtttccatttttctattagacaaagcttagagagagaaattgcagagactgagtactgtgatcaaatgaacaatttcaatgtgcttaacatagaagatactagagcataggggtttttaaaaatgggctttggtgtcaagcagacatggacttgattcccatctctaccacactcactggccatttgacccagggcaagcttatttttcataagattagaataaatacttattttatagggttgataacagaattaaatgatttaacatatgtatgctacttaggagaatacctggtatctggtaagcactaaaaaactagaattagttaccaccatcattgataatccctttattgagttataaagccaaagagtctcccaaatgtttccgtggcaaattcatcctaaatactgactgatataatcaagaatagcaaaatgaacggtagggtgccagatgcctatggcttgtcctgttcacctctgaactcatctgcaaacagggaccactttaccaatagccaattagaccacagaggtgataaacttgaggcccaactgtcactcaattcccctcagtatgacccaaccaatactacatatcatcacatgcctcctctctgctaaagatataatgcagatttccaataggattgttgcagagacctccagactcaatggttcagataaatattctgagagaagaggcagaacaaattgcctttgcaacattttcagtttaaagctatattttcatgtgtgacctagggtctctc

SEQ ID NO: 6188 - DNA, 1423 bp, mus musculus
gttctaatctaaattttaaccagtagttttttaatgtggcctgcttttatacactctagctaatactagttttattatttggaattgttttcttttccttttaatacttcttcccatgtattttattattttattttattttatttgtttttttgagacaaggtctcactctgtcacgcaggctggagtgcagtggtatgatctcagctcactgcaacctccacttcctgggctcaagcgatcctcccacctcagccccccaagtagccatgtattttaaaatcaaaaggggaaggacttttgcttccttccatgaaggagtagtaattgcatggtctttgcacaccctcctccaaaacccataaacaactagaaaactaaatgaaatatataaaatgtctgttttccagcattagacaagaggcagtgtaggtctatgatccctgaaagcatgacttgcagcctggaaacaatttcctaacctcagggcaggaaagggggcccatgcagagcttggcagtttctctgaattgaggagagataggagctcagaaaggctgaggcagctggaaattacagggcagcattccagagaaggaggagctacacaaaggaagaatgccagaaacctgcataagagtcccattgagtggctgaatccaaaactgcacatgtgtaagtgaactccacaaatccaggcaaagaacaactgccggggttttctatcggaacaattctctgagctcattcagggctgaatgacattcaacgttttattccttggagtggaaagactccatttgaatatctaggtattcaataaagactacagaaaagccaagccttagtagtaggaataaactaacactacaataaggctactctagacctatcctaacaaagcttaacaataaggctcaaaaggataaaactgatatgcaagtaacggcctgccaaagcaaatatcaacactctaaaagacgataacaaaatccaaatagtcaataatataacattcctaacatctaacatccaataaaaaattgttagatatgccaagaagtagcaaaatgtgacccttaatcatgagaaaaataagcgaatggaaataaacccaaaagtggctaagaagtacaattagcagacaagaactttaaaagaactactatcaaaacccagcaatttaagagaaagcaaggacataaataaagaagttgaatatatgaaaaggagccacacaaatgttctagagttcaaaaataacatatctgaagtgaaaaaagattcacttaatggtcttaacagcagataagacactgtagaaaaaaggccagcaaacttgaagatatagcaatagaaactatcctaaatcaagcacagagagcaaaaaggctggaaaaaaatgaatgaaactttagtaagc

SEQ ID NO: 6189 - DNA, 1514 bp, mus musculus
aaaaaagtacctgtgaggtaagggatacgttaatttgcttaactgcagtaatcacttcactatgtatatgtgtatcaaagcatcatgttgtacaacttcaagttatacaattttaaaaatgtgtaaatgcaatagtaccaggagccactaaatgattcatattctaatcctctaattctagtattatttctgaacatttatattttatattaatataatcttttttttttttgagacagagtttcactcttactgcccaggctagagtgcaatggcgtgatctcggctaactgcaacctctgcctcccaggttcaagcaattctcctgcctcagcctcccaagtagctggagttacaggcatgtgccaccatgcctggctaatttttgtatttttagtaaacatggggtttcaccatgttggccaggctggtctcaaactcctgacctcaggtgatccacctgcctcagcctcccaaagtgctgggattacaggtgtgagccaccatgcctggcccaatatagtcttataatatgcacacagccttgcagtgcttagcccctctgtgaataggcccagcatatcctcttcatcttctccccctctgccaagtcccctccacaggccacaacactggtcaccctccaaacacagacccagagtgagctgagcacaatggccatgagatgatcctccctccatgccctcccatctgtcaagtgaggacaggggagggctgatgcctaaaaccagaccagtcagactccaactcagccctgtccctgtcctttgtcatctggcagcattctgtcacaaggcattgcaagtggacattagtttacttaaggttcagcatggaaggccacctggccaccaaaagctggcaaagaaatgaggactcctggcaggttataagcagcctgcagcaactcctgaggacctgaaagaggctgcagaataaacttgggcttccctctttacaacgtgatgtgggatgcacagtgcttctgtcatagagtcaggcaaactttatgtgtggctgttaaagtagggagcaaaccttgtgctctaatctgtctgatagattagccaggaaaatatcactgaaaacattccatggaatttgttttaaggttcccagtcagcacaagctattaaaaggaaacaaagtcatagcttgctcctcagtaagtcttatctttctgttgtctgaggatttcccatgatattaggataaggtttgtataatgtttgcttcaggtgacttagtcatcattagaggtggagaagagggaaaaactcagtgggttatttctgcctaaatgccccctcaaagccgccaactgcttgacctggcttaactcgaacaactagaacagtggttttctttttcttttttagaatgggtggctctccaaacttgaaatggggagaggggcctgaagatgcagtggtatgactgaagctaccaaaactgtcacccaataccatcctcctctgtttcaacacaaaaga

SEQ ID NO: 6190 - DNA, 1349 bp, mus musculus
aaatgaggagagtaagaaaacaataactctgaaggattactgtatgtaaggttattggcaaggtgcctgtctcacagtaagctcttgataggtagtggctatttttggtggccagtctccgaggtgggcccagtgactctgacctcctggtattcatgcccttgtatatagtcccctcctacactgaataggactgatctatgtgaccaataagatattggagaattgcctgagtgtgacttctgagactaggttgcaaaaattactgaggcttctgtcttgctctcttttggatcacttgatctggggagagccagacaccagacaccatgttgtgaggacacttcagcagccctatggagaagtccagatggtgaggagctgggcttcttgccagcatgaggtgatcatccaagtgagccatcttgtagactgattctccagccccagtcaagctttcagatgactgcagtcctggcgatttcttgactgcaacttcaagagagccagttaagccactcctgaaatcttgacttatagggactatatgagataaatgtttattgtggatttaagctgcaaaatttggggggtaacttgttacggagaaatacgtaattaatacatgcttattgtaaatggctgtacaaatatcaatggagtcacctcctacatggtcagttccggttcttgactgatctctgttcacaggggctacagggcaagatgactggtttaaccaaatcaggacttccccttccccagatatgaagaggtaactaaagaggacattctcagcaacttagtattttcagatcctcacctgacctgaggaaggtgagaatgtctgtcatcttggtgctatctgccacatcagacaaactttcagagaatatcacaggacaccaagtcagataatctcctcttacttgtgtcctgtatgtaggtcatctcttaacatagagggacaagtcttgccccaagagctaatcttggggtcccttctctgttcctcacccccagcagctggcaaactgtccacatgaatccctggcatgaatccaccttcccaagcctttcacatcacaaaactgatgaaaatggtaacatttttaaagtagccaatatttgacaaagttttgagagaaacccttggtttttcaggctacacatgccttggcgatattcacagcttgggtgatgggcacagagacatttggcttcaagttctcacacagttgtgttactgtaactccaaacccccagtcccgtgcattccccagcgatccttgctatctccctagagttttggccgctgcttctggggtgttccatttctcaacaattgc

SEQ ID NO: 6191 - DNA, 719 bp, mus musculus
atacatcttaataaattatctcaattgagaataaaagagtcatctatcttacatattgcttttcttgagaaagttggaattagaccaattctgtcatccttttcccctcttaggtcaccattttcaaatgaatgtggtgtgcaggtgctctgtctggatgctgagcttggaaccccaccctgtaggccaaattcattcatgctagtaagagagagcaaaagtgaggaaagtacttacaattctcaaacatgaatcattcaagaatacagaaccagccatttattatccatacatggacccagcattcttctacgctaaactccccaaatcatcatttgagaggtctatctactctttcaagacgagctcaacactcatctcccatagccaactaatgaaattattgccttcattaataaaaattagtccagaatccccagcattggccctaaaaatatatctcagtgagaaaggaaaactggtgtaagcctcagaggatgcctcaccctgagtgtctctgtggcctctctcactacatagtgcagccccagctccactggcctctgaggttggggagggaaggagaattctcctcccttaacattcttgtccaatcacagacacaaaatcactgtttgcattcctcctgccacagccaaggaagggctgaaattgtcctgttctagtaaggcttggggacaacaaaagcacccccagag

SEQ ID NO: 6192 - DNA, 340 bp, mus musculus
gcttccaggtagcgacatggcataatgcatgtggatcgcattcctgtgcacgcaattggtatcacaaggctcttactccaacaggaagggctttactatctgaagaggaaaatgtatacgaaagacagaataaaccttcgaagtttactttaatcaaagaatagtcacacaattctctttgcaaaatgcacctcttttcttaaatggttgtatttcctgtttaaatgcacgcctagaaacatttcaatcatgctatggttctttttcatatctttagtgttatttttattataaaaccaacatacacatacggtaaaagtttctagacaataaacaatgt

SEQ ID NO: 6193 - DNA, 1362 bp, mus musculus
gtttgtcctccataaatagccatcattacatacaggattctccaactagcaaggtggggagatgatccaggatgggcaggggagagagagagaagcagcaccagtcctgaaggtcagaaccagacctcaaaacatccccactagtccacggctcagaggagaaaagaagactggatatataaagggaagggaagcagaaaagagagaatggatgaaggagtgggcatgggcagacccactccaatatttgcagaaccaggggcaaaatgataaatggagacccatgtaccacgtatctaaacatttaaaatgtataaatcagtgaacatcaagtgaacagactattaagtaaattatgtaatattttcttatcttgacaaatatatcttcatagcaaactggaagagcaggcttggtcaatttagaattcctggactcctgagagttacagaatgcaataatgcaaggagggtggtcacctagctcagtctctggcccacgacctgctctcattctctttccactctggctctgtccccataccatgaagggcttcattgaaatgcataaatacacgagcccatacattcaagctccatccacacctcttgcaaacagcttctcttggtgacccctcagacctaggaggagtaccttagcaccagaggctggtataggggaagatatccatgtgggctctggaaataggatcatgccttttggatacagaattctagggtcccagtttcttggagcatggtcttgcaggggagcagactctagatagtcacaattccttggcctgtggattcttcaacccacgggaagggtaagaaaaacaggagcagattctctgaagcatgggtccaggacaaggaccatcttgcccaggtctaaggatagaccagatagaaaagaggaggaaacatcaaagacataagagagaggaaaggaaataacaggtgaaaaagaccttagaagaaattcttcataaagtggcttttactgttacctatgtacgttgagggacctgatgtttctctgggcatcgagggaatgggaacgattcttcctctgaattagccttatccccgaatggtggggagaagtgaatgttcgtgcctgcttcatgttttattcttctgcataaattacagtgcagagactagagacatctaattttcctgttataataaccatagatctattataactttcttgctacacattaaagggaaggaaaagagggagggagagaggatggaagttagtcagtcaatgatcagagaccagaagtttctctggttgaaacaaaagaatatttcatgagacaaacaactgaaaagcaagtttacacagaaa

SEQ ID NO: 6194 - DNA, 1282 bp, mus musculus
tctctatccaaggaagttatagtctagtaatggagaaatcacaaatgagtagattaccagtctagataccaagtgtcagtagccataagacaagtgtaaataaagagacttcgagcagggagaacatgttacagggtaaggccctgactaaagcagtggagagaaggaatggatttcagagctactccagaggtagagtcagcaaggatttgctcattgattagcttcgagtggggaggaggggaccaattaatgaaagaatggcagttcattaaattaggtaaggcagaatatagattttagcaggatggagaaagatgaaaatgtttagtttgagaccctctcattttgaggtccttggggacaatcaaagaggagtgccaatgggctattccccatttgagctgaaatgcccagagatttggaagtcatcttgtttaagacaacactgccaatgaccttaatgagggagagaatggtttcccgctgaatactatttatggggctggtggtggaggaggaatcattaaggaggtagaggagaagccagagaaaggagcagccaggagaaaggggaggtctggaacttgctggaagaaggaagggatgtatagctttcaggcgccgcagtcttgcagtagaggctggcaattaagagttattggctgctgcagacatctcttaagatgaacacagtgagcacaataaacacaatgagccagactagtaagtttttaagacttcttattgaatgaagtgaaaatgtgtcctgctgatttccagcccctggtcacaaggcaggcttttccaggacatcaggcattctcccttcccatttgctgtgactcagagtggattctgtggaagtgagccctctgacttagcttctgttcagtggttgttgaggggggcaggtatggttctaagattacccctaggcaggaaagatgtgcagccattttcagctcagccctaccccgactctagtccattagggcagaacaagcagcgtgctggcacctcttcccttgcatcagaggggctggcctcccactcactggcttatttcctcctaagacccatccagtgaagcagagaaaatgatcattattggttcaactgctttattgctgagggttacaaagatgagtgatatttaggaactaaaatattatcacagccaggtgttgactaatacaaaatagatgcaaagcaacatattctaaccccaaatgtacttttataactaaacctgagctaattaatagtgaaacatcctgtg

SEQ ID NO: 6195 - DNA, 249 bp, mus musculus
ttcagcttgaaaccacatctactgtctctttccacatctatggaatctttttaaacaaaaatgcaaattttctctatacttatgacatacctagaaaatttgagcccatagtaaatatctcagaaaggccatcccattagcctaagtttagtaaaagccaaattccaagacctcctagcaaagcagaaataccagtaattgcgataaataaatattagtggactcaatactctagtgaaaacatagact

SEQ ID NO: 6196 - DNA, 1037 bp, mus musculus
tttttacacatctattcaacaaacatttattgaggggttattatgtgctaagcactgtgctaggtgtcaaagaagtaagcaatgtatgttccttctgagggcaaacacatcacgcatttctgcagatgccctcttgcttgtttttgcacttatctagtactaaaatcagccaaagagtattctctctccagagcagatgcctggcacaatctacttttgagcctgcacctcctcgagactcaaaaaatactctggaaattggctgggtgtggtgactcacacctgtaatcccagcactttgggaggccaaggcagaaggattgcttgaggcctggagtttgagaccagcctggtcaacagaggaagatcctgtctttacaaaaaataaaaaattagctgggtgtgggggcacatgcctatagtcctagctactcaggaggctgaggcaggaggatggattgagtccaggagttcgaggctacagtgagctatgatcatgccactgcactccagactgggtgacagagcaagaccctgtctctgaaaaacaaaaaataaaaaaaatcaagaaatagagtcttagaactgctgactggacaggacaccaaatctatctaccatatggaacccatgaggaaataaaggattcaagagtaaatgactcctctgaagccacccacagtggccaatcttatttatcttgagtgacttaggggctggtcggggtggaggtcaaggaatatcctcaaggatagctagatgtcctttccagtctggagattctaggcagaccagagggaatggtggcgacctggctgccagctctctggagtcgagaatctgaagcaatgtgagctgccgccggttcatgccactgccagtgtttgcctgcgccatcactatcagcatcaaactcactccctgctttgttaagtgctttgggatttctcaagtagaaaaggtgctatataaaatcaatcacaggaaaccctgctgctggcagctcagaacagctacagtaagcagtgtccactcaa

SEQ ID NO: 6197 - DNA, 1221 bp, mus musculus
caacttggtaaagctttgaactattccataacagtcattttctggaataagatactattgtaaatatacaactaagatgtgaatgtttgaataataattttatttcaatttcacatgaaaatttagatgtctcatatactcacccattttaggggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagaggtaaagaaagatgtggtgaaagataagacaaatacacctagtacattttctctaccttttgctttcaagagtactgtgtggggttaggtgacaatcataactagcaatagtaatatttagtttttgaaatcgttttccaattcagggctactactaaatttgatttaattaatctgatatggtgtttttcaaactttttgactgcaatttacagtaagaaatcattctatttcattttaaaaatgctaatgggtcacaattcaaagtttgaaaacagtaataatgaagtttttaagcaatagaatacattttcaaattgttttgggaaaggctgggcacggtggctcacacctgtaatcccagcactttgggaggccaaggcgtgtggatcacgaggtcaggagtttgagaacagcctggccaacatggtgaaaccccgtctctactaaaaatacaaaaattagccaggcgtggtggcgggcgcctgtaatcccagctacttgggaggcggaggcaggagaattgcttgaaactgggaggcaaatgttgcagtgagccgaaatcgcaccacagcactccagcctgggtgaaagagcaaaactccgtctcaaaaaaaaaaaaaaaattgttttgggagaaacgagattaaaagtactctaaccttaactgattccagtattttgaacacgttgaagaagctgtgtgggcagttgaaaccttgatagcatccggtaaacctgtggcagcaaccatgtgcattggcccagaaggagatttgcatggcgtgccccccggcgagtgtgcagtgcgcctggtgaaagcaggtgatgatagatttcaatcagtttgtgattagtaagtcttaaaagaacacact

SEQ ID NO: 6198 - DNA, 1756 bp, mus musculus
attggctcaacttgggtcatttgctcattcttgaaccaggcactgtgtagggagaccacagtgttccagttggttgagagtggatcaacattcctcccctagaactaatttgtgagtgggggaagagtgggccttcagagaaaaataggcggctgttactaggaaaagagcaaagggatattggatggccagaaaagaacatacatgcttaatatagcaccttgtccaggggttttctctgcaggaacctggcctagcagttgaaaaggcaatgtctgaattcctgtagtgaccagttactcacaattttaaggaaattcagtctatccccagataacaccaccttataggaaagtcttgtattatgccaatgtctagctttctttggctgtcacctgtgaccctagttttgctcttgggtatacccctgagatatgtgaaggccattctcaagttctcaggtcctttcttttcagactcaatacctgttgctatgtcttttcctaatctgaaaacatttttagtcctttttctatttttgaccctattttttctaagtttaggcattttggtttagcatgagcgatccagatcacagagtaccaaaatgctttatgctttcaaaattgattcatactaagctgtttaagtttctgtatataatctaagaatatgtatagagttcatttgtttactcaagtagtatgtattgagcctctactacaataattcttaaacctttgttgcacattagaataatcacagaaacaaaaaaccaaacaccgcatattctcactcataggtgggacttgaacaatgagaacacctggacacaggagggggaacatcacactctagggaccgttgtggggtggggggaggggggagggatagcattaggagatatacctaatgctaaatgacgagttaatgggtgcagcgcaccagcatggcacatgtatacatatgtaacaaactgcacgttgtgcacatgtatcctaaaacttaaagtattaataataataataataaatattttttacaaaagaaaaaaaaagaataatcacaaaaacttaaaaatcctgatgcctggcctacaccccaaaccaaaattggactctctaggatagggaggggataggaactcagacaccagtattttttttttttttttgagacagagtctctcccagtagctgggactacaggtgcccgccaccacgcccggctaattttttgtatttttagtagagatggggtttcaccgtggtctcaatatcctgacctcctgatccgcccgcctcggcctcccaaaatgccgggattacaggcgtgagccaccgtgcccagccaggcaccagtattttaagctccccaggtgaggctaatgtatagctgaagtggaaaacctctgctctactaagcagtaggcctccttcaaaatacaatgtcaatgggtataggtttccttaaggtttttcagaaaatgaatttgaggcatgtctccatcgtttgcctctgtctgaccttgggcaacttctgtataggattattcatcaagtcacatcagagaaagcaacctggggcaagccagctctttagccatggataattatcaaggtttctgagaaaaagtacttgtattaatattcagttaaaaacttgcttttatatacttttctcagtttggttgataattcctggaggatgatggtatctgaatttattaaactgacctcatgcagaatcaagagta

SEQ ID NO: 6199 - DNA, 1286 bp, mus musculus
agtttaaggtctcatctctgccgtcctgaaagcccgtatctatggaggagatgagacggtgtatttgaaggcattctctgatgacttgggcgggggttagtaaaggctatacatattcttggaaggggaagacctttctggctttgtggtcagggagggttacaggaacatctgaaatcacccttgatgaaagagccatgtttaacctgtaggaagaaggaagaactaggctcattttggcttaagttgaaagtgtttaggttcaagttggtaataatggttgggcaagactggaaaggaagatagagctgtgtggctgggggctggaagtgggatagaaatttggttctattattattattattattattattattattattatttgagacagagtctcgctctgttgcccaggctggagtgcagtggcacaatcttggctcactgcaagctctgcctcccgggttcatgccattctcctgcctcagtctcccgagtagctgggactacaagtgcctgccaccacccccggctcattttttgtatttttagtagagacggggtttcaccgtgttagccaggatggtctcgatctcctgacctcatgatctgcccgcctgggcctcccaaagtgctgggattacaggtgtgagccaccgcgcccagccaggaatttggttctattattaatcaagtttactgtggggaatttttcttgatgtcaaataggtctccacaaaaatttgcagtagcttggagccatgtctctcaatgttagccatgaggaatatccacttgtatgcttcggtaccactttttgaaacgggttaggacaggatttccagaacttttactttgcaaatgtctttgttaatcctcccttacttgataacctgttctctaagcagcgtctgccctctgaatgtcgacggactggcgtcagcaatgacagagaccaagctgggggcatcccctttgcccctgtttcctctgctcccagcatctgctcaagtcaataccaacatgttgggatctctgctgtggcaactgcaggacactgaatggtggactctccatctgggagtctcagttgctaggtctcgtcccttgcagccacctgctctcattgcgatgacttgggctctctgcatggttgtggggctcactgggatctggtgaaactgatggcagcagccctgcccaccctaagggcagctgctcttcatcctgaggatgtctctatctgagggcatttgggtgcaaagccacaaccctgggcagcccgc

SEQ ID NO: 6200 - DNA, 1320 bp, mus musculus
actcaaaggagagaaaaacactcaaaagattataatatgtacactatactattctgaatagtttgtgttttctcctataggaaatgaggtatcttcatttgttttaaagttttcacttgaagaagtgatttgaatacatttatgcttatgaaaagataactgttggcagcctaaaagatggatctgagggagaagaaacagaaaaaaaaaacaaatggggttgtgtaacaatcatcaacaagatgatgaaaaaacttgattttgacagtggcagtgggcaaggatggcaaaaataccaaagatatttatccagccttgtcttttcatctgtgtttcagttgtatgtttctcactggtctctaaaatacctctaattgtgtatcaactcaaattcaactaagtaatgaaaataatagccaatatttattgataccttactttgtggtagacattgttctaattgcttcatctatattaactcgtttaatcccccagcaactctataaggcaggtgctattaatatacacattatctgaaggaggaaccattgtagagtttcagtaactgaccagtgtcacacaggatccttattcttcctctgtttttttgaaaaccataatgttacattgtctgaaacccggcttgatcatttctcttaccttctgttctatttgccttcatttctctgtatcgctatctctgtctacttttcttcctaacctggcagtctgcatcattttaaatgctggtttctctgccttcaattttcccttattcctcttctttttactgccagagaaatatcactatcatcatgttattgagttgattaatgtcttggaaagatgtaataattctctatcactcattgaatcaaatatgtcatagtattcaattcccagtaattgggctcatatcatgaatccaactctactttccccacattacccagaagagaacagtttcctttcttctgtagttccaaaatcattgcttcctttgtgcatatctatgttgttcttctaatctgaattgttttttattcctttacatcactttaacttttcttcaagatgtggcttaaccaagactgtctcccatgaaattaaaccaatgtgtggttgttttcccctttctgtgaattctctaccatttacaataagctgtgttctgacctatctatgcctttagtagagcactagtctcccaggtaatatgaagacggttgagcctgccctcatgaccaacttaactgacctgagctacatcaaggtgttagtgtgtggaggataggtggcaatgcctctgcttaggcataa

SEQ ID NO: 6201 - DNA, 962 bp, mus musculus
accccaaaagcaatgtgtctgaaagaaataattcactatggtgtgtgcttcagagggatctggaatatggagcttgaaaactagaaggaagagaatggacatcttaaaactattttaacaacaacaaaaaacgagcaataaacatgacattttaaaaaaaggatagactgtaactcctaaggaaatcttgtttccccctgtgacgttgagtctgtattctgctgcagtcttaaccatctcattcaacagtggccgcttgaccatctcattcaacagtgcccaagacagtcatttttcagccaaggctctcaaaagctaaagccaggtaaaggtgttaggtacttttaatttagattaattaatcaattttgatacataggaatgaaacatttaagtctttccttaagtttattattttaatacctaaagagatagactatatggcaatagtgaacttaattatttaattgaacttagctttaaacattttattgttaatattgttgttgggtttttttttttttttttttttgagactgagtctcgctctgtcactcaggctggggtacagtggtgctatctcagctcactgcaacctccgcctcctgggttcaagcagttctctgcctcagcctcccgagtagctgggattgcaggcgcccaccaccacgccctgctaatttttgtttttttagtagagatgcggtttcaccatcttggccaggctggtcttgaactcctgacctcgtgattcacccgcctcgggcctcccaaagtgctgggattacaggcgtgagccactgtgcctggccatgttggttttaactaccactgcaaacaaaggggttatcgtttatagacttccatacttgatttgacttggaagacaaaaccattagctaaatgggactggtaaagaattttcaggtcattcagaattgactaagatttggagaaacagt

SEQ ID NO: 6202 - DNA, 1326 bp, mus musculus
gtggtctttaagtttttccctttggcctgagcatttgccatgggaataaagaaaaaacaaacacaagaagacttattttctatggcttgtcaatatggatatcagaagcttgattgatttgtgtggggatcaattaggtcatgtgtaaaaggctgatggatttctagaccttgttgcttcaaacattacataaaccaggttatatccttcccagaagctgtagtctggttacaattcaaggtctctgtaattaactcatgacccaaacttctttctggtggaaaatagtgcttttccttttctcagtaagaaagcacactggaatgatgaatttgagtagatccactgaacaataaggtcttcctaagctgatctgtcctatatctgctgctaccagtgctgactcatggcatcaactctggcagcatttccttcactgcacctttccatctaactgatccttgaatcttcctttttcatttccccttctctccaggactcatatccctccagaggcccgctacttaatctatcagaagctctgtaaactctatatttagtatagactctgtctggtttacttatctgtattttcgctatcatcccccttgttcaggacaagggtgtgggtctttgcttctctcctgggccaatactacggctttctaattggaatccttgtttcccctcttgtgcatgcaatctattctttacacagagctagtcgtcttttttttttttttttttaatgtgcattgtgaatgcagctggaggccattatcctaagcaaattaatgcagggacagaaaaccaaatactgcgtgtcctgacttagaagtgggaagtgggagctaaacactgggtacacatggacatgaagatgggacaacagacactggagactactagaagcaagggagagggaggagacaagggctgaaatctgcctattgggtactatgctcacaccaagggtgacggagttattcatactccaaacctcagtgtcatgaaaatacccatgtaataaacctgcacacataccccctgaaactaaaataaaaactgagattataaaaaagtacatcaaattatatatctctcctgctttccacttccatttagcttaaaattcaaattccttaaccttgcaagatttatatcctatctcaatctatgcctctttcttcttggaccactgtgctgtctactctgattttttttttttgacttctcagaaacactagacttaaatctagacctgtgtactagagtttctctctaacagagactatctctctgttctcaacctccttcccaccccat

SEQ ID NO: 6203 - DNA, 1140 bp, mus musculus
atgtacacacacacatacacgtatagaataaaacttctcgggtatgtgttatttatgattatgtattcataattataacgaagctaagtcaccattatcttttctgctttaaagtatcagaagctgctaccttgccatgaaaaagtattacatgctcctccaattccttccccaccatatttatccaacaggaaaggaatgaataataaaactttgggctttttttcccttcttttttttccaggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtaagtgtttgatacctttttaaaaattacagttttaaaaaaaatgcttcgaagcatgcattgatgttcaactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatccttaagattgttgattttgtcttcggtatcactctgtttctttgagatggcaaagaatttaaatttcagtaattacaggtgagtatttgaagctgacatggatactcaaaatgttcaagtcataactaaaaatgaaccatactatcaataaaaatctccatttatgtcaagtaatggaaatacatgccttctaatcattaattctgtagtatcatattgacgtacaatatgtgttctt

SEQ ID NO: 6204 - DNA, 6936 bp, mus musculus
tagagatgttattgaattggcttaaaaagtatgaaataagagaaacaaaaatattaggctaagaaagctacagtttggttttttaaaaatatttctgtgataagaaaaaacaaaggtttcagctgccaaccatagagcttcaaaacatacagctaagcaaagactgacatactcacatataccatctcactaacacaattgttagatgatggtggaaaatgcagccaccaatctcattttttttaatttttgttttgagacaggatcttgctctgtcaatctggctggagtgcagtggtacaaacacagctcactgcagccttgaccttccgggctcaggccatcttcccacctcagccttctgagaagctgggactacaggcatgcaccaccatgcctaatacttcactttttttttttttttgtagagacagggtttcaccatgttgcccaggctggtccaaaatttctgggcttaaattatcctcctgcctcagcctcccaaagtgctgggattgcaggtgtgagcaactgtgccctgtcagatatcattcttttttttttttttactaatctcatggcaggctttatttctttttcactatatttctttttttttaaattattttattttattttattttgttttttattatactttaagttttagggtacatgtgcacattgtgcaggttagttacatatgtatacatgtgccatgctggtgcgctgcacctactaactcgtcatctagcattaggtatatctcccaatgctatccctcccccctccccccaccccacagtagtccccagagggtgatgttccccttcctgtgtccatgtgatctcattgttcaattcccacctatgagtgagaatatgaggtgtttggttttttgttcttgcgatagtttactgagaatgatgatttccaatttcatccatgtccctacaaaggacatgaactcatcattttttatggctgcatagtattccaaggtgtatatgtgccacattttcttaatccagtctatcattgttggacattcgggttggttccaagtctttgctattgtgaataatgccgcaataaacatacgtgtgcatgtgtctttatagcagcatgatttatagtcctttgggtatatacccagtaatgggatggctgagtcaaatggtatttctagttctagatctctgaggaattgccacactgacttccacaatggttgaactagtttacagtcccaccaacagtgtaaaagtgttcctatttctccacatcctctccagcacctgttgtttcctgacttttgaaggattgccattctaactggtgggagatggtatctcattgtggttttgatttgcatttctctgatggccagggatgatgagcattttttcatgtgttttttggctgcataaatgtcttcttttgagaagtgtctgttcatgtccttcgcccactttttgatggggttgtttgtttttttcttgtcaatttgtttgagttcattgtagattcttgatattagcccttcgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattcatttttgtataaggtgtaaggaagggatccagtttcagctttctatatatggctagccagttttcccagcaccatttattaaatagggaatcctttccccattgcttgtttttttcaggtttgtcaaagatcagatagttgtaggtatgctgtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgtgctcttttttgtttccatatgaactttaaagtagttttttccaattctgtgaagaaaggcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtcctgcacatcccttgtaagttggattcctaagtattttattccctttgaagcaattgtgaatggtagttcactcatgatttggctctctgtttgtctgttgttggtgtataagaatgcttgtaatttttgtacattgattttgtatcctgagactttgctgaagttgcttatcagcttaaggagattttgggctgagacaatggggttttctagatatacaatcatgtcgtctgcaaacagggacaatttgacttcctcttttcctgtttgaataccctttatttccttctcctgcctaattgccctggccagaacttccaacactatgttgaataggaatggtgagagagggcatccctgtcttgtgccagttttcaaagggaatgcttccagtttttgcccattcagtatgatattggctgtgggtttgttatagatagctcttattattttgaaatacgtcccatcaatacctaatttattgagagtttttagtgtgaagggttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcaatgttcatcaaggatattgatctaaaattctcttttttggttgtgtctctgcccagctttggtatcagaatgatgctggtctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatccagttttggtctattcagagattcaacttcttcctggtttagtcttgggagagtgtatgtgtcgaggaatttatccatttcttctagattttctagtttatttccgtagaggtgtttgtagtattctctgatggtagtttgtatttctatgggatcggtggtgatatcccctttatcattttttattgtgtctatttgattcttctctctttttttctttattagtcttgctagtggtctatcaattttgttgatcttttcaaaaaaccagctcctggattcattaattttttgaagggttttttgtgtctctgtctccttcagttctgctctgattttagttatttcttgccttctgctagcttttgactgtgtttgctcttccttttctagttcttttaattgtaatgttagggtgtcaattttggatctttcctgctttctcttgtgggcatgtagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtgatctgagagatagtttgttataatttttgttcttttacatttgctaaggagagctttacttccacgtatgtggtcaattttggaataggtgtggtgtggtgcagaaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaacggccttctttgtctcttttgatctttgttggtttaaagtctgttttatcagagactaggattgcaactcctgcctttttttgttttccatttgcttggtagatcttcctccatccttctgttttgagcctgtgtgtgtctctgcatgtgagatgggtttcctgaatacagcacactgatgggtcttgactctttatccaatttgccagtctgtgtcttttaattggagcatttagtctgtttacatttaaagttaatattgttatgtgtgaatttgatcctgtcatgatgatgttagctggtgattttgctcgttagttgatgcagtttcttcctagtcttgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttaatttggctggatatgaaattctgggttgaaaattcttttctttaagaatgttgaatattggcccccactctcttcttgcttgtagggtttctgccgatagatccgctgttagtctgatgggcttccctttgagggtaacccaacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctccttgataatatcctgcagactgttttccaacttggttccattctccccatcactttcaggtacaccaatcagatgtagatttggtcttttcacatagtcccatatttcttggaggctttgctcatttctttttattcttttttctttaaacttcccttctcacttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctacatttttttcaaagttttcaacttctttgcctttggtttgaatgtcctcccatagctcagagtaatttgatcgtctgaagccttcttctcttagcttgtcaaagtcattctccgtccagctttgttccattgctggtgaggaactgcgttcctttggaggaggagaggcactctgctttttagagtttccagtttttctgttctgttttttccctatctttgtggttttatctacttttggtcttagatgatggtgatgtacggatgggtttttggtgtggatgtcctttctgtttgttagttttccttctaacagacaggaccctcagctgtaggtctgttggagtaccctgccgtgtgaggtgtcagtgtgcccctgctggggggtgcctccaagttaggctgctcgggggtcaggggtcagggtcccacttgaggaggcagtctgcccgtgctcagatctccagctgcgtgctgggagaaccactgctctcttcaaagctgtcagacagggatatttaagtctgcagaggttactgctgtctttttgtttgtctgtgccctgcccccagaggtggagcctacagaggcaggcaggcctccttgagctgtggtgggctccacccagttcgagcttcccagctgctttgtttacctcagcaagcctgggcaatggcaggcgcccctcccccagcctcgctgcggccttgcagtttgatctcagactgctgtgctagcaatcagggagactccgtgggtgtaggaccctccgagccaggtgcaggatataatctcgtggtgcaccgttttttaagcccgtcgtaaaagtgcagtattcaggtgggagtgacccaattttccaggtgccgtcagtcacccctttctttaactaggaaagggaactccctgaccccttgcgcttcccgagtgaggcaatgcctcgccgtgcttcagctcacgcacggtgcgtgcacccactgacctgcgcccactgtctggcactccctagtgagatgaacccggtacctcagatggaaatgcagaaatcacccgtcttctgcgtcgctcatgctgggagctgtagaccggagctgttcctattcggccatcttggctcctccccccccagatctcattcttaataaaagacaagtaagttaaaatcgtaatgaaaaactgtttccggtatcaggctggcaaagataaaaaggttcgctaatatactgagagcaagtgtatgggaaaaacagaattctatacttacacactattgctggaaatgtaaatggtggaaactccattgaagggaacttggcaatatttgccaaaattaaaagtgctcatactcttggcctagaattctattttaaaactgtatcctacagaaaa

SEQ ID NO: 6205 - DNA, 560 bp, mus musculus
aaaacatgactttcttttaatgacatttaatttgctctggttttcacaaccctatagaataggcagtaacattcttaaacttggaccaaaggtcaactttttactcagcagttgcagaatgactgaacatagtgttcctcttttccagcatctcctgcttcacaaaggggccattttgggtgtgcacatagctggcggtgggactgcagctgaacctatgagtgggtgtgaataatctttctgtgggttgagttgcacccaagaacaaagtaagacctgagcctcagaatgcagcctctgtactctcttttagagagttttatttatctttaggttaaataacattctagaatatgtaagcaaagtccctgaggtacatggtatagtggtcagaacagattgtacaaaagcaaagattgtattaggtatgttgtgtgcttagtgttctatgaacataccaggatcttacgcattttcaaaaaaatttaggtgttcggtctataagccaatctgggcagggcataaatgtgatgcatctggaagtataaaggtaaaatcat

SEQ ID NO: 6206 - DNA, 131 bp, mus musculus
atccctattgtattaattattcaattaagaataaacaacatattacaacttttgaaacatttagctgtgctggatttactgaagtatggtacaataattaacaacttcagaaatgatttttgagattttta

SEQ ID NO: 6207 - DNA, 84 bp, mus musculus
actattttgagtagctaaagaattaaatgtctggatgtctgattaataaagtacattgggctatctcagaattgtgaacagcaa

SEQ ID NO: 6208 - DNA, 38 bp, mus musculus
tagaaaaaaatggagtaaatactatataaccaaaaatg

SEQ ID NO: 6209 - DNA, 835 bp, mus musculus
tctgctcccggctttatattattgaaagtcatatttcaacagtctactattcatccccggtcacttgagcttagttatcatgaatgaaaattgtgctctctgcaagatgttgcccctcatagggagcaaatactgggttggaatgaccattaatgtgattttgtatgaaaacaaaaaaaaattattgtaagtcatcttacttggctttttagcagaaaatatgactcacaaatgatacctacaaagtaaatacaaaagtacattgcaacctttgtagtttcttaagcctaccagtcaagtcagaggagctggtttccaggtttatcccagaccgtcactacccctgggaggcctcatctgatttgatctgccaccacacctctgccttaccagctaccctctatgctcctctgcctcctcttcagtctctctggttcctttctattcttccaacacagccaacacctgctatcaggacctctgtacttctggtttcttctgcccagaaaacttctcctcctttatcggcagggttccctccaacaattgacttcgcatttttgttcaaatgttgtttcatcaaaggtatgtttcctgataatcatttataaaatagcaccttatcaccttccaccccctttccactgctttatttttattcctatcacttattaacagatgacatatacttatcttttgttaatgtctccttctccccacatcactactaaaatataagatgcatgagggccagttttatctgcttctgtttcctcggcttcagaaagagtgcctgacccatagcgggtccccagtaaatatgttgagtgaatga

SEQ ID NO: 6210 - DNA, 1027 bp, mus musculus
acttaatcataaaatcagtataaatcataaacatctcaggtgggactttattagaaccaaaaatgcaaaatgactatgcttctgtttttcaagaaatggtacagtcccctaacacagctgtagtgttgatcatatgtctaacagaactacttctaggtcctcttgaacagaacgctccattaggcattctgtgggctaccccttcccagcaggcttttgcccaacccagttgccatagacggccatcagacacttggaatgacatcaggagacaatctgagcggactctgacctaaagaattcaagctagggggagactgaagatatcaatgtcatcttggctgacaatagcattccaaaggtcaaccagggtgaaaagaggatagactctgagttttcagtgccttttcagcaaccaagtggctaacaagtataataaagcatccccccaaaaaagaaaaaatatcctagaggcatgatgtcagtgaaagggaaataaggcaacctgtacacttaagtcatggtattttaaaacattttacctcttccaaggtaaatctcatcctgaaccaattcccacctctcggatgacctacttctttctgctgtgataaccccagtataggtgaataaagaacttaatggtatagaagtggaaattctttgcattagattaagaatggctaatttttaccgcagtttgtcacttttccagccctgtgctttatgctgaatagctcatttaatccttaaacaaagttttgaggatagcacattttgttccacattttacaaatgaggaaactgaggcaaagggagatttaaaccatatgcataatcaaacagttaccatgtgatacagccaattggctgttggccacacagcttcttccaagtcagaccagccttctcggttgtcagccatggagaaggtgaggccttcttccatgtctacaagcacctgaagaagtgaaacattttctctaaggatactggattttagggagaatgggaagaatgctgaacc

SEQ ID NO: 6211 - DNA, 7769 bp, mus musculus
gaaaaaaatatgattttctctcaaaaagatatctccttctgcatgcttccatcattctttgtaagtatctttttagctatggctcactcaagtttacttataaaccagtccttaaggatttcagttcaagatggctaactagagacatcatatgccagccctctcaagacagaaaagccaaaattatgaacagacaattatagcttaaatagaacatctaggataaaacactaaagtctaataaagaactcataaaagatacccaaggcacagaagaagaaagccaatggccagcttggctgagattaaccaggatcccagaggagctcagaattgcagggaaaggatgagtaaaagagatgtagtgatcgatatgcctactgtgagctgctgtgatccagactgcagaagagctcttctacgtatatgaatgctgacactaacgtgagtagtgatatggagacgctgaaagcattgcatcagacagagaactcacactgggtcactcacctcctccaagacctgaatggctacagaagcattccattttgggagtgcaacaatcgtgggactgcatcctgccctgggaacaacaggctccacatctctacatcccagaagttcctgctgacattcccttgcatagactcagagggctgcagtagcacagcactagctggacccaaagatgctgcaaagtccccagctctatcccataggtagtgctactcctcaggaaaagggcagtacagcattcaaaaggccagctcctaggacaaaggaatcataagtacacacttttaaaagcccaagaacttcctatctggggctatgagaagcgactctggccctgtcattggaacaaaccctgtgcttagttttgtaagtgaagagtgaaatgccctcccactagcagagcagcatctgtgcttgagctgtgacatagagaacaggaatcctcctccgcctctgcacaccttctcttgctgccactggaggccaggttgggtgagccaaagggctgactgactggagcagtaagtggtgactgcaatcccattgatggtgtggactctgtgcctgaacttttgtgtataaagcggggcacctcacccctctgtgtggtactttggtgctgctgcctcagagagtaggaaagactgaaaacggcgtggttgaaacttttggagctgagtctgtaaggcagtcatcaacaacaccagcccacaccaactggatcaacagggtagtcacaccacagctaccaccattgcccataccacaccagctgaccagggacccgagagcctgctcacttgccctatccactgctgctactacttgcagatgagcaatccatgtggaagcccaagaatcagactgccactaatcactgacataggggctagtgtacactaccctagggcataaaaacatagtatgctcagcccactgctgccatcactgaagcctgaagactggcccactttccaagtccccagtataacttctacacctcctttactgatacctacaccttaatgcgccaaggaaatcacaggaagcactgatgttgcttacaaccaaagaaaccatatagagatgaaactactggatgcacccagaatcaaagccaacgtgctctaccaactaacaccacacatgtgtcttttaaaagttttttcccttacaaaagtgaaatgaaaggccagggctgggcatgctgggtcactcctgtaattccagcactttgggaggtcaagacaggcagatcatttaaggtcaggagttcgagatcagcctggccaacatggtgagaccccatctctactaaaaaatataaaaatttgcttgacatagcagtgcatgtctataatcccagatacttgggaggctgaggcaggagaatcgctttaacccgggagacggaggctgcagtgagccgagattgtgccactgcactccagccttggtgacagagtgaggctctatctcaaaaaattaaaaataaatttagaaaccaccacacatacatctttttaaaaagtccttcctttataaaagtgaaatcaaaaacaggaagaagtgattacaccagatacacagatatcaacatatggatacagaaaacataaagaaaagcaagaaattatgaaacctccaaaagaatacaataattcatcagcaatagatattaatcaaaaagaaatttttaaaactccagataaagaattcaaaatgttgattttaaagaaactcagtgagacgcaagagaattctgaaaaacaatacaaaacatcagaaaaacaatttaggatacgaatgagaaatttaccaaagtcatagatatttttagaaatataaattctggagccgaagaattaattaagggaaatacaaaatacatttgcaagcctcaacaatagattaaatcaggcaaaagaaaaaatctcataacttaatgacaggtcttttgaaataatgcagtaagacaaaaataaaggaaaaagatttaaaaataatgaacaaagccttcatgacacttgggataacataaagtgaccaattatatgaactattgttattcgcaaaggtgaagagataataaaaagaatagaaaatctatttaataaaataataaatgtaaacttctcaatgcaaaaatcatctcttatgttaaaatcaggctatctaaagtcaatcataaagagcaaattctaaaaacagcaagcaaaaggcaactagtcaactataaaggaaaactcatcagaacaacagtgcatttctcaggagaaaccttacagtgtggaagataatgagataatatatccaaagaagtgttggaaagaacactattaatattccccccccaaatatctttcatcaatgaaggaaaatagtcttttccagatgagcaaatgctgagagaatttgttaccactagactagccctacaagaaatgctcaagggagttctaaatttggaagcaaaaggatggcatttgccatcatgaaaacatgtgaaagtataaaactcactggtaaagcaatcagacaaaggagagaaagaaaggactcaaatggcaccactatagaatttcaccagactacaacaactaacaataagagaaaatgtaaaaaaacaaagaatatataaaacagaaaacaacaatataacaggaacaaagcctcacatatcaataataacctgaaaaaatggactagattctcacttaaaagatatagataggttgaatgaatttttaaaataaacttactatatgctacttaaaagaaactcaccttatcattaaagacatacattgattgaaagtcaaaggatggaaaaagatattccatgcaaatggaaaccaaaagcaagcaggagtagctacatttctgtcagataaaacagattttaagtcaagaacagtaaaaaaaaaaaaaagacaaagaaggtcattatatgatgataaatggatcagtctagcaggaagatataacaattctaaatatatttgcacttaaaagtaaagcactcagattaataaagcaagcatcactaggtctaaagggaaagatagactgcaatatatgacagtgggagcctttaacatgtcattctcagcattaaacagattatttagacagagattcaaagaaaagacattggatttaaactggactttacaccaaatagatctagccaatacttacagaaccttctatctaacaactgcagaatatgcattcttttcttcaacacatggaacattctacaggagatggtaggccacaaaataagtctcaacaagttttacaaactcaaaataatattgagtatcctctcagaccatcatggaataaaagtagaagtcaatatcaagaggaactttggaaactatacaaatacatggaaattaaacaacatgctcctgaatgaccattgggccaaggaagaaataagtatgaaaataaaataaaataaaatattgaaacaaatgaaaatggaaatgacatacaaaaacctgtcaaatatagcaaaaggggtggtaagagggatttttataccaataaatgacacaaacaaacagcaagattacaaattaacaatataacaatgcagatcaagaaactagtaaagcaaggacaaaccaaactcagaattagaagaaaagaaataataaagatcagagcaaagctacataaaatagagattaaaacaatacaaagtatcaatgaaatgaaaagttattcaaaaagataaacacaattgatacatctctagatagactaaccaagaaaagaagagagaagatccaaatcagcaaaatcatgaatgaaggagccattacaactgataccacagaaataaaaaagatcaccagagactattatgaacaactctgtgcagacaaattggaaaacctacagggaatggataaattcctagaaatatacaacctatcaagactgaatcaggaaaaaaatagaaaacttgaacagatcaataacaagtagtaagattgagtcagtcataaaagtctcccgaacaaagaaaaggacacaactggatgaataaacagccaaattctaccaatagtacagagaagaacaaattaccaatcctcctgaaactattccaaaaagttgaattgaagggaattctccctaacttattctacaaggccaggatcaccctgacacccaaacctgacaagaacacaacaacaaaaaaagccacaagccaatattcttaatgaacataggtgcaaaacaatcctcagcaaaacattagcaaaccaaataaaacagcatatcaaaaaggtaacataccatgatcaggtgggatttataaaagggatgcaaggatggttcaacatatgcaaatcaataaacataatacatcactttaaagaaaacaaaattattatctcaatagaaaagcatttgataaaatgcaacatctctttatgataagaactcgcaacaaactaggcatagaagaaacatacctcaaaataataaaagccatataaaacaaacccacaggcagagtgtggtggctcattcctgtaatcccagcactttggcaggctgaggctggtggatcacccaaggccaggagttcgagaccagcctggccaacatggcaaaaccctgtctctactaaaaatacaaaaattagccggacattgtggtgggtgcctgtaatcccagctacttgagaggctgaagcaggagaatcacttgaattcgggaggcagaggttgcagtgagctgagatcgtgccactgcactccagcctgggtgacagagtgagagtccatctcaaaaacaaaacaaaaaacaaacaaacaaaaaaacccacagttaacatcatgctgaaaggggaaaaattttaaagcctttcctctaaaaactggaacaagacaaagatgctgaactttaccactcctattcaacatagcactggaagtcctagacagagcaatcagacaagagaaacaaataaaagacatccaaattggaaaagaggaagtcaaattttacctatttgatcttatgcatagaaaaacctaaagactccacaaaaactttatagttaataaatgaattcagtaaagttgcaagatacaaaatcaatgtacaaaaatctgtagcatttctatataccaataattatctacccaagaaataagtcaagaaggcaattccatttataatagctacaataaaataaaataaaatacctaggaataagtataaccaaggaggtgaaagccaagcgagactacaaaatactgctgaaggagattaaagatgatacaaacaaatggaaaatcatctcatgctcatggattggaagaattagtgttattcaaatgaccatatctctcaaagtaatctgcaaatgcaattcaactgctaccaatataacaacattattcttcacagaattataaacaaaaatcctaaaattcatatggaactgaaaaagagcctgaatacccaaagaaatctggagcaaagagaacaaagctgaaggcatcatattacctgatttcaaaatatattcaaaggctacagtaaccaaaataacatggtattggttcaaaagtagacacataaaccaatggagcagaatagagcaaccagaaattaaaagtcacgtatttacagccaattttaccattgacaaagctgtcaagaacttacattgagaacaggacactttctttaataaatggtgctaggaaaattggatagccatatgcaaaatagtgaaactgggcccctatttctcaccctatacaaaaaccaacccaaaaatgaaataaagagttaagtgtggaaactaaaagcacaaaaattttagaagaaaacctaggggactctctcctggacattggtctaaccaaaacttttatgactaagacctcgaaaggataagcaacaacaaaaaatagatgaatgggacttaacctaacaagcttctgcgcagaaaaaaaaaattaacaggatgaagggacagccttttgaatgagagaaaatattgcaaactatgcattcagtaggggactgatatccagaatatatgtggaactcaagcaacacaacaggaaaacaaaacaaaacaaaacaaaacaaaacaaaccactacaatgtagacaaagaacatgaatagacatttgtcaaaagaaggtataaaaacagccaacaggtatatgaaaaaatgtttaacatcactactcattagagaaatgcaaatcagaattacagtgagatatcatcttagtcagaatggctatcattaaaaagacagaaaaataacagatattgggaaggacacagaaaaaaggcatgcttatacactgttggtgggaacataatctagtagagccactatggaaaacagtatgcaaatttctcaaaaagaaaaaaactaaaaatagaattaccattcaatccagcaatcccactgtagggtatctactcaaaggagaaaaaaaatcaatatataaaaggggtacctgcactcataggtttactgcagtactacttacattagcaaaaatatggaatcaacctaaatgtacatcaaatgaaacaattgtgatatatatacacaatggaatactattcagctataaaaaagaatgaaatcatgctatttgtagcaatatggataaaattggaggtaattctcttaagcgaaataagccaggtacaaaaagacaaatattgcatgttctcacttatgtgtggggctataaaatcttgtcacatgggagtaaataacaaagatggagagggcgagttggggaaaaggaagaggatgaagaaagtggattaagggagggtgcaaatgtaaaatagtcaagatggaataaatgtagtgtttgatagcagagtagggtgaatattcttaactaaaatgtattgcacttgggtgatggacacattcaatacactgagttgcttatttttataaccttcaattatatgcaaagcaatttgatttcaaaatataatttaatatttatcaatgaggaaaatcttttgagtcctatgaagaagcccagagcttaaagttacccccctccttcactttattttgcatagcattacatagctggtttcacacagcattcaactaaatatttttgaaacaaagtaataattatttaactgatgaattaaatattgtgtataatactcttaacaaggggaaaataataaattaaatacttcactcttgtttttgc

SEQ ID NO: 6212 - DNA, 199 bp, mus musculus
cctgttttcaatgttgttgacatttttgctctattttctggaagattttctcaacttcttccaactatctctttacatatttttttctctcattaaattttaaatttctagttgctttatttttttggctttctttatgtccatttttatagtaccctgttcttgttttatggttacaatatttcttcttcctttttaa

SEQ ID NO: 6213 - DNA, 1048 bp, mus musculus
tcacttgcaatggaaatactgggttgtagtgaaggtaagatcttgaagagtcaaacacaaatgaaagtacttgaaacatacttaagaagatacaataaaactaaaataattatgtagctttttttttttttacttaaaggtaatattgcatcaatcatagatctagagatagtcaagacagagctgatgaacctcttcctattctttcattttttaaaaaaataaatttctagttaaattccaagatttctgtctaagccacaatgttttcactcaacatttaatgcacgacccttttgtgacaggcacatacctgaatacattaactccaaaactgaaatgtggaccacaatataactaaaatttatctttcatacagtacagtctttttagaatgaaagtttcatattccccatgaaacaggacttttaaattcagcatttttcaatgtcccaagtactgctttattttaacactctaaaccttaagacagaagtgttattattctgcattagtagatgaggtaaccaaagaccagagctcttaagcaattcctagagttgcacagtgggagactgagctttcaactcagtattgtctcgctataaagatggagtttttccaataatgcaatgctctccttcttcttcttctccttcagtgaattaccatgtctcttatattctctcattcacaagtataggagtgatcaacaattctgaaatatcaatctccttaaaaaaagtgcccatcttgtttatatttagttacttctagaagaactatacttcaaattgcttgaaatgtctacaagaaattttgagtgtgatgttagtaaacagcaatccttgcacatatcactggctgtaaatatgaaccataaattcctcacttaaacatataaaatcaagcatggaattaggttattcaaagaggcaagtctgtgacaatattatttactatcttatttgcaaggatcacatcttctaaaaactaactgttgtatgtttgtctttaaagaggtctatagataaaggcagtgattttc

SEQ ID NO: 6214 - DNA, 144 bp, mus musculus
aacccagattttaatattattggtgcccatctcttagctagtcataggaaaaccaagttaataagaaaaaaatgctacccaatattctttcatggtaggtatcggtgactatttgtcaaatacatgctcaaaaatttacacaag

SEQ ID NO: 6215 - DNA, 1175 bp, mus musculus
gaaaccctgaatttgcataccttggaaaatattttcatagcttggttaaaaataagtgttgtttgattgaaaattagcaaggtttcctcacaggagaaaacaaaatgttgggagacaagtgtaattaagaaacaggattgtgtttgtactatgactttaaacatttttttaaaaaactaaagaccacagtcagcattcctcttctctatttgtaattactttgagtgcttaacctgtcttttaattgtcactccacattttagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgagcaatggttctaaatgaatttccgttgccccagtaaagtcatcatagtccatttttatgataaaatttataagaattcttactgtgtacattcttg

SEQ ID NO: 6216 - DNA, 294 bp, mus musculus
cttctaaaaaggaacgatggcatctttcagaattatattatgattttttacattttactatcccttgcattaatttaaatcgtggactgccaggattaatttcagaaaattctacgtcattctttgtgatatgcaaagtaaccacgaagcaagccgtggtggctagcagatcattcttttcatgagctccctggcaagacaggacttatttaattttagcattacatgtatacccatccagccttgctaaatggacccaatgaatgtaatattaattagaaaaaactatcttga

SEQ ID NO: 6217 - DNA, 334 bp, mus musculus
caaaaggttgatagcttgtccagtttttagtgcacagactgacagctaaatacaaattgagaaatgtaagtttcacttcgagcaaatttactgggtgaaaacctcatttttttcatttcatttgaatatgttcattgcttctcagaatatgcaactttatagtgagcatattttttattcttgaaggctcattattttacagtgaggttactgaacctagaccacatagtactgattacccagcataatattaatcaaaatatacaaggcaaatgggattccaaacagtgccaaataggcatctgcttttaacacagaataaaaaagtacattt

SEQ ID NO: 6218 - DNA, 732 bp, mus musculus
tgcaacttgtagtccaatcaatacttagttaacagttcacagaaatggtggtaaacttcattccacatcagtattttagataataaaatgttaaatcatttattgaaatgtaacaagatttccatgcagatttaatgtgactagatagtattttatattgtttttattagcaatataataaatggcaagtaataaattcagatgtagtgcagacagactcaggttgtcagaagtactgggtggcttttttctggttattgtatcacaaagccagtaggtgaaatgcatggaacaagttatttttgtttcttctaacaaatgacaaatattttaggatactattttatagttcttttctatgtaatctcataaccacatatatagaacacatttcccaggatattcgattatggaataatataaatatgaattgctcttaatttcatagaaacaaaatcttttctaatatcctcttatccactatgtaactatagccaccttgaagggagaaacaccacattatgcattctcttatttttgatgataccaagaaaaaatgttaaatatttatacttattgctggtatatatttggtactctgtaaattcttgctgaaagaatgtgaggcagagagctgctaagagtaatagtgtcagacttgaactagaattctggagttgccatttactggttgtatgtttgagcaagttacagtagtcccgcctcatctgt

SEQ ID NO: 6219 - DNA, 1017 bp, mus musculus
atttcagcgaacaaatgagaccatatattttattagttatagactctttctactggactttcgaggctggtggcacttcatggccatggtcattttgcctaccatgtggagaaaatgagccggaaaaataaagtccagcacagacaagaaaaaataagcagagcaaccacaggaataaatgacagaactcttgtcctatctgctctatctcataccaacctccatctgcaacttcccatttatgggagttactaaatttttacttcaactaaatggggtttggtttctgccacttgcagtaaaagaattcagactaatacaataattcatcttatttatcttctatggcaaacaacttaatagagttataaagcaaatttagtagaagataatttcctttcctgggtcataagtttaattaataccttttttatttttgttggataccatttttgaaatccttgaacataaagtcctatgctattttttaggctattacagcaatgggggaagaaactcgacaaggagcatggtgacttctgctaaagttgtttcattaaatcccacagggaaaatgtgttaaacataaagtatatatgtttgtccaagaataaattcttcttttcctacttagagataaatatccaaaagactagggtcctaaatcctatatgttagtcatagaagacaaatttttatgattttttgacacatttgtactgctagacttcactaaagcatatgaagcacacatgttaccctgacagcaaagaaatgaaaattatgcactatatatatttttcagtggcatctttgtagaccttgccagtatctgaactgttagaacatggttgaatgtcaattttctgcaggaattttaaagcaggtttattatagtgctgaacatatctggtcataaattttaccatgcagaaaaagcaaactttctccaaacatgaaattttataaacacccattaattgttcaatatagcatggcttttgaatgctagacatt

SEQ ID NO: 6220 - DNA, 1107 bp, mus musculus
ttttttagcacaaatgtgactttcaataaatgaagccttgggcagcatagtaactttgtacatagcatgtatccaataattctcacttttttgagaatagtaaaattttgaacctaacaaccaagatgaaggtatttttggacacattcatcagacttaaagaaatgaaattgtaacagtaggccgtctagaagctgtagcagaaaacccaagtctgaaaactgttggtggtttcacaattgatgaaaaactatgcacataggacttcaaattcattcatttggtcattagagtatgactgggtacgattacattccaagattccaaagtttttgttttatttttatttttttagatagcctaccatttttactgaggaaaagtaatattatgcagaagttcagtatatgaaagatgaaagggaagctgttctgggtgaagcagagaagtcagtctctagaggctttccagattcacctccctcagtgcccttaggcggctctgcaggggccaaggactcaccagaatccaatttaaaaaccgctgaaagagaatatcaaggatttacatgaccctgagaaaaatgttttatttgtcattcttagtttgcaggaatcctataagcatcagcaaatatttgctttcccccaaaataataattgatgtttcctatttccttaaataatcttagttatcttattatcaaaatactggcctcagaaactcacaggaagaaaaactttacatttttaaacgttcctttagaaagccacatgatcctagaccagggcttcagtgggaggccaggcaaagctcttggttccccagctgagcctcaagatttttccaagttcaggtactttactcggttacatgacagtagtttaggaactctctttgtgggaggcattgcttcacggacctgacaggatggatagggaatggcccttgtgcctgatccataacagtcattgcctgttacacacatttcaagattcattctggctatgaagataatcgagacagtcgacagttaccccgcagctgcatggatttatgatggcactgtcaagaaaatgagccaaaatgacacagtagctggcttta

SEQ ID NO: 6221 - DNA, 1360 bp, mus musculus
atggcaaaatctctgtcataaaataatttggacttaattaacattctccaaggcaggcaagctggaagtataataattcttttgaaagcaaataccctttgatgattacaagaatcaagtatgatcagagaatttttttcttggccattttacaagagcctatccatctttatgtggcctatgacacaaaaattaacatgcgaaaaatggtcattttaaaacgataaataattagtggggcagctgggtgcctaaaaaatttctttacgttatgatagaagatacgttagactgaaccacttatttcaggcacaattttattttgtcatttactttcccattaaaatgtgaagtttataagctgagatcacaaataatttcttaggctttcttccaaataagaaaagtaaaacagaaaaggtaaaaggaaagacgtttttaatttaataagaaatttaaatattaattattataacaaattaatttcaaatttagagctattactaagttattagtttattgacattacattatcaccatattcattcactaactatcaggccaggattctaaaacatgcagaaagcatataggtttgaattcactggatgataatatcaaagattatcgtttcttcttgtggtggaatattaattatatctaaataattttggggaaaggactttcttaatagtatttaagataggtaaaattttacatttgcagtaaggtaaagtattaaagtaacaatagtgataattactcaaagagcaattgcaacttttatagtacactggcacagaaacaagagcaatgctgtatattccactaattctaagcaatttaaaattgtctaaatatggagcatgaagcatggcactcagtgcgtgaacaatgaccatcctgagtgcctgaattacgtcactaccttgtggttatttatgcatatatgtttgtgggattggcctatcttggcaacagtagctcctttcaaaaacagcctttactagccaaaggacattgatatagatattctagttatccaataattcccttcaagtttagaaattattctaaatatttcaaaaatgtatgaaaaaatattataatctaggctcatagaccttgtctaggtggcactgctggcttctgtaggtcttagctcccagaaagcaccttaaaaattttggttgaaggcattccaaagggcagagctctgtaagatgcaggccaggagcaagggctttgcttgctagtactgttttcctttgaagtttctaaaaagcccttagaggcaaactctgtcttcctgtagcaacagcacatgcccctttccatattatgagtaatcgtatcttca

SEQ ID NO: 6222 - DNA, 999 bp, mus musculus
agagatagaaaagattttaattttatcagcttaaaactgaccagtcaacacatgccaaacaataaccccggataatttagcactcttcataaatgtgatattttcaaaagctataaaaaagaactccctattaataactctgactataaaggttcatcacaggctactattcttccctctttgaacttaacgacaactcaagtcaatgccctccttttttcttttgttgcagctgctattgggttggaaaagactgttgttggaaaggactgttgtccaggctccaaaaagtccagacaaggtctccagagactctctatttttcctccagatccttttactgacattaatgatgaagcagctttgtctgtgtctctgccttggttagcaatgccttagtgacagggcagctccagatgcattagatcagcagctgatgccatcatgcgaatgtctaacacttactttaggtaggtgacacttcttaatattcaatcctgtcttcacaatgtcgacttgtcccaccatagatgggtgttctttttatcattatttttgagactgttaatgtttttgcttgtaattcctctaaagagcgtttaagaaaaaataattatttataacctttaatgctaggagggtagtgtagtttgcctggaagaatatgcatcacagagttcttgtttagaaatggtaattaattttacagtcaacagtagtgtgacacactgtctctgactagacgtccaccatggcttcctgccagtcctttggaagaatattaattgacgtccagtgctaagcagtctctttgctgtgtatttaaatgaaacaaagtgctttaaattaaacaaatacattctaaacttgcatattcaatacaagttctgtatcttgatagcgccaaaatacacatttggtttatatctttatttttcctctttttttttttttgttctcgttcttatactcctgactcttatagagccctattatttg

SEQ ID NO: 6223 - DNA, 177 bp, mus musculus
gcagaaagataaaacacactcaactttctcctaccgtagaaatccccagtcttgactcctttccagttgggattctttataagtataaatgttgattttctaaaggtttctagtagcctgtctgccgacaacaaagaaaacttgactttctccatcaaatgatgccctgtaaattgt

SEQ ID NO: 6224 - DNA, 1149 bp, mus musculus
aactatgctgaattaatttatttattttgatatatataatagatatcttaagatagctctttagcacactactatgatgtactttttaaaatatgaatgttgtttttcaaataattcctttcaatccctacagatataaatatatagctatatagatatatatatctctatatctccatagatatagattatatatagcttattttttctttgtaagctgttaaattacttaaagcatgaaatttcttgacttgtagagtgacttaaaatatgtctgaaagtctgcaaggctaatcaaattttagagttctataaaacataaattcccattttttaactttaagacagtttacgaaaacctttacacaccaaacttaaaatttacattccttttggacagtttttacaatgaactgaagatgccagagttaacagatgaccagtgtgtcagtcctattttgcccgtcctgcttgtcacacactggtggatatttctccacttttgttccactttaatataaagcacacagatgtttcagaacaagacttgacttctgaccttgaggctattagggtcagggtcctcagggcctgtgaaattatcacaagctgagctaaagtttttctccatcacaggaagtaaccagtaagtaagaagttaaaaaggagctttgtcagagagacaagatggtctcagtaagggtcagcttctgtagtctgctatctctgcaggaggcacatgcatgggaggaggaatataatataaccactggcacatcacatatctgtcaggcaacgccagggctgagaagtctatttaatgtaatatacgttgtttaggttctaaagtattaatggcaattatctcatcttcgttttttttttttgctactttttgtgaaataactttgatttgggggtatgtaatggaagcatacggatggtggcaaatgaataaagactggttcctgacctcatacaatggattcctttaagcaaataacattgtaccctgatgaattttacattattttttgacaaatttgattaatatgtttaggtccactgtgtttttgtttgaaaggctttctaaaatatagtattgttaaagaaataataaacattgaaatgtttttagatcctttgctt

SEQ ID NO: 6225 - DNA, 757 bp, mus musculus
ccctttccttgtttacaacatttctgaaagatgtctcattttagattttggatttaaaagatttgtttaacaagagaattcacaaagattcagtgattcagagctccagtgaaataagataatgcttcttttctgaaaatgcaggcattccaatgtcaaacctgggtttaagtggagggaccgaatttcctgggcagttggtattgacactggtcctatacctctgattgcagaaggttccattttggaaatttaccagtgaagatgccattgacctctaaaagaatttcaaggacattcttttctaagattttcactggtattattctagaaacaaaccttctgaggcagtatttctgaaactgtgttctgtaggtcactatatccctgagatgataataattgtttcccaatttataataaaataaggtttttgaaaatagctaaacaaatttaagtagtttgatatgctaaagtacatactgtaaagagagctaagggaagtgttttccaaatttatttgaccatgaagtcttccatcaaggaaaaagtattatatcccaatgaataatttgaagccactgaagcagcttcaaaggcttcaaaggtaaattacccattcttctatgtcccactccaccccactaggagctcttcagctctgtatccatcatatattcacatcagcagaggctcacccacgtgctggacagccttttctagagtgaaagagtgttactgttctgttttctaattt

SEQ ID NO: 6226 - DNA, 180 bp, mus musculus
acattagtaattattactaattgtcctaataatgctatctacatctggttaattcctatcattgtacctcctacaatgtgattaatgtcaggagtggggaattttatgtattaaatttcttcttaaaggttacaccctggaaatgtgagggaaagtatttgtggcaatgggatgtcaccc

SEQ ID NO: 6227 - DNA, 440 bp, mus musculus
tgcctaggtaggtagaagaacgctttcatggaagctattaaaaggttctaaccaccaattttttttcagtacttattactgtgacctcactccaccatctgtaatatgtgtatctggattaaaccaaagctcattccagcaataatctgcaaaataaaattggaaaagaaattctatttaggataactgattgattgattgattgattttttcattatgaattaacttgttatattgcttagtaaaaatgtataaatatagtttattgaacaagtaactttggtaggtaagaaataacacacgactggatgcaggatttggatttcctgcttttaatggatatgccaaataaagtttcataaaatgttttttggataacacagtttaggcttcaggaattaaactgagtaaagatatgagaaagctgataaaatgatctc

SEQ ID NO: 6228 - DNA, 269 bp, mus musculus
taagacatttgctgtattataatgtcatccttgatagattgactcttttatttcttatatctaaactacctactgtttttcccaaagaagacaaaagtactaattgaattgtgtgttttgtttggaaaatcagttgttattatcatagatttatttggacatttattttgcacatgcaaatttattatgtaaagattactttgtgaaaatggtacctttcgtatttactaatcatttttatagtattttaaacattttataataaatgt

SEQ ID NO: 6229 - DNA, 1783 bp, mus musculus
ggacggacagttccactttttttttttttccatgcttctggtgctctttgtctgtgttagcagttatcaaaatctagttttagcttttttttttccttccgcacgtggaagaaaagaaggaaaacagctttggaagttctcaaccgtcaacccccgggaggacgtttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgagcctgaaggaggcggtttgttgtggcgagggcagctggggccgcactggcggaggcgggagagggagtatggcggaggacgccctggggtggcccagcatgccctggggtggcccagcctgaggctgctttctgacttctcaaggcgttgtcggatcaaagtttagccacccagtgggtttaccttgcccgctgcctagacagagaagatttatcaaggaaggggaattgccatggagaaagagtaaggcacgcagagccggctgtgcgggagaccagagtttttttattgctcaaatcagtctctccagcattctgggatgggatcagagtttttaaagataatttggctggcaggggctcgggaactggggagtgctgattggtcaggttggtcagggaatcatagtgtggttgaagtcaggttttcttgccatcttctgttcctgggtgggatggcagaactagttgacccagattacttgtctgggtggtgtcagctcaaccatccagtgaagggtctgcaaaatatctcaagcaccgagcttcggttttacaataatgatgttttccccaggagcaatttgcggaggttcagactcttggcgccagaggctgcatgacccctaaccttaatttctaatcttgtagataatttgttagtcctgcaaaggcagattagtccccaggcaacaaggggatcttttcagaaaagagctattatcaattttgtttcagagtcaaactgtgaaatgaattccttcccaaagttagttcggcctaagcccaggaatgaacaaggagtttaaaggttagaagcaagaaggagtggattaggtccaatctgtttcactgtcataatttcctcatttataatttttgcaaaggtagtttcaaaaacaggttaaccggctggcacgaacttgggtgcctcacctcctccagaacctgactggcacagtccatcctacacattgtgggtgatgagggcctggcttccagatagccagctgcagagaggatattgttgagtcatttatcgttgtttggtcaccaactctgagaagttctgggttgaatcacctg

SEQ ID NO: 6230 - DNA, 860 bp, mus musculus
tttctgtcccttgccaatttctagaggctgttactagcttgttgggagcacatgcctgggcttgaatgctggctgtgccacttacgaactgtgtcactttaggcatattccttagtatttttgtatctcagtgtccacatctgaaaacttgagttgttgtgagaatgaaatgaaaaaacacatacaaagtgcttaggacagtgcctggaatgtggaatgtactcatcagttgcagtgctggtgtgggcactacctagcccaaaacagtttctatgatttacttgtttttggatttgtttgtatttgaaaatagtgtctatatattttttttcacatgagaagcaaatggcaaactgaatagaaacgacgtttaatgtacttgcattcttttacagatgctctctctctgtttttttttttaattaagtactgtgttattcttgtcttattagagaaagagaaacagtgattattaaatgttgtctaattaccttagcctggtgttgttttcactcaaggggagccagggatatgtacactgtgtacactgcgttccagaaaggagaaaaaaaggatggggttgtgaattcagtaaagaatttgagggaacggttttcaagtgcattgcaccctggggacttgtgtctggcatggggctaccagggaagagacagcagaaaaggtaaccagacttgtgagcactcaacgttgcaatggaatctggactctgcttcctggcaatgcgaccttcaatcagtcccctgacttcttagagaagtagaaaacagtgaagagcaaatgctgtgtaagcagagacttcccacgaaatccttctgctaattaattagctatagatttgg

SEQ ID NO: 6231 - DNA, 461 bp, mus musculus
ccaaagattaggagcttctttgaggagcaactatcttcttaatctttacatcattataggcagacacaatgcccagcatgtgttataccttcaatataatttaaacgaattcatgcatgaatcaggaatgaagaaaggaagggaggaaggaaggaaggagggaggaagagagggaaggagggagggagggagggaggggatagagggagaagttaatggatgtgttcaagataaaacaaccagtcatggtaaaaggaggatttttaatccgtgtctccatggttctctgatggtcgatggtaaatatgtaaggaaggtaattttgcattattttggtgagaaattctgtatattacatatcagtatcaaacataaatattgttatgtaaatattctctgtttttctctaggttttaaatacttacctggtaacctaatcctattaaaagttttgtcttttt

SEQ ID NO: 6232 - DNA, 1138 bp, mus musculus
gatgcaaggaaaatgattgggtcaggcttgtcttagggttgccagcatcaaacatatgaagttattataaccaaggtctacaaaaagtcataaagaagcagacttgagaaaaatgaagggagcctgtgaaagttactgtactatttgttcactatgaagaggttggggaatgatcactgacctctaagtaacagagaatggaactcatctttcacttctgaatgagctcctcactgtaattgatggcatttcctgaaatggctgcgatcattagggctccagtgactgaattaaaagaaaatgaaagatgcagatggctgtaataaagcaggaaaatgcatttcttcctggtgacagatacaactgatcattttacaaggaagtgctttactaaaagtgtttcagctatgtagttctcagggaaaatgaagagtaatgtaaaaattggacaagatgaaactggctgtttcattccagatattgactgcacaagtcacttttaataaatcagctgcttatggtacctaagacagcagtttgttaatattatgaggcactacaaaatgttctctttggttaggcaatctttgagcgtcacatgataaacttaaaagttttatttaattttttatttgctatatgtttttcgaattatcaacacttgaagtagtagacatatttgtttggaaacagctttgatcatctaaaagattcaagggtcagcaatcttttcctggaaatgtccagataatacttattttagacctttgtgggcaatatagtctctgaaacaactgctcaactctgtagttgtagcgggaaagcatatgcaggcaatgataaaggaatgggtatgactgtgtttcaataaaactttacaaaaacaacgtacaactggatttggccttcatactgtaatttgtgaatctgtaatctaaaaaatctattcagcataccaaatgatgttgtgaataacaacaattagaaatcttaaaagctttctacactgaaataaataaaatgctaaagctaaatattttagtcttctactagaaatagggatatgagcatttatagcatttaaataaatacggaatactgttttaaaagaaccacagcttaatgacaacctgtattt

SEQ ID NO: 6233 - DNA, 386 bp, mus musculus
attttagaacattcacaaattcattatgtgaaagtctgaacaatgtacaattatatgaagtaacagaaattacactcttatgttggccttcctcaaatctactccatagtagaagcaagcatattagaaacaatcatctgttccaaaaaaggcaaagctggcgtgttatgttattttgtttttccccataattctgcactattatttggcaaagatggatacttatgaagctattaccatctaaattcactggggtagacaataagaaagctggtggtgagtgtggcattttcctttagggtactctttcagtgctctcactcttaggtttggatctattcctctttcatttctcttttttaaaggcattctcatgtaaagctttg

SEQ ID NO: 6234 - DNA, 860 bp, mus musculus
ctgcagttcatatatcatctttatcttatatacatatctatgtcttccaaaacttagttttaaacagagattagaggaaaggatgactaaacagtgttagtgttgaagacaaatttcatttcttttatttcaattcccacttaatgtaaaattatatacaaatttaattgttctgttagaatcacagaacttcattgtcttaaataccattcagtaacctgtctttatgaaatccaaatatgattttaaatggcttaaatttgatgatgttttacctcactacactgctggaaaaaattacctttgaataaaggagaaatagcccagcctcaagttgttgaggttgttgttaaaagcagcttcatccgaatgtatgaatgatgacaatataaattattgtctaacctggataatttgaacactgggaaaattacattaggacagcagttgtaaactgggactatcaggaaaagtaggaggtatgttaagcctatcgtgtattaaacagtaaaaacaataactagtacaatatgatataattgtttaagaagcccagaggtagattccactttcacttttattcatacaattatgataacctcccaaatagaatactttcatatcttccccatttttatatttacctactggcagcctgctgggtatctaaatcaagaactttctctcaggagcaaatcaaaattgctacgtgtgaatttttaattttccagttccaaagcttagaagaaccaataagcatgcactcaattttaatttaaattgaaacccacagctgtatttactgtagatggtctttcagggaactgaatctaatataatttcttcacttatctaatcat

SEQ ID NO: 6235 - DNA, 841 bp, mus musculus
aaatattttagaatattaggaaaatttagaaagttttgctagtgctgtttgccttcattaggaaatgcttaaacaataaattgataacgattgttaaaaaattaatctgtgacattaaattttatttccaaatatgttttatgggaattgtattctactttttgtatttttaccacagtcttttattatactacgtataaacctgtatttaatatcatatatgtttttgtctttgacatttgagagatccctatttttatgaaataatcagctttgtaaatatttcttattctattttaaatacttggttctaaattacatgaaataccagttttaagtatggttttgtggacaattagacacaccaaaaagtcaccaccacagaattatcgtttagtgagaggccttaagcatggaaattgttaaagtaaacttctctaaccacaatggttgaatgacttattcacagtggtaatggaactatttgggtcactttcagaaaaaaaaaattatatagttatgttactgcaattgcaatacatcactgtattattaaaaatggaaattatatttttactatttttttgcctctcttcgcccacccccacaaaacaaggtcctactaatttagcaagaaagttgacaagttacattttaatctgatgcaagaaaatttagactattcaggtattatttttaattcaaaacaaagagtatgtgtgtcttcctcactttgtgagactgagatagcattgaaaatcatcaaataatttttatgtaaagttgtaaattttaaaaaatgttttgaaatgctttcaaagcaatattttaaacatgtttt

SEQ ID NO: 6236 - DNA, 291 bp, mus musculus
tataattgtatttcagttttaaatgcaataggaagggaataataatactatataagagattttgcagatgatgcacacattcaacaataataactaaataaaagtgttatttcttgctggaattcatttatgtcaataagtattatttgacaaagactagttattaggtaaggaaagaacaaatatattattaataaccaaccactttgtgtcctaacatcaactctcataaagccttccttcaaaccactttggactaccagttattttatatccttatgaagagaagag

SEQ ID NO: 6237 - DNA, 1054 bp, mus musculus
acatatatatatatatatatatatatatgtatatgccctccttccaaatagcaaatgtgccactctatacactagaacagatcacattatttgatgtttgttctgtaaatatcaattgtattccagaaaggtcactcaagtttaatggaaaatgatgaaaaatatctctaatggttttatgttatattttgagaaatatttttgagagacaatagaattgtccaataaaatccagttttaaactatttagccttaaatatcctaattttggaaaattatttttgatgcctacttctgtgaaattcctgttttcccagcacacgttctgcacatatatgtgcattcagatcctacatatattaatgtaatttttacattactatgttcccataactttaggcaatttgtaaatcattgattcttaagttaggaaaatagcagtgaaatgtgatatatgataaattattagcataaacaatacaaagtaaatgatgtgaaaaattactgaggcttgtttaatgaatgataacggacacaaactcaacaaaatgattcttgtagttcatgggaaacctttaagaatacagagattgttaagaatataaccagattgaataaaaatttaaatagattatacattttacatttcacttttgggaaacatcaatgaacagaattgtttcctctttcctctccctcactccaccataaacagcaagcagctccatctgcagagaccgtgataaccacagagaagtgcgatggtccatttaccacactttacaaacactgcactaatgatgctttccttatcactctccacctattaagatgtgcaataaacatatcttcttgagtttcacattagtgtgacttcaaatacattttttatgtgcagtaatgattttctaatgaacgtgcatgcctcaatgtcttctaggtattgattagtataagcaggctaattttaattcctagaaatttctattcatcagcaagatctttatcagttttctactgtatgccagccttataagaaaaaaaaaaagatttg

SEQ ID NO: 6238 - DNA, 1054 bp, mus musculus
aatcacctgctaaagttcaaatagatagttgcaaagttagaattggaaccaaatttttaaaacttccattgtaattttcatcgcttctggccctactttaataagaaataatggacccaaacccaagccactgtgcatgaatctgaagaaccctgggcttgctagatactgagagacattaagaaaaactcacatgatctgtgtgtagtgaacaatggtttttctttccagcagtcatatcctcatcattttcttttatttggaaactctcctccaactctcatttcatgcaatggaaaaaaaaaaaatctctgttttcatcattagagatggcatgaaacctagtctggaccaacatactcacaaatcttgcctgaagtgattgcttcacaaacagcctgaataggagaacatccaaatcaatcagagaaacttttgtgaaactacagtatgggtgaagaaacttgttgggcaaagatttcatagagtaaccatctaaagaccatctttccaaaacatagaaagagccttcctgtatgtggccaaaataaatggaacaggcatgggatatagagtgactgataatggcatttgagtccttggatccatccatacctgatctactgctggaaatcttaaacgtgtgtgtcaatgaattctctttttcagaggagccagtttgaattttttttcagccaccatcaagaattctattaaatcctgttttataacaaatattggcattgatagctctcttactaatagaagataaacaacaaaacagtgtgtgcctttaaaatctcaaaggaaagaaaataatgccatagagctgagaagtgcctgtcactgaaaatgaatctctaaatggaagggaagcactttttccaggaatctactcattactccccaaaagatgtaagaggctatatccatggccatgtagaaaaaactgaagatgataaatcagaaattcaataaaagtaaaagaagaaaaaggtaagttgatttgcaataaaatattggttaacaaaggcagtaatgaaaatgtttaaca

SEQ ID NO: 6239 - DNA, 1165 bp, mus musculus
atagttgcaaagttagaattggaaccaaatttttaaaacttccattgtaattttcatcgcttctggccctactttaataagaaataatggacccaaacccaagccactgtgcatgaatctgaagaaccctgggcttgctagatactgagagacattaagaaaaactcacatgatctgtgtgtagtgaacaatggtttttctttccagcagtcatatcctcatcattttcttttatttggaaactctcctccaactctcatttcatgcaatggaaaaaaaaaaaatctctgttttcatcattagagatggcatgaaacctagtctggaccaacatactcacaaatcttgcctgaagtgattgcttcacaaacagcctgaataggagaacatccaaatcaatcagagaaacttttgtgaaactacagtatgggtgaagaaacttgttgggcaaagatttcatagagtaaccatctaaagaccatctttccaaaacatagaaagagccttcctgtatgtggccaaaataaatggaacaggcatgggatatagagtgactgataatggcatttgagtccttggatccatccatacctgatctactgctggaaatcttaaacgtgtgtgtcaatgaattctctttttcagaggagccagtttgaattttttttcagccaccatcaagaattctattaaatcctgttttataacaaatattggcattgatagctctcttactaatagaagataaacaacaaaacagtgtgtgcctttaaaatctcaaaggaaagaaaataatgccatagagctgagaagtgcctgtcactgaaaatgaatctctaaatggaagggaagcactttttccaggaatctactcattactccccaaaagatgtaagaggctatatccatggccatgtagaaaaaactgaagatgataaatcagaaattcaataaaagtaaaagaagaaaaaggtaagttgatttgcaataaaatattggttaacaaaggcagtaatgaaaatgtttaacagtagtgaagatttaatcaggactatggaaagcacacatgaaaattctctccaaatgcagatggaaggtatggagaacatggcacccaagtaaataacagagcttgaagaatgagctgtcatttaagaatcaaatt

SEQ ID NO: 6240 - DNA, 384 bp, mus musculus
aaagacaaacaaaagaaagagaaataaatattagtatgacatttacaaaataaattacggtattagcacagtttgtctatttctgggtcttctctgtctaggcgcacattggtaggactgaacttcccaggacccatgatgtttagcaaaaccataaatgtgagtgtaagttacctgggtcacttccagactgagatcttaagcaccaaaagatgttttaccataccatctctcacagtcagcaaggctatcgatggttgctgcttggtcagtctggatccaatagacaggaagacagatagcaaagcccaaaagaaaccttcaatgaacatgtatcacaagacatttttaaaaagctttttttgtgtttttatgccaaagata

SEQ ID NO: 6241 - DNA, 297 bp, mus musculus
tctctgtctaggcgcacattggtaggactgaacttcccaggacccatgatgtttagcaaaaccataaatgtgagtgtaagttacctgggtcacttccagactgagatcttaagcaccaaaagatgttttaccataccatctctcacagtcagcaaggctatcgatggttgctgcttggtcagtctggatccaatagacaggaagacagatagcaaagcccaaaagaaaccttcaatgaacatgtatcacaagacatttttaaaaagctttttttgtgtttttatgccaaagatattc

SEQ ID NO: 6242 - DNA, 1282 bp, mus musculus
ttcggatatgaggtgagttaagaatattgcagatggaatagcatacgcaaagacttgtggcaggacagaacatggcacatgcaagaaacttaaccaattcctctgctactgaggggagagaccattgagggcagggatgtgaaagggttctagggcctattaggatctgatggcgtcattctaagagcaaagtgaaaccagtagagaacctcagatatgagtctatggaggttagggatagtaataagatttacattttaaaaagatttagtatcattgcagcgtgagaaatgaattagaatggagccagggggagtcactgatcgtttgaaaggcattgcagtactccagatgattaagaaaaataatgagtaggacatataaaattagaataaaaacctgaataagatatagatgtcaagcttgacaccctaatatacttactggaagatgaagagaattacacaaaaagtaaatgagtctgatcaacagatttgagtattcttgaatctaaagtgggaaatcattaccaaaaatagtcattggagcatattatcagtcccttaatctcaaaaggaaagatatagtataaggtaatgccttctgcctagaagatctgaaccagaaagtatcagctgataattattatactgttttatttagatctctatggactccaaaataaagaaatgtctgatgttagaggtattggatcttatcactgaagtctcaaatcaaatatcacctcctctaagagatttctttgactactcctcgtatgacaccaacttcatatttgctctatgaaatcaacacatgtaataatctcgaccccctagtagaatacaagttctgggagggcaggatcatcatgtgtttttaaatgctccacctcagtacctagagcagagtaagtgctcaataaatacctgtaaaatgtatgagtgaataatttcataggtgcaagagaagagagaataacagaaagatttcacttatcgatgcccctaaattttgagaaaaactaaacaaaaacaaaggtagagaaaaaggctgagtaatgcctttcaatatatttatagattctttcctcaaaagagctcaccttttcagagataacagccttattatccattacacatcaatgtgtacattggcattcagtatggaaattccatatgcatgtagtccatttcataaattttggtgtcatgctttacaattaataaatatttactaccaccattgtctacttcaaaagctgaggagcacatttaaggct

SEQ ID NO: 6243 - DNA, 334 bp, mus musculus
agaaaactctatggaaatttcttataaagttgaagagtaaatataagtttggtccagcaatttcactcctagctatgtacccaaaagaaatcgagctaatatccacagccaagacagatataacagtgatcatagcagctctattcataaaagccaaaatctttttgtaaactgcctattcacagacaaattgtggcatattcaaacaactattactcaacaataaaaatgtacaagctgatatttacaacaacatggatgaaaccagacacaaaagagtattaccacataattacatttatataaaattttaggacagcaaactaaactggta

SEQ ID NO: 6244 - DNA, 629 bp, mus musculus
gtggtctctattgtattcaaagaaatgactgttcatcctcatgcataaaatttaggatgagacactgtcttacaatttcctgctttctgactgtcctgatcgatgttttcagtcatgccactttttcacagtctgcgtggcacttctccaacaggaaatttacctcagatctgttcatgtcaccaatcctcctgtagctctagcttctctgctccaagttaaactgaaaactgccctgtcatttcttttaacctttgagtttgaggcagttctgagaacttctctcacagcaattgcttgttcctcctgggcaccatactataactaggcttaatcatagaattctagggttgaggaaccttgaaaagcactgtgacctctccaacactggccgcaaccactcacaaaccatcctcacacactgtagaggttgtgttgccttttaaagctccctctcagaattctatgctttaggattttctcctaaaaacaccaactgcaaatctaaatctgtcaacctttgtgctaaggtacacttccctttgctcttgctaaagtgggataggggagaaaattgatcactttctatactaacattttatgtccattttttgaaggccattactaaa

SEQ ID NO: 6245 - DNA, 1105 bp, mus musculus
tattattaagtgttattaaagtaaattgaaggcaaagcatgtaataaaaatttccctgcgacaaaagtctgaggtctatatgtggttccacagtgcttagaccatatttaactgtgaaagtaccaatattaacatgaaaatgtttttgctgctgctgcaatctggaatcaacaatgagtatgtgctgtttggcattccgtttttaattacatatcatatttcatactagatgttgaaattatatgccacaaaattttatatcacttaataggtgccaaaattacaaaagttaaaatattttcatttcatagaactcatgtagctaaagtttcatttcctaacagtaatattaaggacatattgatggaaatgaaatttttaaatgccaaacaaccatcgagacttccaggtctacattcatattttcaatcagttcctagttatttacatcagaagtaagtgatagaaagcatctgtcagtctgattctcaggtattttgaattacaataatcaagagattaagtcagaagaaaaaggagggtatccctagagattatatctctctaaataatagagaggattgagagggaagaggaaaaaagatagccaaagtgaaagtggggagggagtttataatttatgatgtaaaatattcaataacaactttaggatagcagaagaactggagagtttaggagggacttttgaaaaacccaagccagaaactccctttaacactctatgaaggaggtaggtacacgttagaattcacttttaattgtatttgttggccaaacacttttttcttttttgaatataattctctctggaaattgtgctacctgcggctctaagattcatttgggttacaaaggaatgtaattaactaaaaacacaaatgaattataagcttttcactttgtcaactgtgtaagctagaggtcctttcctttttgctatacaagtcaaaggaaaatagcctcctgttttgaaagcttaaatctaacattagcgtacaaaaccatatttgccaaattgaattaattgttagaattaatcaacactggggaaaacatagatgccgttaggcagtcatttttcaaa

SEQ ID NO: 6246 - DNA, 1062 bp, mus musculus
agttttattagatttcataatatacagtttttcatgtatcataatacatactgttcaggatacttctgtgtgggcctcattcaaagagattttattactgaagacctttgtttaatagatgtcaggagatagcctcatcatcaaggtatgtgcatttgcagggcagcattttagtcagactccaattatgttttgtgcccattttggaatgtctaaaaatgatagctgtttacatagagggtttattttatgcatcaaagatgatttttcttaacattatcagttctgaagtattttatagacttatgacatgttaattggtctttaaatattttatgtattttaaatgattgaaaaaattagatttatatcctaattgaattattaaatgattttgattagcaagcctaatttcagttgttttgtttgggaattctttgtgtttttatgagagactatggtgctgaagttaaataagcatatggttgatgctttgttgcttaaaggattttttttctctctttttttttaacaaggttcatttttttggaagagaataaattctcttggttgtattataattagaaataacagtgacagaaatatattatcagattgggttaaaattataaagcttggggtaatttttaatgtgttactttattgacacaaatattttgaaatataatgtaattatttactctttaataaataatgtattgattgcactttcactaaatttatccgtaaattacacattttcatcttgtcgcttaaaagcacaaaatattaaattataaatggaagaatcttgatgatgttactatttgtatgttaaataactcagaaaaagtaaaacagaatatgttactaaagctgattttctttccatcttcttctctggatttcatagatctaatagattttaaaaagataaatgagaattccttttttgattttttaaattacctttttacttcagtaataaagtgaccaaatttatatgttttttcctgagttttgattgtctttattttctaatgaggttgtacttttttaaac

SEQ ID NO: 6247 - DNA, 1265 bp, mus musculus
agaaaaaaatacgacagaaaactatagtttctttacagccttagaaaaggaaaacgcgtaatttctaactccaggaggacagtattcgagtacgtgggtttctttcacccccgacgtgcacttcaacttttaaaatgcttgctctggtggtccacagtactttcgcgttcactgggcggtaccatatctctcaatagatttgatccaaaaccccaagtgcgggagacaaagctaggtggaacgttattaaccctccacaactccaacctctactagcttcctcggagcaggcgaggcaccaggcccgtgagaaaacactgagatctggggcgtagctgtgacatggggtatttctggccgggatctcaccgggtaggctccacccgcgggttatcggctccctccaagaagcatctttgaactcctcccatgcaggccctattcctacaccagttctctttctggaatctctttggtactgtgtttcattaatcccacaaccatattcccacctattccctaacgacaacaaacttttaaggtccaggttaccgccgcgtctccctagcaaccgtgccctttaatggttgccggaagaggctataatcacgtgctccgaagacttccgggtttccaacgtgacttccggttgtcagaatttacccctgacgcggcggcggccgacgggaagctgtgtgtgcttaggtcgtggtggccccggtggtggtgggctccgggcgggctcgcgtcatcctgcccccgctgcgatgcatccgcggcgcccggacggatttgatggcttgggctaccggggtggtgcccgggacgagcagggctttggcggcgccttccctgcaaggtccttcagcaccgggtcggacctgggccactgggtgacgactcccccagatatccccggcagccgcaacctgcactggggcgagaagagcccgccctacggcgtgcccaccacctccaccccgtacgaaggccccacggaggaacccttttccagtggcggcggcggcagtgtgcaggggcagagcagtggtgagaagcatggggaccgacacagggatgaggggttactggggccgcggcttgcggcctgcagaccccggaagcggcgcagaggatcccgcctcctattccttctcatcctatcgcgcgccacaccctttgccctcctttggtcctctgcccctgaggctggcctcctcttcctcacaaacgaattctcctggatcaactccaaaaaagacatc

SEQ ID NO: 6248 - DNA, 2061 bp, mus musculus
aacatagcacctaggtttcttttctagctcagaggttttcaaactcttttgcttttatatcccctataagaattgtattaaagtatgtactgtcatgtaatttttatgaatagtaatgtttttcatcatatatttaaacactttaaaggatgtaatttggggcatattataaatgttttcatgttaaaatgaaagttgaatttctcccataatgtatatagttgaatctaaacaccatgaaaatggataacccaccatcattccatttttaaaaacaaatactatgttgaataggagtggtgagagagggcatccctgtcttgtgccagttttcaaagggaatgcttccagtttttgcccattcagtatgatattgactgtgggtttgtcatagatagctcttattattttgagatatgtcccatcaatacctaatttattgagagtttttagcatgaagggcttttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcagtgttcatcaaggatattggtctaaaattctcttttttggttgtgtctctgcccagctttggtatcaggatgatgctggcctcataaaatgagttagggaggattccctttttttctattgattggaatagtttcagaaagtataataaaaaaaaatgcaaacacccccagagtgttgcattctttaaaaaacaaaacaaaacaaaacaaatacttccgtaacttttaggaatctgactttctttttctacttgaacttaaatttttattcaacttcctccaaagatctttaccttaatgtaacataattttgtttgaaaatactgcttacgctatcacatgtatccgcaattgaaatatacctaaattcaattttttacttttattttgttaccataaagctctgaacattaaaaaaatttatgcaattgaattattatcaatacactactgattaaacaaacatattattaaacacaaaaagtaaaattatattgcaaatgcatcctttaatgagatgataaacttttttcagttagttcctttatctgtaaatgaacattacttactgctgaaataaggggtcagtatcaattctatttctatttttttttttttgtttttatagatgtaagttgaaggaattgagagtgttttattatagcaatgtaattcagttctttgaattccttctatgttatatgtcaacatttgtgtaatggtctattagcaaaaatatttttaatcttcgggcacatgacaatttgataaagtccttcttcatttcttttaaacagtgaactaggaagcacctgactagcaaagagatttgttctccagcaatttgaataatttactttctcaatttctgggaagtataccaagagagctttactaagattcatcaaattattgttaattgtgctgtaacacttgtacttaggcccaccttttaaaacccgtatcaccagaaatggcaggaaaatcaaacaaatttttagttttattacatgtttgccaaaacaatgctttttgataaaatgctttgatcttatttcttgttttaaatgtattgccactaatttggagttgcagatttagctcatttatgaaaaatatctgtcataaaacctcattggcagggccagtcttcactgtcaaaccagtcagccaaatcagatacactttctgtgagaaaaagtttttcattcttcaattcaaatagctattttgaggaatattataaaaatcaatgagaactaaaagtatatcttatgaaactgatcactaaaaacaattaagataaagatctaatataattgatttttccatgtttaagttataaaaacaagatgaccaatacactatttctcatataaagc

SEQ ID NO: 6249 - DNA, 1003 bp, mus musculus
gttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagc

SEQ ID NO: 6250 - DNA, 1003 bp, mus musculus; identical to SEQ ID NO: 6249

SEQ ID NO: 6251 - DNA, 1280 bp, mus musculus
catggtatatttgggaaagtaaaaaatgctgatggataaatgaagtttgaggcaaataggataggaaatgagaccagagacagaagcaaaagagagatttgaaggcactgtaaatcttgttagaagttcagattctgtctcaaggccagtggggagtattatgatttggtttctctagcctgcagagtgaaagatagattggagggggcaagactagagcagctgtcaacctatatatcagagagaggctctctaaaagaaaataatatttattcaggaatgggcattgccatgggaataaatgtaccatggtaaactatatgtgcattcaggaaggtaaagggagacaaaggtttttaaaggaaaaatgaggagaattgcatacttgttttgagacaattatccttggctattacaaagatcaataacaagggtgatgtcagtctaagtttggacatgcatttgcagggaagatgtccttatagaagtatttttgtaaggatgctgtggcctttttgcaaggtagcttttgcagaatcttctgtgatagttttttttgttatcaggcacaaaagcatgagacagctttatgacattccccagctctatttgtcatgtgttggtttggtgtttgtttttgctttttaacacaagtgactccattttgattctgacagtttgtacacagggagcccagttgagcacatgctacaataatttgggagtgagttaatgtaaccaaggtgagggtgatggcatggaatgatacagaaataaaagaatgaagatatttaggagataggaatagtagtacttagggcataatttactgggagtagagagaaaggtaggagtgaaggacagttcccaggcaatggggtggatattgaagttgggaacattgatggcacagcaactcatggggaaagatgatgtattcattagggacagactgagtttgagctttaagacattaaagtttggagctcagctactgaaactccgttatcttctgtcctgtggggccttgcattgtcttgtgagggctgagtggaaatctcctgctgttcctcactgattaccaggtacttgttctgatgattcacctacactagagaatgaaagacagaaaacagagatgttggagaaggggtagcagggttagaaaggataacaagagggacagccaatagaaagagaatgtaggaattacctaatagaacagtttttgtcctccttctgacctttctacaaccccccaagtccagctattaagaacg

SEQ ID NO: 6252 - DNA, 642 bp, mus musculus
gatttggaaactgcttaaatgcaggttcctgttacttgctaataaaagcatttctaattattcacctcagagtgaaaatgactcagaactcactctatctgaagagaaatagaagtgtgttaaactaactaaagaagtgatttccccagaacaattcttgctcatgacagaaaggaaggcaactgtgaaggagtatagatgttggagtaaacagttgtgagagcaggttcattggcaaaggagaagagagaagagcaattgtctttctttttttccacaagttaattcgttgagcttttttttttttttttttttgagacagagtctcactgtatcgcctaggctggagtgcagtggccagatctaggctcactgcgacccctgctgcccaggttcaagcaattctcctgcctcagtctcctgagtagctgggattacaagcacctgccaccacgcctgactaatttttgtattttcagtagagatggggtttcaccgtcttggccaggctggtcttgaactactgacctcgtgatccacccaccttggcctcccaaagtgctgggattacaggcatgagccaccacacccagcctcattgagcttttaatcaaataattttcatgctctgagttattaatt

SEQ ID NO: 6253 - DNA, 344 bp, mus musculus
ttagactttgttactaaatagctgtgtgccctgagaccaaaacatttcacctccctggccttcctgcatttatgtacaaaataaagggttaagctgtcctactatccagttccaaaataactctgtattatatttttgacaaataatagagaataaggtgaaggaccagtggtggcactggtatgtagtaaaaacagtacagggtttgttatcacactgtcttgacacttaggaagttgctagaggatgtcaagcagattacttaactgattgaggctcaaattctgatctgaaaattggaacaatagtaggtgcctcacaaggtttttctggaaattaaatat

SEQ ID NO: 6254 - DNA, 1360 bp, mus musculus
attagaatctgaccgtcagaatagtatggaaagtgggacgattgagatgaagacagtgctggtagggggatcaacccaatgtggctgctgaagggggatgtatgccaggaatcaatgaatgaggatctttggcctgaggtcgcatgctcatgaccttgcacttctatcgggtccttttgttgaatcagaatgcctgggacttgtaggaacaatcagtaaaagatgaaggacaactttgatacctaagagaggagcacagaccattgctttcctagtgctgcagagggacaccacccagaaccgatgagtgcagtacgctctacccaggcatagaatggagttctccagtggctactaactcttggactaacatgtccctgtgaagagatgaagccttgccaagttcaaagacaaaggtctaagaaagagtgtcaggataaatgcaaagtaaagctgaaatccttgcacaggctgagcagacatagagttctagcgtgtggtgcaatcaatgtaccctcacagttacagacccagtctacctaatgaggtctaaacttcaagtatggaggatctgaccaaagtccagtgagccagcttgagcgtatgcgtgtgatttaaaatttacaagatttatcttaatgtcatttctgagtgcctgggtcaggtctgcccttgttggaatctgaagagatctaatttggatatccaccatttcatacccaagtttggaatggccggcacttacttcaagaaataaaattgtaagatgcaagtattatttcttggttacagttatgctgtgtccagtttatatacattcagaggccagtgcattcacatattcatttttggggggtttggggtggggaatggagtagagactggttatactattttgtcatgcagagtctgctgccctatgctctgaaagagggacagtttccagtttccttaacattgtaacgcctcaggcagtatatgaagtccacctggagtttgtggtaaagcaaatttttataatatctctacttctttgtccttggtggtgagttttgcttcaagctagttctaaaattcaacaagaatgtcccaatatttcctaacagagagagaaagcatgcaagtggtttgaatttggagcatattttctattttatcacctttaatgagagagtcagagcctgtcagtcatgtgattgactggctgccttcaatatgttttccagggaatttaagaagtgcagtattttcttttctctgttgccagtatcagtgacactaaatatttaattactaactagggctgcagtagctgctcctcaggagtgatgaataacgagcccctgtatatttgtgaact

SEQ ID NO: 6255 - DNA, 1008 bp, mus musculus
acgtgatgattcacattacctcaaagctggaaggaagttacatgtgtggtgttcatgcccttttagatgggggcatattcaacagtctgccattcactcatgttgctccctctttctatttgcatacttgtctgtcccctgcagatagttgcacgtgagaccacaattctaaagactgggaccccttcccaaggtagatggttaatgtgtttgcctaattggaaacatcatttgcccacctctattctgctgtgtgccctgagcagctgatgtgcacagatggcatctcttgggctccctttccactgtggcttcaggttgttctcaccaatgggagccattggcaagaaatcagagggcaggaggaaaaacagtttggggaatattttctccactctttcccagtttcagcatcacagctatgaaagtggctgcatccctctgtaatcacagctcccctgagctatcactggtctctagcagcttaatattctcccctttcccttttaggctgttactaaattttggatacctccacagtattctttgggttttcagaaacctgacctcactactgtatgctgtcccttcattaaaatatcttcagctaattcacctgatcgaaattctgtttattggcaaggtcctgactaatattaataataatagagccacgcttctctcagcagtcatttgtcaaaccctcttttcactttagggaaacaaaaaaatctttctattctgagctgcttttaccttcactgctgatcatgatccagtcctgttttcccacttagctgaccatgtgcactactgaggcctaatctgctgccttgctttggtttacactgtctgcttcaacctgacagcagattgattgactactgggccaagagactccttgctgggctctcaggttacccactgtacttggcaaggcttcaagtgaccataatgagtttcccatccaccagctgtagcccaacctgtcttgcttgcaataagcaa

SEQ ID NO: 6256 - DNA, 535 bp, mus musculus
tcccctttccctgtggttacttaagagcaatgagaatttcaggaagcctatggtctctctctgtggccaccagcacatgattaatataattgatcacttatgcttagcaaaatgcataaagggtagtatcctcatgagaacttttggttgctcacgctctactagaatctttgggctgccacaaatgaaatccaggacgtttgtttctaggttttatgcccctttgaaaaattcaaagccaggtaactaagatgatgtaaagcaacctcagagagaatccttctcactctgtaacagttgtgttctttgcaggagacatacagctgatactctttgtttaggttttatcttcattctccaatgtctctctcactgggatctgcagatctaaaaggagacaaatcaaattctacattgggggaaggtgtgctcagccacaacatagtactaatttcatttagatgggcaataatcatctattgagatcttcccaccaagaaccgtggctgtctgagaccaggaagatgcagcagga

SEQ ID NO: 6257 - DNA, 676 bp, mus musculus
gggcgggcctctctactcgaaggtgaccacgtttagattctgagacgggaagtggagggtgaataggtcaaggcggcctttttttttagtttaacttttccttttttgctgtctagtcatcctcgtcggtcttctgcttcttggtatcgacatcgtcatcctcatcatcttcagctgcccgcttgcccgtagctgtctcagcttcctcatcttcatctccatcctcttcctcaccatcaccttcttcctcctcctcttcctccccaccttcttcctcttcttcatctacctcattgtcagcctcctgctccccattttcctcattagcattcccgttagcaggggcgtctcttccattttctgcctcttccacaacttccttcttctcctgtaagtccttggtggtgatttcggagctggtgtctacggctgcgtctgacatggtggggcacgccggtgatccgatgcaggcgattaaaaagaaagcgagagttcagggactctggcgataaagctgccggagtccgcggcggcggaggaggcgcgtggcggaggcggctgcggcgagcaaggaggctgccgcgagcaaggaggctgccgcgagcaaggaggctgccgcgagcaaggaggcggacgaggaacaatgcaaagatggcttttcagagcagccagtggg

SEQ ID NO: 6258 - DNA, 885 bp, mus musculus
tcattaaaaatggctgactctaacaatatgtacaaaaatataaaatgtaaataaaaaatacaaacaaatttcctttttaaagtacttttaagaaaaaaagcagggccttggaagttttggttcttttttcctcccctgttgcaaattctcatggtttgggttgggtggtggagagcgcgtgtcatctgcgggtggcactgtccacggtgggcgggcgggcctctctactcgaaggtgaccacgtttagattctgagacgggaagtggagggtgaataggtcaaggcggcctttttttttagtttaacttttccttttttgctgtctagtcatcctcgtcggtcttctgcttcttggtatcgacatcgtcatcctcatcatcttcagctgcccgcttgcccgtagctgtctcagcttcctcatcttcatctccatcctcttcctcaccatcaccttcttcctcctcctcttcctccccaccttcttcctcttcttcatctacctcattgtcagcctcctgctccccattttcctcattagcattcccgttagcaggggcgtctcttccattttctgcctcttccacaacttccttcttctcctgtaagtccttggtggtgatttcggagctggtgtctacggctgcgtctgacatggtggggcacgccggtgatccgatgcaggcgattaaaaagaaagcgagagttcagggactctggcgataaagctgccggagtccgcggcggcggaggaggcgcgtggcggaggcggctgcggcgagcaaggaggctgccgcgagcaaggaggctgccgcgagcaaggaggctgccgcgagcaaggaggcggacgaggaacaatgcaaagatggcttttcagagcagccagt

SEQ ID NO: 6259 - DNA, 1004 bp, mus musculus
taccttttgctgcttaagaactgtcctgaggccagtgtggtggttcacgcctctaatcccagcattttgggaggtcgaggcaggcagatcacctgaggccaggaattcaagaccagcctgaccaacatggagaaaccttgtctctactaaaaatacaaaaaattagccaggcgtagtggcacatgcctataatctcaggtgtttgggaggctgaggcaggagaatcacttgaacccaggaggcagaggttgcggtgagccaagatcgcaccattacactccaacctgggcaacaagagcaaaactccgcgcccaccccccgccaaaaaaaaaaaaaaaactgtcctgaaacattagtggcttaaaaagccatcatttattttgcttataattctgtgagttggttcattagttctttggtttgggccagctatactaatgtctggactctctcattcatctttggtcaactggtgggttagtcaggttctagatgatctaagaaggcatcatttacatttctggtggttggcgcatgttgacagcactgacaggagaatctgggtcatatgtatctcatcctccagcaggcaagcctaatatatttgtctggattcaccaaagaaacagaatcagtaggatgtatgtgtgtgtgtgtgtgtgtgtgtgtgtatatatatatgtgtgtgtgtatatatatatatgtgtgtatatatatatgtgtgtgtatatatatatatgtgtgtgtgtatatatatatatatatatataatgagagagagatttattataaggaattgttttatgtggttttggaggctgaaaagtcccaagatctgcagttggcaagttggacacccaggagagctgatggtgtagttccggtccaaatcagaaggcctgagaaccaggagagctataatttaagttcaggtcagaaagtcagcaggctgaagacccaaaaagagctgatgttttagttcaagtctgaagacaggaaaagca

SEQ ID NO: 6260 - DNA, 411 bp, mus musculus
atttccttctgcataaagtgagaatcacactggagtacttaataaataagttggtaatacctcataaaagtgctgtttttgatctttaaaagggccacagttgaacccctgtgaaaataagagaaaagaaaaaaggggagggggcacagagtagcaatactgatgtccttcaataggtaaatggataaactaactgtggtacattcatgcaaagataaaaggaaatgagctacaaagtcatgaaaagagatgggggaaatttaactgcagattgcttaaatacatgtcttaaatacacatctaaaaaagctacatactgtgcttccaactacatgaaaaggcaaaactatgaagacagtaaaaaacaaacaaacaaacaaaaaacagttgttgccaagggtttgaggcggg

SEQ ID NO: 6261 - DNA, 1338 bp, mus musculus
aattattatatccaagctttatgaggccttttttttgaaaaatgtttttctaaactgaaaatgaagaggataacatcttgaatgtaatccttgacagcttctattatggtttctgtcaccttttagtatacttcctaactgtgcgtactacagaaaatggcaaggaattaatcaggttgccaaaagagttgggttacacagcatgcagaaagcacttcagctacattatttgtacaatttctgtagggagttgtgcaatagaggccttaaatttaatatgtctggcccctttccacctggactcagttcaaacccattgcctgcagcttgctgaatccagagtgggaaatcagtcattatattaggaaccaatggcaaatgattccaattcacatttttcagctggtacattttttaacctagagcaacaccaaattggaaaattctgcaattctgcaagctgggcattagatctatattgcagtctaaatacatttctagtcttaagaagttgacaagatgatttttctttagaatttctttagttgatgtgccattgacagaaatttcaaggtctaccacatcatcaccttttgctggtcctttgtttttctcactgagggtaagtggtggtgtcagtgccataaactgcaataatctatgaaacattgactcgactcctttatgcctgtggccacattaggtaaattgaaaggccatatgcagcaaaatgaaactttcttggagattgttaaaaacaaacaaacaaacaaaaaattccaagcatagtgtctcttgcctgtaatcccagcactttgggaggctgaggtgggaagattgcttgagcccaggagtttgagatcagcatggacaacatagtgagaccccatatctaaaacataaaaataaaaaaaaaattagttgagcatggtggcacgtacctgtagccccagctactcaggaggccaaggtgggaggattgcttgaacccaggggactgaggctgtagtgtgttgtgatcatgccactgcattccagcctggacaacaaagtgaggccttgtctcataaaaataaattattttttattagtaagtaaacataaaggaaagtaatgctatatggaaaatgaaatgaagaagcaagtaatagaaaaagaaaggccaaccacctcttaaccatatgaatatatggtcaaacatgttggtagcaaggaaatgtaaaataaaatataaatgagatctcactttctattcttcacattgaaaactaatatcaagtgctggtgagaatatagggcaacatactttgctggtagaataaagaattgctacaacct

SEQ ID NO: 6262 - DNA, 670 bp, mus musculus
aaacatatttaaaatcctagtcaaaggaatcaagatcaaaaactctgatatataggaacagtatggagaattaaatcatatagtatgaaaaaaatgtaaacgcatcacctaaactgatgggctttctcaagaaaagcatcaaattgactttgtccctgatgtttccgagatgctcacggaaaacaagagcatttgctgccacttatcaagacttccagtttatgctttctaacaggcagcaaggacagcactgttgaaatgctgggttcaataaggactttgttcagtgtaatcctggggccagtaaattcaacagcgacagcataaagacataatttgatgctctttgctatagaactccacatatctctgcctgatgccctcggccactttatttatttgctacattccagagtcttagttattaagttgtgctttacactgtacaccccaaacactccatttgttcattcattcactcattcggcaattcaacaagcctatctcaagagcctacaaaatgccaggcactgttccaggggctaaagatagagcagggaacaaagcagacaaggcccagatctcctggagttttcaaaaatacaggggatgatgaatgataagtatcttcccaagctaagaaactaggggctgcacgaaggaaacaaaa

SEQ ID NO: 6263 - DNA, 298 bp, mus musculus
acttgagaattgcattgacttctatagaaattgcatttttccagcaaataatcttggatgaattctcgtctttataaaatttattcttctcattccagaatgacaagtatgtcttcactgaagttattatgttattgttcatgaaagttttatggtatctttcaaatatgtttttgagcaagagttttcatcaaatagttttagtattgttatggtgaaaacaattttctaagaatatttcctttgtgatatgtctgaatattttcaatctacgttttttaaataaaaaaattcttat

SEQ ID NO: 6264 - DNA, 304 bp, mus musculus
aataattttcctaaccagacctcagagaaaacacataacagtcaccacaattttttatttctacctaagatgcagaagaattatcagagaaaacaggtttggaggtctttgtatttttagttcaaatgtgtgtgtctctttaaggtagtatatgactatagccctccgctggaaaaaatatatatatatatgtatataggattaaaatgcaaggttgaagtgtccagtctgttaggggcttacaaatgtgacttttatgatttctataaaagcaagagaaaataaggtattttcctgcagaaaa

SEQ ID NO: 6265 - DNA, 1496 bp, mus musculus
actggaagcttgttggcatagggattagaggtctggtctctacgataagctagccacgatgttgagccttcaaccatcgataaaatcacttggaaatccagtatccctgttagagttggtttcagtgcccatgttgcatgctgctttgtcagggtcctcattaagactttcttcctcccaccttagacagcactgaccctctgttcaggctcacacagtcgctgtcacccaggcccacctgcagctgtgctgccactcaccaaagtctgagaggaactgctcccttaccaggacagtgagcactggcccaaccccactgtgctcctccatgtgtgtggggagtggcctccccaccccctgcccagagcaagaactgattctgggtcacccacccaggactagaacccagagctagtctgcctcactcctgaacaaccaccgctcccaccatgggctgggctcagcaccctgcttggggcttcgtggaatatgtggcatgggacctggcctcaggaagcttattctctatttggggggaaagtaacaagataatacaagacagcacagaatcctgttcatatttctgtggcacggtcttacggatgagaggagctcagaggagactaatatgggttaaatcaggtaggaaagactttgagaggccataagaacttgagcctgactttgaagggtgggtaagaaatagaatgggtgctcccaatggagggaacaccaggcaaagaaaggagtgagcatggcatgggcagaggccaggggagaccaatgtggcaacgcctttcagggactagcaaagatagcaggccggactgccctatgtgcaaattaccattcatataaatgactgataccctttactgagaacaaatgaggagagagagagagtaaatacaaagtgactgcatgcatgaatcaattaataaacgaaggtgtcgagcacctgaaggcaggttggaaaataggaaggaccagcaaaggtaggtgggggttggggaagccaagcactgacttcttggggatgtattatagatgtggttgagtagagactgctcctatcagggaaggtcacagaaaggtcccacttaaattactagttgagtccgctatattttgtatgaaatacatacataaaaagtatgaaaacagcctcttcttttgcataacctttgagaatttccccgatcaaatcctgcagctgggtgagcaactccctggctcgactctgtgtggcctccaggtccagggaccaagttttccccaggcttccttgcagcagctttctccctccttcatggctgacctgcacctctcccctccatggggggaaggtaggagtatgagctcagtgctggaagctgctgttctgggagagttgcttgtgccacaggagtcaaatgaacttttccccacgaggccggcccctctgctgatgctgtgtttgtaaaaccagtaaaggttttccttttgtgaaagagaga

SEQ ID NO: 6266 - DNA, 793 bp, mus musculus
ttccaaattgattttcaaaccaaaattggaacagttctcaaatgctcccaggatttggggctattaatacagaagaacaatgagaaggaaaaagtgagtgtgtaagaggtgatttatgactgaaaggaagttacagcctcggaaacttgtatgtaacccaatcacgaacccttctggagatgttccagggaagagatggagaatgtaaagggagagggtttccgagggatattaaaggttatgaaaggaggtaatgtgggttttgggcctgaaatgagcaaggaagaagctgatcatgttgaacatttcataaccacagcaggtttttgtgcagctgtcatcggtgcctgagacaccccatgagcctttccttttatttatttcttaccattagtccatcaccagacaggttaaatggcaggaagagagtgtccccacaagagtgtgagactgtgactgctgctcaaacccatggtctcgtctcaggtgtccagtcttcaacagtcaaggtcacagctctagctgctaatcagtaagaccagccatggccaagatggagtggaggttcacaggaaagtgtggttgggcagccagatcctggtcaggtgttctggaaatgaacacgtaacatcccctgtttttttcgtagtttttgcaaaagttatttattatttacagttttattggggtggaattgatatacaagaagttgtacatatttaaagtgtgcaatttgatgagtttagacaaatgtatatgccaatggaaccacaactacaatcaagattataaa

SEQ ID NO: 6267 - DNA, 570 bp, mus musculus
agccctctgtaccacaagggttgaaagtgtataaactacattttccagaccttcttgttagcagagatctggtttgggctcttcccatgggacaatgcttgggcacttaggggcagacagggaggaatgaacttcttcattcagtcctggcagcagtggcaccagcagatggctgcacacccatgaaggcagcagtggaggcttatggcctcctgcagcagccacctgggcagcacaggggctgaggggcatggaacagaaaagtgcaggctctggggtgggcagtgatttcctatagttctcatctgtggatcataccatgactctcttttgcttctccagccctcttgacaattttgtaacttaattctgtgtactaaatctctctctacttgaagtgtctagagtggtttctgcctttaagattaaattatgggctcaagaaaatccctaaaccccaactctatctcttcctagttctggtacttggataagttaatggacctttgccttattcacataatacctagctcaaaggtttgttgtacaaacttaatgctgcagtacata

SEQ ID NO: 6268 - DNA, 1307 bp, mus musculus
tcaggtgggccttggcatcttcttggggcagaaagctggggagtgagcagggaggaaagcatcaggcttggtggcagctgagatatgccttttgtttggcagggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtaaggtgggatggagggttggggtccctagcccagggcagccttgctggagcagaggaggactgcgtatgactatgaattgggcagagagccacagccagagaataaataattcattccatttaatgccaggcccaaagtctcatttcttccagtttatttctgcttttaatgtggtatactagaaaaaccaagagtataaatcaagtagtcagttacttctgtctgttcctccctttggggaagtctctcaactgtccgtattttcatctatacaatgggtatagaaaccttcatgacataatccaaaggtcactgtgagctctcaatgtaaaaaataccttaaaaatgtaagagacaatgaaaatcattctcattgagaaagtcacttgtcagtttctctaggataagttcagatttatactaagtgtcctagacaagaatattttggttataaataaactccagctaatgaaaaaaagaggcaagatttggggaatagaagaaaagataccaggatatttcatataacccaaagtcagacaggttggcctgctgggggattcagattaaggacaggaagccagtggcaggtgccctgactttacctccctctgtctggggggtgcacctgagtatggcagtcacagttaatgggaccagaagagacaggcccacatcgggagaacatacaactacaggcatagctggtatatcccaccgccaggaaaggaggatggctgctaatatgaaagtatttaagttatgtatgcatagacaatacacacacaacaaaaaacgtgggtattcagtgaaaggtaagtatgtgtgtatgggatttcaagatatgttcttaaaattactagtcaaaaggcatgtgccttttaaaatttgagcaattgacctcacctccaaagaggtggtaacaatttttactttcaccaaagatatatgagaatacctattctctatggcgttaccaa

SEQ ID NO: 6269 - DNA, 1398 bp, mus musculus
ctgcagtgctattattaatctcatggagcatggaaaaaatacaaactcagatctgtctgccccattttcatctgtgttgatgttcaggacagaggatcatagtgggtgatgccatcactgctgaattaaaaggcaaatttccctccagccatgatgtctctgtctttgtttcactccctttccctccatggtccccctggcctgctccaggactctactgtgaatcccacagattgtcatggaagggcagaagtgtgttacaactttgttttcttaacttcttttttttttttttggaacagagcagcactttccagaggtgatgctaggagaagaatttcttagcctgagtctggaccaggtgtgcagcttgatatccagcgacaagctgaccgtttcttcagaagagaaggtatgacatggctcactggggaaacgggaacctcactcgtcaggtggtcatgggaaggacttgtggtttggtgagatcttttcttttctttttttttgagatggagtcttgctctgtcggccaggctggagtgcgatggtgtgatctcggctcactgcaacctccgcctcccaggttcaagtgattcccctgcctcagcctcctgagtagctgggattataggcacccgccaccatgcccagctaattttttgtattttcagtagagacagggtttcaccatgttgaccagactggtcttgaactcctgacctcaggcaatccgcccgcctcagcctcccaaaatgctgggatgacaggtgtgagccaccatgcttggccaatcttttcttttctttcagagaaaaacaacagcttttttttttaatccctttaaaaataaaaattataaaaaggctttctggctcatgactgctacattctagactctttagagaagaaataacagtgatgatcatgatgacaaagctgccactatttactgaacacttacagtttgccaaacactatgctaagtgctttatgttcttgggctcattccacctctaccatacccctgtgaagcagacattactattgtccctgcattacagaagaggaagcaaattcagattcctcttctaccagtaaaaatttctttatgccagtagatgtagtctactatagtgaaaatagcataagcttcagtgttggccagcaggtccaaatctcagctccagtatttacaaattagttatgtgaccttgggtgaggtactttgcctctcctgtgtttcctcattttgtaaagtgaggataatagtattagaacatattccatagggcaattaattgggataatatatgtaaaatgcatggtatagtccttggtacctagtaggtgttcaatcagtattagcccagtttattatttaccctgcacctggaa

SEQ ID NO: 6270 - DNA, 1398 bp, mus musculus; identical to SEQ ID NO: 6269

SEQ ID NO: 6271 - DNA, 1398 bp, mus musculus; identical to SEQ ID NO: 6269

SEQ ID NO: 6272 - DNA, 1261 bp, mus musculus
gtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattccc

SEQ ID NO: 6273 - DNA, 1261 bp, mus musculus; identical to SEQ ID NO: 6272

SEQ ID NO: 6274 - DNA, 1261 bp, mus musculus; identical to SEQ ID NO: 6272

SEQ ID NO: 6275 - DNA, 1261 bp, mus musculus; identical to SEQ ID NO: 6272

SEQ ID NO: 6276 - DNA, 1261 bp, mus musculus; identical to SEQ ID NO: 6272

SEQ ID NO: 6277 - DNA, 1261 bp, mus musculus; identical to SEQ ID NO: 6272

SEQ ID NO: 6278 - DNA, 1261 bp, mus musculus; identical to SEQ ID NO: 6272

SEQ ID NO: 6279 - DNA, 1261 bp, mus musculus; identical to SEQ ID NO: 6272

SEQ ID NO: 6280 - DNA, 1261 bp, mus musculus; identical to SEQ ID NO: 6272

SEQ ID NO: 6281 - DNA, 1200 bp, mus musculus
aaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcc

SEQ ID NO: 6282 - DNA, 1200 bp, mus musculus; identical to SEQ ID NO: 6281

SEQ ID NO: 6283 - DNA, 1200 bp, mus musculus; identical to SEQ ID NO: 6281

SEQ ID NO: 6284 - DNA, 1200 bp, mus musculus; identical to SEQ ID NO: 6281

SEQ ID NO: 6285 - DNA, 1200 bp, mus musculus; identical to SEQ ID NO: 6281

SEQ ID NO: 6286 - DNA, 1200 bp, mus musculus; identical to SEQ ID NO: 6281

SEQ ID NO: 6287 - DNA, 1200 bp, mus musculus; identical to SEQ ID NO: 6281

SEQ ID NO: 6288 - DNA, 1200 bp, mus musculus; identical to SEQ ID NO: 6281

SEQ ID NO: 6289 - DNA, 1200 bp, mus musculus; identical to SEQ ID NO: 6281

SEQ ID NO: 6290 - DNA, 1200 bp, mus musculus; identical to SEQ ID NO: 6281

SEQ ID NO: 6291 - DNA, 1200 bp, mus musculus; identical to SEQ ID NO: 6281

SEQ ID NO: 6292 - DNA, 500 bp, mus musculus
gaggttatgagctttggacagaagcgtatttgaaacgggtatttctgtttttctttaactgtattactgtgaaactgttacagctccctaatacccagtttttctatctttaaatgatttctactctggagtccgaaggttagaggagatatggcctataagtgattaccatagtgcctgccataagtccattttttttttaaatctaccctacagggatttcaaagtgggtacagagatagaggaattaaagttgatttgagttaggagagagttagacctgaatctaaagttgtaaacgttttgttaccacaaaccaagagggtggaagtgcaaaattaggctaatgataaggcaagcgtcacccctcatggaaaaaaagccagattttatagcacccagaatctcaagtagacctcaattaccaagaaattgtatgatcatctgtaagtcatcatagaaaacagaggacattttggttgtaatttcaggttttgttc

SEQ ID NO: 6293 - DNA, 1992 bp, mus musculus
tcatgaacatattgatgaagatttccaggttagcaaatacatagctcagttccttgaagggctgacaatcttgtttgttattttctattgcacagttgtaggctgtactccaagtatcacaaatgggcaccactagtaacagatagaaccgagaaatgtgtagatggcttcttgtaaaccctttattacctttagaaaagctcagattcatgacctatatagagtagttaatttgagtgtttgtatataaaatcacaaactacagatgtttctcaacttacaatgaggttatggtttctaccaaatttatattatttttgcactcgtaaagtcaaaatattttatgttgagtcatcactaattggagactgtctatattagaacagaagaccctttgacataatctaagctgaatttttctcttagagatgaggaaacaaggcctagagatagaagagtgcctttaagggacccagcaaacaagaggcaggttggtttagttgaaatgaaaatctgtttttccttctatctctttgtctgacaagcccttctactagtttctgcttctttagtcaaaggctttcagagaacccatcttttcttccccaatgggaaggaaattaatggatgtgggaatatatctggagaccccctttccccacctcaaatgttagccttgacttagttacttaaagccactgacccaagcctcctaatgaagcatggctcactctagaaggtattgtttatggacctgaagccttgagaagatgaacagtatcagtgctcagagctggcttatcagcaggtatcccagtcaagctgacagcaggacctgttactctcttacctttgtttcttagtctttcaaatccattagcatagggcatcatttgatatatttctgtcttttccttctagagttcaagtgctatttacagtgagtcttttgtaacttcacatcctaaggatatcagagcattttggggtactgcattagttagaattaaactaagccatatgggtcccctaggaacagtggtaaatcttggcagaaatgtttatctttttattaacagaaagattagtttgggtctttatgctacttattttaagcaactgtcaagcctgaagatcttaagagcttcctgcttgggaagagacttaataagaattatagttaaggtttgggatagatcaagagtcttagaaacaaatgctgactccctgttgatagagaaatcattttaagctctctcaacctctgctttccattgtataggtcagaattgcatgtcttgtcaggattgttgtacagaagatatggaatagtgccagagaactgggtaagaagctgacatcttttccagtcttcaatgagcatccatttgtgttgggacagtctggggaaaatataggatgcgtcctccctaccctcagttcagctttgagtgtttcttcaaaaggattttatatttgtcaactcacttgacattcccactatcaggtaaacatgtaagagaaaacagactttttcaggatcaccatgcacgtaattgggatacctacattttggtcctagctaggttttggtctagcccatctgaacttgaaaaagtgatcttcaaaaaatacaaaagaatgatgttgatccccaacttaaaatccttcatttgagagtggtgtgggaccacctgcccatttcttcgacctaattttttgccatcatccccctcaaccaaagcatgtcagcaacagaggagttattccattgctctgacttgcttttttttttttcctgcctcatggtcattacacatgcagctccttcagcctataatgttctttgccctgtggctttgcgaaactgcctatttttcatatttcagttcttagcttaagtgtctcttgcttaaagactttcccctgaattctacctaaagcaatatactgtagtattttctgtttcagtctttggtttggcaccttaac

SEQ ID NO: 6294 - DNA, 2921 bp, mus musculus
tggaaaatgcatctcattatttaaggctataacagtggtggtggaattgtgggagttttactgagtgagcaatgaccctcaccctcagtttcttactgttaaatgagggaataggtttttcaactgtgttgtgtagagctgtagccccctatctatcacaaacaacttgagatgttttagaagtgtgtttccagagccaggcatggtggcccatgcttgtaatcccagcactttgggaagctgaggtgggcagatcacctgaggtcaggattttgagacgagcctggccaacatggtgaaaacccatctctactaaaaatacaaaaaataaccaggcatggtggcgcatgcctgtaatcccagctattcatgaggctgaggcacaagagttgcttgcaacacaggaggttgcagtgagccaagatcacaccactgaaatccagtctgggcaatagagtgagactccatttcaagaaaaaaggaaaagtgtttccagggccaggcatggtgactcacacctgtaatcccagcactttgggaggcagaggctagccaatcacttgagcctatgagttcaagaccagcctgggcaacatagtgagaccttatctatctctacaaaaaaaaaaattagctgagcatggtggtctgtgcctatagtcccaactatttgggaggctgaggcgggaggatggcttgagcccaggaagccaagacagcaatgagccaagattgcaccattgcactccagcctgggagacagagtgagacccgtctcaaaaaatgtaaaaaataaaaataaataaaaaataaaattgtatcttcaatcaccgcaccaatcctagaacttagttattatcaccctccttttgtatgtgtggaaactaagactagagagactttgtattgatggcagcagttgctaactaactcccagctacagccaggaggcacagctggggctgcacactccgtggagctccctgggtgccactgtagccacccaaatcatgactacagacccaggcctcctgctctacggagcaggcaggagtccatcctcctggccaggggctacagccaaccaaactgtggctgtgcatcccaccctccctgtcctctttcaggggggcaggaacaggcagtatctgccctcctggatgcagctgaaactctctgacccatggctgcagacctgggcctcccactttgtggagtgggcaggagccagagacaagcaggaaccctacccctcctgagtttgtggaactggagctccctgggtacagctgtggccaccctctcaggcatctctgcagtctgcaccctcaggggcccaagaaggccccctcctctgtcccagcaggctcgggttatctgcttccactgcctggcctctcttctaccctggtgcccactcagtcttggagcagggttggggccaagctgcagggccttgaatggcagcaggaggcagagtcctggatgggcaaggttgggtccccagtaaggcccaccttcaggccaggaagggcctgatggctgagggctgggctgccagtcctgtagactggagcggggacccatgatgcctcttctgggcctgcccgtggccacccatgagccaattggcatgcacttcctccactctgaggtccataaaagccctgggctcagccagagcagggcagaagacagccagagaatgaagagggcagagaaatgatgggaccactagctgcagagaggagtaccctctctgatgatagctggagaggatgggatgaccagccgcagagaggagctactccctctgctgagagctgcagaggtgacctgctggcagagaggagccactctctctagagcctcctctctgctgagaggatattgggatgaacagttgcagagaggagctaccctctccagggcctcctctctactgagaactaaacacctaaagatgacctgcttacagagaagatctactcactgctgatctcctctgaactgttgtaacacttaataaagctcatcttcatcttgttcacccttcacttgtctgtgtacctcattctcctggatgcaggacaagaactcaagcaaaggcatgagcagccacagaggtttccgggaagaaaatcgacaccccaaagattctgtaacattatcttgtccaaggtcatagagtgtgtaggaaacaaagccagcagcaaattcagaacccctgtttttccttgcactctgccactggacccaacgttgtcaaatttcagtaatttattgcagtgttgctttctctttccactgctgtcttgtgtcctatgagaatctgacttaggcttgccttcattgcatgctgacagtttttctcacctagcagctatcatctcaggactcagtgtcaactaactctaatctgagtatactcacattctggaagctatcatatagaggaacacaacctacattcttaacatagggtgtctaatagtggcaggaaggtcaagggaatttgggggtgtatgtggcctttatccctacccaaatcctatcatgtaggcaacctctacctattccataaacagaattagatggttccaggggaactgcagagagcttcttgccatacatcgtgtcctagagctttcaattttgaatggaagtggcagacactggggctttctctcctaggaggacaagggtcactgcaaggcatcagtagctccagaaaaggaaaaaagttgatggagatcagctgtcttttcccatctcctcattagacgagcacttccatagataggagtttatgcagcattttcctgaacagcaacttacaagcatgcaagagatattttggttgactcatttgtcacccccataaaaataagtaccctctgtgttgaagggcataagccagg

SEQ ID NO: 6295 - DNA, 260 bp, mus musculus
gccaataagtttggatttcaacctatagatgatgggggagaacaaacacaattgcaaattaaaagaaactctaccatagtcatcattagaatggtttttaaaggtttcattattcatattcttgatttattctcaatttgaggttactttactgatgaaaaagttctaagttgtccatctaaaaatggtttatgtcaaatgacgttgccaaagcaaatgctattatgaaagtgaaaatataatctcagcaggcgtttatt

SEQ ID NO: 6296 - DNA, 260 bp, mus musculus; identical to SEQ ID NO: 6295

SEQ ID NO: 6297 - DNA, 1817 bp, mus musculus
gtaacacaggctaatttctgtctttgacttcagctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcagtgagttttggatgattatatgtgctccataaggaaagatactatttgtcacgtgttcacaatgccccatgcactgtggggtaggtggttgacaagcatcatctcttttattctgcatccaaaaacaaaatacgatgtagatactgttatctgcattttaaggaagaggaaattgagtcttagaaaagttaagcaacttgccccagatctcagatcttacagctagccgttcaaatccagatccactccactacagctgctctttactgcactttgattcagctgccagatagtttccatgatgaatcccagagcctaatcaagcataatattcatattcagaaccagggcttccttactaatggcaattattcccaaccaatccttccttagcatttgaaaagggacttctttcttagaatataaacccttccaaaatggacatctttttttttaattggcagatagggatttcaccataagtcatttcctttactatttattcattgaccaggcagcatgataaagtgtaatagaaccagagaacttgcttcaaaacttatggagggtttgtacttggtgggtggggtctagttcacatagggtggccaaggaaggcctctctgaggaggtgacatttagctgacaccaaaaggaaagatgtcagttgtgttaagagcagagggaagcatatgtgcgaagcacctgctaggagccgtgatctttgtgtggagcagtgccaggcctacagagcccaaccacacaccctagcatgtctctgcctcctcttatctagaagacctaattgaggaaggagtctttgtgaaactcactgctgtatccttcatgcacagtccagtggctggaacataatgggcgctcagtattcatggaataaacaagcaaattgagcatagagacaattgactgtaactgctccaagacatgtccgcaccaaaagctatgaaaagacaaaagaaagggcagtaaatagaaaatctatcatctcatccccagggagaggctcagcttagttccatgttcagtgcaaagtgagggattagcacagacagggtggtccttcaatgcatggcccataaccattaaagcagaggtcttctcactgtgcggtcccatctgattgttcagtgatgaggattctgagcatctctcagatcctgcaatacatgtggatctgagatgtggccattgataatgactgccttcccgaggcaccagcgtgagcacctgcggcagaggtgcctcacatttgccagccaggtgctcacagaagttaagtaactatccagtggactcacagctgatcaaaggtgcaagtgagatcataagccaaaaccactgaactccaaagccttattaggaaaataaagcatgtttatcctcttccacagtcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaa

SEQ ID NO: 6298 - DNA, 972 bp, mus musculus
ttcaacacctagtgaaaaaatgctaggattcaggctaccccaggaagagtgatggaatcatggatacagctcacgatattaagtcagatgcaacagcagctgttgacatctcgggggagccgtgaagtgggcacttgaactttgactgcactgaaatgatgtcacttgccaaagacagccatctaacctcaaaggctaaaaagtgcccggcacaggataccagagtggttcaattaatagcaagaaattttcatagaacagagaaagaaagacatcagaggctaaccagaagactaaggtggagagaggcaacagtagatcagagagttactgagaacaagtattaaggcgatcagccagcagcactaatggagggtcagaaggaattgatggttagttactagcaggccctgagcacagctggtagccgcaggaagagctggcagggtgagaggtaggagcagctaatcaaactgtctaatgggctgattagacaagcagtgggatcaaccaccaggggtaggcgattcaactgccagaggatcagagggacaggaaaggcaaagacagaacaaggtcagtcaggggcctgagtaaaagggaagatgattgggtggcagtctgatcagccagctgtgacagctcatcaaacaataaagggagccaactgtagtagtagcaaggagggccgaggggacggaacagtttacagagcgggataatctcgcagtcagaaaagctaatcaaagctgacaggagctcctcagagctaggggcgggactagtgaatttgcagccagtgcctttggtcaagggtttattttttcacatcataagcagagcatgcagctcagctgctttctctgctgtcccaaggctcaggggactgagatttgaagactcgttgacaaagtagggcagagatgccaagtcccagctcctataaatatggcagcctagaccaggagctga

SEQ ID NO: 6299 - DNA, 1020 bp, mus musculus
tgcactctagcctgtctctaaaaaaagaaacgagtgtcagataattctttctctccctcaatgttctcagcttcataatttgcaaatgaaattaactaatttttatgtgttgaagaagagatttaatatgttgcttctaaggtaatctcagatatcgtgacttttcaggttggtggacttttcaatactacagtccacctaggaagagttacatctctgaaattggaccaagtcacatgttcttgggtgtacttatttttgatctggatcttttatatttcacttacatgttcttgtaagtgaaatgatcttcaggaaatgttttgaatgaggaaatgaagtggagcagcaaccacctgcttgtgggtttgtatcgtatcacgaagggctgatgggccagtctggtgctccaagaatggcaatgacccatggcaaatgcctcggcagtggtggcagtagaatcctccctggccatggggccagctgtttctgactgcacaccatgtagtgagaagttcccttttcaacctggacattttctaggaaccacatgggctgttaattttacaatggcaaatataactgcagatggctgtgtgcaagattgggctgcaggataaacatgatgaggtacccactttctggggacaaaatggaaagctttatcttttctgttacacttatctcaacagcaattagaatcacaagctattgccaagtttcaggtacacttactgatatgtgatgagaaggatatgaaaagtttgttgtattcaacaaatgagcccttcctcgaataagccctcacatcatttttatcatcagcttgaactaatactttgctctacaccccctactttacttgacttttccccatgtaaatttgggcatgttaatccacaggcatttatttattatctactctgtgtgctttcctgtgcatttggaaatatcaagaaaaaatcaagtccgatcttcatccttaaggatcttgaaatcgaataagagctaagaataaaa

SEQ ID NO: 6300 - DNA, 288 bp, mus musculus
attcaagtgttcattccatatctattaaatatctaaaacgtctgaagcaagggagtagtgggtgtaggaaataaaaagagttacttttatgcagtagacagtcttgttggaaagacaagacgttaaacacacataactcagtatgcattgaaactatgtggaagatagtagatggttaggtgccaaaacaaatattagaaagtgaacagtaaaggaggtgagtgagaggagttacacatgtagataagagaagacaatagaattagaacaagattttgtaaaatgtgg

SEQ ID NO: 6301 - DNA, 289 bp, mus musculus
ttattgttagtgtttaaaagtttggtaccaagaatgccattcctgtcaatggattgtcattgtagcttgctgactatatctattcttttacatttttaacaaatattgagagcaacaaagagactctataaattcttctctacatataacatcctggataactgaaataaacagtaatttcttgagagatacacattcataatatttaatgtaggaaatgacaaggaagtagggagaggcagaaaataaagcatgtgcaacatcctaagttacctactaaatgtgttgg

SEQ ID NO: 6302 - DNA, 366 bp, mus musculus
tattatgtatttttgtaggttagaagtctgggtgtggactaactggacctctctgctcagggtttcatcagactgcaataaatgtgctgattggggatgcactttcatctgtggttcagagttcccatgcagtctcagtgggtgttggcagaattgatttccttccaggtgtatcagtagcaaccccatttgcttactggttgttctccgctactagaggcagcctagcctgctgttctgtgccatgtgaccctctccacagtgcagcacttggtacctcttaggccaacaagacagcatccaccacagcttttaatttctgactcttctcctctttgacctccaggtcctttttgtacaaagact

SEQ ID NO: 6303 - DNA, 563 bp, mus musculus
agaaatgaagcttgggctaagtatacaaataagtcaatgccctttgaaaagcaaaaaagaaacaatccagcctggcttgccctaatgaaggcagcaagacaaggtccaaaccatctgtaccaaaaacgtcacgaattcagatgtaacttaggtggtcattgcacctttaagtctcttcttttgggtaggtattgtgttttacatgaatttgcagaaagagatcacaatctaataaaagtctcaagtttaatcctgaaaaggaagcagatttatgtgtgaagctttctctgggctctaatttcctaatcacatatatattaatgctgatagaacttgtctttgagaggtacagctcttaccaatcttaggaagtggtaaaagattctgctacttcactctctttttacatttttggttcatatcagtatcctatcagagtttacattgccaatatgaatactggcatttgcaggaattatgacaaatgttagtggtttgggcagcaatgtgctaagaaatgtttaacaaatgactctccagaaaaaaaagtatgcacatatatg

SEQ ID NO: 6304 - DNA, 679 bp, mus musculus
acaaattataatgagtttggttaagtgtttagatataactttacataaaaggcatctgatatggtttggatgttttgttccctccaaatctcatattaaaatatgacctgcaatgttggaggtggtcctgtggagggagttggggggttggttgggtcatggggatggatccctcatgaatggcttaatgctgtcctcacggtaatgagtgacttctcactctataagatcacacaagacctggtggtttaaaagagtctggcaccctctccccctctctcatgccctttctcaccatgttacctacatggacttctgccatgattttaagcttcctgaggttctcacaagaagcagatgccagcattgtgtttcttgtacagcctgcagaatcatgggccaaagaaatctctttttgttataaattacctggtctcaggtattcctttatagcaatgcagaatgaactaacacagcatctctcaagtgctctgagtggatcttactaggatgtatgaccttaggagttaattgacctttcccaagcttcagtttctttacctacttaataaggaaaccaacggtgcctatgtcatggacttactaaaagaattaagtgacacaatgtttatatatcactgaaatataattgccaatatttagtagaactgttagtagc

SEQ ID NO: 6305 - DNA, 396 bp, mus musculus
atgataatcagctgtagagtgaataaataaattgtggtaaattcacccaatgcgatacagtatagaaatggaaagaagtgaactacagctatgcacaatgaaatgaatataaaggagggtgctttattatttcattagtaaaaaaatgaaaacaggcaaaaatcatagtgtttagataagtctaggtgtgtaaacaatagggaaaagcaaggaaatgatgatcaaaacaattactttggaaagggagggaagaagtataatggaaagagagcacaaggaggcttccaaggtgctggcaacgttccattgcttcaccaggaaggtggttatgtggatgtccattttgtaatacatcactgatctgtacatttttattttgatctctacatttgaaaa

SEQ ID NO: 6306 - DNA, 1026 bp, mus musculus
ctccttatgttgtgttcagtgctacctgaggccaaagatctttaaaggtgaacaaacttcagttttaaaaaaaaggatgcttaacaaatgaacaaatacaattataaagtacttgatgatgatgataacttctatgaagaaaataaaggagagtaatgggatagtaatggaggggaggactggataagggacaagatctgcaaaatctaaggagggtactccaggaaagtgtaaaagggaaaagtcagttgataaggagaaatcagtttgaagttgtcaggagcaggaagagcccgcagggccttgtggtgatccacacagcctgggaggaggtcaaacgattaagcaaggctggaccatttgagaactagtaagaccaccaaggagtctggatcttattcaaactataataggaagtcattggagggctgtaagtgagacagtgccatgatcagatagaatttttaagagtatattgactgtgtaggaagaaagtggggccaagggggccttgtagcagctcttcaggcaaaggtcaatggtactgtgggctaggatggcagccacagagttagtgaaaagttctcaaatacaagtgacttaagacatttctttttctgcttgattttattcttgtgagatgtaagactattgaacattttgtttagcgtttaaaagtgaatttctgactgattatctggccttgccaaaatgaaaggcacacaatggcatctgactatttttctgggcagctccagccacctctacctcagtacttcgggtgtaatcaataaacataacagaggctattcattccaccaggatggattccaacaaaaggcctctgttcacactggtaataggcagacttcacccgctccatcacattatgtattatgtctcgcactcttcagtcacctacctgctttactgttcagtggtaatgaaatgctctgttgacataagaatcattataaagctgagctgtttacacttgtggtggccaagacaatgtccctccaatgg

SEQ ID NO: 6307 - DNA, 1492 bp, mus musculus
caccgtcctgacccccaggagcacactcacccatggggtcaggctgctattagaaattccttccagagatgccaggtgagagggaggcaggcagacagacatctgtgggggtcacattcaccccagacagttcattgccggaaggaagccacatgcctcacgtcgaagctcatctgattggagtcagacacagccagatacagtcatgattgtgtccagaggcccacgggggctggcggggcccttcacgacagctgctacggcacagcccatctggaagggctctttttgttcaacgctttaaccctctgaggaccctcgggaccaagggatgccacaccctgggtgagagagatactcaaggaggagggtccctctacagaggatgagttaggacacccgggacgggcccacattttcctccccactctgcttcccaggtagattgagggtaggaggaggcccacattccacagaggagagactgtgagcctcttgagttttaagaatctgtgaaggaacacccccaaacacctaccatgcacccccaagcaagtaaaggggctccctgagttccagcagcttgagtaaaggcccagaaagtgaccctgtgaggctcatggagaagggaatgttgagggcccagcctgcactgggtgggcagcgccctgccccaacttcccgcaggttcccaggaaatgaacaaaaggctccctcagctcactcgttggcagatgtctctgacctgaggccattcatcaactctcactcaggcactcagccccccagacagcctggaggtgttggcagcacaccagagagactttcagccaaagacaggtctggtttccctgaagaaaaagaaacctgaactggctgccttcccagagcgtctgcttgggggacccacccaagtaaacaaagctgttaaatgggggcatgtgggccaaagcccgctgcactagaagctcccgctgcagcagtgctgccctgccccaggcaccactctagcaagagagagcctctcaccaccgtggggcctgaccctgctgctgaccagcctctgctacccacagcctggaccctctctccacctggagcccctctccttcctgcctccctctgattcatgcccggtgggtaggagtcctacttcctctcctcttccctgaacacagtaacagtgggtgtgctcctgaaggtgacgtgagggcaacaagactgactgaccttcctcgtccacctagggagctcatacagacccatcacatccaccccctgccacctctgcaagcttggacaggaggtgagctcctccgagctgcagcttcctcatctgtaaactgggaataacaggatctctatcaaagatgatggtgactattcagaacagacaaagccacagagacagaaacagatgaatggtttccagggctggggcaggaggaatgtggagtacctgcttcatgggtacagggtttctggtttgggg

SEQ ID NO: 6308 - DNA, 934 bp, mus musculus
ttttaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctatgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaa

SEQ ID NO: 6309 - DNA, 565 bp, mus musculus
tgttttagcctggcatgttagtctggacctgtccatctcttcagcctcatgacccataaagcatttaccctaaacgatatcgcagtctctgaatgcacacgttctggcacatactagtttgtcttccaagactcagcatcaccttctctgggaagtcttccctgattctcccaggcaacgtcagtctgaacttacactctgcttttccaggtctgtttccctacaaggacaaggagacagtgtcagtgtcttactcatctcggcatctccagcacatggtgcttaagaggtgtcgaatgaggaatgatctcatttcccgagtcctaagaatcctctaatgcactgttgttttgtcagtttcatgaattatttttcactagaacctcaatcatttttctagcccttaatggcaggcaggccggctgcttatttgtttgtatcccccagacagtaatcaatgtgaactccgcactgaccttgtggctgcggcctgccccctgctggtcagaaggtttctgggacagagacaactcaaggctgaagaaacaggggttctaaatcattt

SEQ ID NO: 6310 - DNA, 2589 bp, mus musculus
tgggctctgtggttcttcaagaatgaccgcagccgggcctggcaggacaacctgcacctggtcaccaaggtggacactgtggaggacttctgggcgtgagtgtctgtccccagtggggctagagttggggggctctgagctctgggctccctctctccgggttgagccagccctccctagggcctttcagcctttgtgagggctggggctttgtgggttctgcccagggggtatagggcacaaccaccccccaccccaccaccttctttgggctcagggagagagcctggggagcaggagaagcaggaagctgaccttgactcggccactccagggctttgtgacctgggcaagttccttcccctctctgaacctgtctcagctgcaaagggaggactcggctgcctcagtgtccgggtgctcacgggagtggctctgaaaagggctacacaagccctagggagggtgagaaggcctcggctgtagctggaggggggagcaccagggggtctaaaaccctccccaggggttggctcagccttcactgggaaggctctgtggaaaaggtgggtcttgagagtttggataaacgggagtggaatcccaggtggcaggccagtgtaagcaaaggcttggaggccatggggtcggatgaggagttgggagggctgaacccagttggaaccaggccctaaaaagccttgacttttggcatggggtcgggggctctgtccaggctatacagtcacatccagctggccagcaagctctcctctggctgtgactacgccctcttcaaggtaagctctgctctcctctttccctcccgcaaagggacaaggggttgatccctcccggactccactgcgttaatccctcagaggggtgggggtggggagctacgggccacctctcagcagagttgtggtttctgactggaggaaatgctctacaggagcccggacagagtaggtcaggcccaagccgcaccttggaggaccttaagaggcgggaagagggagagggagagatttctgacctggctccttaactagggaagggcatcagaattgcttgaggacactcattgatgccacacccatccctggagggctgacattgtgtttagagatctccccagtgacttctgccctgcctgggaaccatgcagccaagcctgggatgtcccccttgcctgcattggggtctgcccctgaggcttccttaatccaccccgatttgaatgcttgtcttaaggaactcagtaaaagagacatgcacatatacaaggctatacaaggtgaccagtgctgtctgtcggggggagctgagtggctgggggtggaacctgcttgcactgagggaagggaggataagagaatctggcctacttagggcctcagcagagagcggataaggccgggatggtgggtgggtccccatttccctttgaacacagggaggcagttgacttgccatctgccttgcaggatggcatccagcccatgtgggaggacagcaggaataaacggggtggccgctggctggtcagcctggccaagcagcagcgccacattgagctggaccggctgtggctggagacggtgagttggaggaggagggtcctcaggggaagagacgggctgtgtgggtctcatggtggcagtggtctcaaggatggcaggccagtccctatgtcccagccggtgatctcacaaccccctacttcgggtccagctgctgtgtctgatcggggagagctttgaggaacacagcagagaggtatgtggggccgtcgtcaacatccgcaccaagggggacaagatcgctgtgtggacgagggaggcggaaaaccaggcgggcgtgctgcacgttgggtgaggagggtctctggcacagggtggggacttgggtctctgctagagggaaggtgggtggagggggcttggcctgcatgggagacctctgaaagtctccatagcctccctcccttctgccttgcccacctgtatggaaggtctggcgttcagatttctaactttctcttacggcagtgcagctctccttttgcattaagggggtcatattttgggtttccacatgggtaagacacaacaggtgtggctgtggccagaatgagggtaggagtctggtggcctaagttatctctaggaccctctgatgactacctgtgtctcttttcctctgtgtcccccgcacctgcaggcgtgtatacaaagagcgcctgggcctctccccaaagaccatcattgggtaccaggcccatgcagacacagccaccaagagcaactccctagccaagaacaagtttgtggtgtgaggggggccttggcacccctcctatgtaatgggacagccgccactgagcctcattactttgggggatggggcgggactggggatcagacagcctagttcttacctgtcctcaagtgaacaggaatgcaaacactctttaacatgagttggggcctgagccttaggggctagatgggggtagtggtggcagtctgaggacctagcttgtcctggggccacaggacagcagcagggtggaaaaaactcctg

SEQ ID NO: 6311 - DNA, 1169 bp, mus musculus
ggggcggccagtctcaccactgaccagtttgtctgtctgtgtgtgtccatgtgcgagggcagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggtgcgctgagctgtgtgggggcagggacgcgggcgccgggttgcagcccgccctccgcaggagtgactcggaggtctgaggctggactttctccatctccaggctggtgcttgggaagcccctaggcgagggctgctttggccaggtagtacgtgcagaggcctttggcatggaccctgcccggcctgaccaagccagcactgtggccgtcaagatgctcaaaggtgagtgtggcccggtgtggtggctcacacctgtaacgccagcactttaggaggctgagggtgggaggatcgcttgaatccaggaattcgaggccagcctgggcaacatggcaagacttcatctctacaaaaaaaaaataagaaaattagttgggtgtggtggtgtgtgcctttagtctcagttactagggaggctgaggcaggaggatcccttgaatccaggagttggaggttgcagggagccatgatcacgccactgtattccagcctgggcaacacagtgagaccctatctgaaaaaataaataaataaataaaaataaaaggtgaacgtggcagcctggaggaggtgctatggcattgggactaatagaaggggctcacggtgccaccaggtgagccctggagctgggagaggctgtgggatcccacccttaaacctgcaattcacctctgctcctgaccctggc

SEQ ID NO: 6312 - DNA, 1169 bp, mus musculus; identical to SEQ ID NO: 6311

SEQ ID NO: 6313 - DNA, 2026 bp, mus musculus
ggatggaatggggaggcagggctgtggttttctcccagagggagaatccagaatgttgcgggcgtgatttccccctttgggcagtgatcggaagcacagctctgctactagaaagaggtcagattctttacctgtaaaaatactggcgaggtacacgtagcgaggaaggcaggacttcttggcgtcagtctgaaggcagtaatcagcagggtcaagcctctgagcttagattggcatgtgtgtgcacacatgtgtgcatgtctgtgtatgttttgtgtgagtgtgtctgtttacatccttctgttgaacagatgcatgtgtgttgtatgtgttgtatgtacatccagaagagccatccgttgggaaagactggcaccgcctcgcccagcattccagtaagcacaagcctcctttcaggaccaaacgctgctgacactgctgacagtgctgagtgaatcagatcgtgattcattcaacaagcactatttggtggcaggtcctatgctcatgctgaactgcacaaggcccctaagtctcaggaagctccaggtctcctgggaaagaattatacctggggagggctgagagaggagaggaggccagatctcgggctgtggtcaggttgtgatgggcctgaaccggaggctttgccatcatcctgtgtgttgacagcctgccctcaccctcagctcctccctgctatgctctccatctgagaatgcagcccctgccctgggggctgtgtgcttaaactagattccggggtcatccttagcaactcccactccagatctcatcagttacctacttaactgtgtgaccttggacaagttatttaatctctgaacctcagtttcctcatctgtgaaatgggaaggatactactaccggcttgaaacgattaagtgagataatgttcacaaagcactcagcacatacaaatgattttaaaataggcatgggtatggttaatcctgtctgctgaatacctgtggaagccacccatctccctctaacccctccgtatcatcctggtccaactacatctcctcctgggccccacccctccgggctcactcccagcagccagaccagcagcactgcctccctcggggttttccccaaggccaagctgatccaggcaccaaggagaagacaggtgccgagctccggtcagccacgatggaggcccggggagcctcctgagggaggcaggccagctgcagggctgtctctttgcgcatctctaagactgaacctctcaacaacccggatgctcatctcttgtctatattgggtccctggcaactagttggtcatcatgttttacacattatgtaagcaatccagatgtacaacaacctggatgctcatctcttgtctatattgggtccctggcaacagtaggtcaccagtatgtagtcaacgagcgaatgaatgaatgaatgaatgaatgggagggtttagactcagtgagaatggcactggggcagctgatgtttgggactctcatgacttggcctactgtttctggatctctggctctgccccagcttcgtccgccctccctggtcccatccttcagggcccagctctgacttcacctcctgaaagctctctctggtcccatccagccctggaatcacctccctcggaagccctccctggcctcacccagtacctcctctcccttatcctgcccctgatgtctgcagttgtgccctcgaggagttttcagtctttcttgtttgcctgtctacctcccgctaggctgggagctctctgtgggcaagaacctcgtgctcactcttctgcatccccttgtgcagcagggctcgggcacagatgtggcgtgggacagtctgctgactgcccacctcaccgccgcccgcacagtccccttgccctcatggagccagggcgggatgggggcagcactgtcctctggtgccagcagtcagcacattggaagtatctgcaaggggcgtccctcgtgtcctctggctgtggagaggtcaggagacag

SEQ ID NO: 6314 - DNA, 778 bp, mus musculus
tggccatcctgtcctgtcctttcaagagcttcactctgaggcctgacaggctggacaactgcccaggtcttacagctaggacatggcagggcaaggtccctttgctcagcagagctgccccccggacacctgagacttagggatcccccctaaaaagatctcacaagggcacccgggtgctgcctctttccaatggcacggagcggcaaggcctttgctttctcctccagcccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatggtgagcccttctgggaggcatcagtgggggctcagcaggcaggccctagggtgggcagggtgggggcttgtgcctctgatcctgcatggggcaaggctgccgcgaccctgggctggcaggagagcccaccctggctggtgtggctgccctggcccactcctgggtggggcattaaagttcctagcagggctgcaatcccagagcaccagaacaccccagagtagctgaggacatggaagaggtggccgggctgcgggctcggcaggggccgggctcctgcagttcaccgtgggtggacgaggcttgagctgtgtggtcagctcagggctgaggccagggctgaccctgccaaggaatctggtgacctctgac

SEQ ID NO: 6315 - DNA, 369 bp, mus musculus
gagtacaatgcttctctgcagactccatgagccatgggctggtatgctacagcagaaaccaaggtcctatagcatcatgttggtattgcattttattgcattttagcactgattacaccaggcaagggccaatccctctctagtaatgcagtacaaaagcccctcaacccgagagtcaggatccttctcccctagtctcatagacggctctaccaggttgcctgttgtgcttcagacagcatggataacaaggcactacacatttgcccaaggatgttgagtgttccctgttcatgctgctcctcttggtctgctcttatctgcactattttgtgtgtgttttctccatgggtcttcacaaatgaaatt

SEQ ID NO: 6316 - DNA, 796 bp, mus musculus
gcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcgggtaatggcggccacctcgccccggggatccccagcatcggcgcgctcgaggggcggcgggaggggcgcgtgccgacagcaggagttcccggcgcgcgggcacggggcgtgggcgcggcctggctgccctgtcgccctttgtgccgcgagaccccgatcctgggggccagccgcgcttggtgctcgagcccctcgatcgtgcatgcgcctcggtcagcctcagttcaaggagtctggagccgtggaggcttgggctatagagtgcagccccttcagtgtgcagaccagagagacccagggagatacatttgcctgtagtatggactcacccgtgacggagcacggactagaatcccaacgccctcattagtccattgctctgtccagagtccacactaagggcataaggacaataatctcttctttctcttatgtcagaaatcagcctgagcctgagtaccgctaaggctttaatcacgggtcccgagagccctaagtcttctctttgcttgctgatctcgtaccttaatgtgcaaaagaatca

SEQ ID NO: 6317 - DNA, 272 bp, mus musculus
gaagcttgattttgatcctggattctttcagtccatcacatttggataagggggaaatactggattagtaccagactttgtctatccttatggaacatcttgttcatttgttattttcattctcaccttctaccttgtatagaatatgtgcaatacaaattagggggcctatttgtttgtttttggcatgttagttcacaaaatggtcaaaccagccatgcaaccttgtcctattattgattattcatccaagaattgactcctgcttgcct

SEQ ID NO: 6318 - DNA, 1461 bp, mus musculus
aataattacattttgctttaactagtctagataatgctagaatttattgattttccattataatggcagtcaatttcacattcattgtattattctagccttattttaatcttgctttttacatattaatacactgatatcaaaaaaaagtttgcctcactgtttataagtaacagagacagaatttaagctcagagataactccaaagtttatttcgttccttttttctttctttcttcttctttttttgtttttgaaatgctgtcttgctgtgttgcacagcctggagtgcaatggtgcgatctcagctcactgcaacctctgcctcctgggttcaagcgattctcctgcatcagcttcctgagtagctgggattacaggcccacaccaccatgcccagctaatttttgtattttttgtagagacagggtttcaccatgttggccaggctggtcttgaactcctgaccttgtgatccgcccacttcggcctcccatagtgctaggattacaggcgtgagccactacacccagcccaaagtttattttgttctatcatgttgactcagttaaaataactgatataacatgtatcttcatttaactacctgtctcaactcttaccgaaatagtgtaataaacattttgaccctagctgctaaataatgtctctgtgtttttttccagctattccacatttatcacacagtgaaaacaaaagcaaaactgccactcagcctaactgatggtccaagacaggccatatggcttggtgccatcttgaaatgcaactactgcttttattgcactttgagattctaggttggctgtttgaatgatttactagttgccttgttaaacaagaactagtctttaccattctcctaagtttgtttaaagtaacattcatctttttgttttaatggtggtaagatttaatgtagttgaattactgtcaatttgcctccataaacattttctatatgaagactttaagtgcaagattatcaacaatgcaattaactttgaattaattaggaatcacagtcctgtttctgctggcttctgttccttttgcccagaaaatatctgcctcctctttatttctccttcattctgtgtgaaagaataattatgtaaatatccaaacccggatctacaggatggtaaacaaatgttttgacagagaacaaaatagcacgttggaatagggaaagctatacaaagattaattgcattttagttttattattattattattattatgccattttgggtggcattttgcagcaaaaagctccatgacgagttgttaataggttaaattaccaacttttataaatttttagcatatttttcagctctataaagcaagctcatacaaagaaaaaataatctatggttgtatatgcaaaatttaaaaaataaataaattgaacataattctcaacataattgag

SEQ ID NO: 6319 - DNA, 1146 bp, mus musculus
caaagccacaagaggctggtgtgaccgattcatgcgtcgagcaggactatcattaaggcatcaaacatcgttttgtcccaagctccccactgccattaaacagaagacagtgttggagcactctttcaagaagtgctgcataaccagtactcttgacaacaccgggagagacgttctgtggaaaaatgcagacatcaatgactgtggtttgaaaagtgattcagaagagttggattcagaatatgaagttataattataacttaaccaatttatttcacacattttctttacatatgcacaagattgatgtgataaaaatctgtttaactcaaagcgctgtttcaataaatataaacattttctgtgatatgaaagcattgtgtcatagtttaatgggcagtgttttttcttagtgatacatatggtgcatcttaacaattggtagtgtcttaggttaaattaaaaatggtagcttgtaaatttatttttctttttaagatagcagttatttattggggaatttgattctgactcttacaatgttaaacttgtaatcctgtgtgaaacacatgtttttgggggggagggggtaaccaagatttcagggtagtaacttaggaatctaagaactatcttctactttaggaagagtgggattagttactccctttgtataggaggactttatgctcaaggaatgtgttgtggagaaaaacacttcttcacaaacaattcagtgacaagacctcaaaggtaatgcgtattgaggaaaacagtagtgggtgaaaattcccgcttagctgtaaaatgactctcttgccaggtttccgtgtttgtctcaactgaactctgggctgagtgtttaccagggagaagagatgtgaattaaacaaccttcctgtttagtgttacctgctttgtacaagaatgaagtgcaaagccaacttactttattaatccaagttctttttatgtttttcttaacctttattaaggactagtcatcacaaaatatctatttaacctctattttatgatggtgtgttattatgtttgatacctcatacttcttgcttagagttttgtttaacagttcactggctctgtcccaatgtttgtgatgaacacctttttgctatattgta

SEQ ID NO: 6320 - DNA, 1119 bp, mus musculus
gaaactacaaaaaatttgtgaacttttctcatgaattctttaaaggaagttgactggccgtttagccatttattttacagaaataataataaggactatttaaacaatgtagttaattttaaagtttttgagcttggattttttttttaaggtatatttttcttgtggttataaaatgttaattcttccctgcttttgagtaggcgccaatggcgtagaatggtttggatttattgcatttatctgatgccaagctggagattattgggtgccctgcctgctgtgtgtccagctctgtgctgaggacagtggtgagcaactcctgcttgtgtccccaattcctgcctgtcctccccagaccatgcactccatggtctggtgaggggctgttatgatgaaaggaaacaactgctctggtagggaagggaaggtattaggttatgtggggtacaaatcaatggcccccaatgtagtcttgaggaattgtaagatgttagggtgtttgttggtttattttgatgataattcccaaataaagatcatatctgtagttgatgactaaagctgttagattttatccattgtattcattttatttttctcccctctaagacctacttatatttttcatacctttttaatttctgattcgtgctggtgagggggctgtgctttagaagagatgcagattttgagatgaaagagcagacttcttaactgacctcagaatactttttttgttttttgagatggagtttcgccctcgttgcccaggctggagtacagtggcacgatcttggctcagtgcaatctccgcctcctgggttcaagtgattctcttgcctcagcctcccaaatagctgggattacagatgcacaccaccatgcccgtctaattttgtatttttagtagaggcggggtttcaccgtgttggccagggtggtctcaaactcctgacctcaggtgatccgcccaccttggcttcccaaagtactaggattacaggcacgagccaccatgcccagcctgaccttagaatactttaactaacacttttaactaaattaaaggaatgtaaagggtaaagaatcatgttttgtaatacttataatagtatt

SEQ ID NO: 6321 - DNA, 574 bp, mus musculus
aaaaaacagtatttgtacatcttagtctcttaatgttaaatgccctaaaaattatgttttttccttgtacctctcattaatttatttagtaaattgttgttgtgcaccagccatttttttttttttttgccctgagaaatagataggaaagaaaaagtctaaaccttaaaggagcccgcaagctttaacccagctcttacccaaatcatcataaatcctgaattggtagagcaaaaattcatgaggtagactggcagcagtgcctaacaaatttcccttgggaaaacagtaacagattttttattttttagaaaagaaagtcatctcctttttttactattaaaatttcaaatttaaatattcacatcttacgaagtattctcttagtgtaatagacagtgaatgctgtgagcttgaattactgggaaattagtattttaattatttgtgtcatttatataagttaaaggtatcatgtgttaaccatgtcaatattttgagaaatttgaaaatcccaaatcccaagagatcattgcctttcagatagactgccagctttatgaaagatgatttg

SEQ ID NO: 6322 - DNA, 1161 bp, mus musculus
ctattgcttcttttttttttttgaaatcagttacacaaatatacacagctgtcctttataccagaaagcattctttcttttatctgtaagggaggagatgtattccagggcaaagtagcatggctcattgttggttagtgggacggctgcttgccagtagtgtgtgtgtatgtatacgtgtgtgtatgtgtgcatatgtgtatgtgtgtgcccatgggtgtgtgtgcacatctgcccaatgtgtcatgccttgtttttttcccctctttaatggcactgctgagaacacatctgcatgaataactgctaataccaactgtcaagctagcaaagcagtggggttgggtataattttctagcataaatttatcagcacagtgggcgtttggggttagctccttctgcagatgcctcgtgaagcaggttgtggtccactgcaccaaggaaagatgtagttttgccaaagaagaagtactgtgccatcagcagcagatcaaggggatattatccatcccaagcaactgcaggtcagaaattgtatcatggacagttcacaggaggccacagggagggaggtgattgagaatgtcaccctgtcacacttgagtcactggcgggtacagccactttttatgtgggtgcctgccactgacaggctccctcggcatgtagttacccttcttcaaaggtagaggatgtgacattagtaatctgtgtgggtggaaagcctgttgttactggtcataaccctgatggaagaattagtggacctcaccaggccagtataaatgtaaaacccagagagggtcttgaaaggaaaagaaatctgtttactttacttctctcatcttttctgtctattatcttctaactcagatcaaaactccatgccatatggcaataaagagaaggcactataccatcatcttgtaccttccaaagaagtgacataaccaaagcatcccaggattagcagagaatgaaggagccagtggagacttgcctgtatccacatgggacatttttgggtcctccgagatcagaggtggcacccatctgccctagcagtaactttactcttgatgtaaatttgtcaaatttggtgtttgacagtcattttaaatgagaagtgttcctaagatccaacctaggctgagtcat

SEQ ID NO: 6323 - DNA, 1161 bp, mus musculus; identical to SEQ ID NO: 6322

SEQ ID NO: 6324 - DNA, 963 bp, mus musculus
tccagttgtctgaggccagggagctggccagccctcagttggactcctgcctttttcacccctcccagcagctgccagaccacagagccagttctgtgaaagatcctcaagaaacaatgagagaaaacagcttctgtttgattagattagatcaatttatgtgcctcggggaggggcctgcgcagggcagggggaggggtgcccctctgttgttggtgggggcagcggtggcccatgcggtcacttcataagtaatgaggctccgtggaagctggaatcagagtaagggggagggcgggctggaggaggagcatgtggaaagagatttctgcagtctgtctggagagctgcccaggtttcccagccaaaaaaacaaataaaaataaataaaaggcaagtgctgaatgacacagattatgatattaaaaagggatgccattgaaactgcgccctggagtccgctgtctgtgggggtggggtgtgcttggcaatggggtgggggcatctgaccggctggggacacaaaagtgtgcacaattaaactgtgaatgtccccctccccccatatgtcagaaattctatacttcggatttgtctgcattgcaggttggggaaatggcaggatgaaaagctagtgactcttttcctttttctcattttaatttatcagggtggggggagccagccggagacccctcctctttggtgttcgattccctcccttgcacataaataaccttctctcctggctgcctcccctccccctcggccccattgctgttctggccgtcctattgccgcgcggaatctgcactgccgcttgcttattacgtacaggggaggattgttgacaagtgctccggagcctgcctcactgcgctcttcctccctccctccctctgtccttcttcctctctgtctctctgcaatgatccggctctgaggatggctgctccacgggtc

SEQ ID NO: 6325 - DNA, 963 bp, mus musculus; identical to SEQ ID NO: 6324

SEQ ID NO: 6326 - DNA, 1103 bp, mus musculus
tttcttagtgtctttttcctactcgttagttgtatttggctgctgcaaacaccttgggctcccaagtagttgggaatgtggaaagctacatactttccctctagagagagccccagtgtgaaaaactaagatagccgtgtgtttgctgatccttgggacgagccagggaagggctccgggagcactgtgtgaattaaggctgtcaagaccaaagtaacataggagggagaagatgaaaatgcagcagcacgtctcttaatgtgatcgtttctctttccccttactgaagcatagtgctctctgctatttgaagagcgcaatttagatttatattaaggaatgaataaataggatgcggtgatgaaatctcatctggagtgaatgcagattgtggatgctaatgaccgtgtggctgtgcagagaacccattggaagcctgggcgcttctccctcctctgttcacccactaggcactcaagagcaactcaggcagtggggaaaaggttatctttttttaatgtctctcagtgttgcatcttgccttatagcgccttaaagcacttgacaagccttcaagtaattcttggtggtggcgttttcccccagaaggccttaagagatggttttaatagatacacctatcaatttattcccaacttgagcattttgctgtcttgcatcatttgacatcaccagaaagtcctttggttacttctgtagttcacattgtactttctgtcctttgagttttgggtgctcaggggcaagatgtcagaaatcctgagttttagttgtgccactgcgtagctttgaccaagtcactttacgttagcaggatacaatttccgtgttcattaaatgaggagactggactgaaagctcttagaggcctcctctagctcagacgttctgtaacactcagggctttctgcctcctctgatttggcggtgtcaggatacaggtccaagtgcggcactgtgccttgcaaaattgctctctctccctggccagcttttccaccactgtggaatgaagtctgccgcctggaagaatcccagatttctcaaaggcgtccagttctagggagcagcgtgcaaagccc

SEQ ID NO: 6327 - DNA, 673 bp, mus musculus
aacattccgtttagaatatttgtggagagcaccctgcattactgtatgtatatctaagagctaatattgctgaacatttattctgggtcaggcagtttatgtttgttttatccttaattcttatcatcctatggtgtgagtactattattattctcattttacatatgagcaaattgagacttagagagatgatatataataggtccaaggttacatagctagtaagtggtaatgtcaagattaaattcaagtagtcaggtagaacttgtaatcactatgctatgttgcctccaattagcaatttatcagtagccttacagtagtttattggtgctatttcttatagcatcactaaatatacatattaatccaaagtacaggacagttaagcaaaaaagaaattgctgggagtctgcctactctggagtgtaggcagagaaatattccatcagtccagggatagatttcagagcgcttggagcatgaattctcaacatgggcaataccatccaaaagcagatgattatttgttcttaggaggccagaaaatcttagatattaaaatagcttgtagacttctaaaaagccacagtacataaatatatataccacttatctctgatattcaagtttctctaggagcaggaaggtgataaggagaaaaatgtctaa

SEQ ID NO: 6328 - DNA, 263 bp, mus musculus
agcttcttgtaccatgttgaatagaagtggtgaaagcaggcatccttgccttatttctgatcttagagtaaatgcttttagtctttcaccattatgatgttggctatgggttttttcatatatggattttattatattgaggtagatttctttctagtatgttgagtattttcaacatgaaagggtattgaattttgtcaagtcctttttctgaatcaaccacattgagatgatcatgtggttttagtctttcattctgttaa

SEQ ID NO: 6329 - DNA, 267 bp, mus musculus
atgtccttattttctggaagcaaagtccaagaaatgcctgcataactgagcagttttagaagtataggaatggcatgtcaaaaacatggagatgggtgagtaagctttgtccagagagccgctgaaagttcaaagttccttttagcccattttgcctggagcatggggtatgtggttggggtgtataaaataatttagggttagattgagaagggactgatgtgacatgttgatgactttgagttattttcttaaagaatggtaaac

SEQ ID NO: 6330 - DNA, 315 bp, mus musculus
aagaaaacacacacacacacacacacacacacacacacacacacacacacacacattctgcctttctttaaggctaactagggttcttaagaaattatttcatcaacacattagtttctaaccaaccccgtccttctgaagggagttactcatcaaaacatttcatcagcagctaatcaagacagctaatggcccatatatgtatatacttcattacctgcagtaacttaaatgaatcttatatgactggcagctgtcaactcttactcagctcatgagtaaagaacaaaaatgagaaactgaaggttaaacaca

SEQ ID NO: 6331 - DNA, 191 bp, mus musculus
tatcagtagttataagtaaatttttaataagaattgtataatatattctaattactctttttgctatcattatcagcactttaaaaatacaatatgcataataaaataacaccacaaaataaactgaaaatgtgtttaaaattctccatgagcacttgggggagtggaatttttttttaaaactagtttaa

SEQ ID NO: 6332 - DNA, 1205 bp, mus musculus
ggcactggaggaaactgaggcagaaaagcaataactaatattccaaaagttataaagtttcctggtataagacctgagtacaagcctaaattcaggcagttcacactgccagggacctttaagacaaattaagataaatctaaggcatctcttagtgattagtagaaaatgaaaggggacaaggcttatagaaaggttagatcaaacatcctggtttcttttgttttgggggatttatttgtagtttgatgtaagttctggaaaagaagtgagattggagaggttgattgtgaaagagtaaaatcctgttcagacaaaaagagtaaaaattagcttggactggtaaagatcaaagtagctctcctgttaccaatgttgggagaacagacacaggtagatctggttacagagtcaactggactcactggttacacagcagttgtaaactgccataattgcaccatttgagtgatgactcttttcttaccaatgtagccccaacctgccttgtatatccagacatcagagatctctaatttataaactgccttcatctcgtgacagtatgcaatagctaattaatctacctctcctaatggcccttgagaaacatcaacacatcaacaactccgcttaggggcccctcagatccatcagtgggaactcagacctctcctaaatgcccttgtagagtgacattctatggttcctctagagcaccttctctggctacatccagtccatgtatctcattgtttttcagcaacaggcttgttcctgaaggtctttggctgattaaccattaacatttgaggtcctacagtgaaatgctatgcagtttgactttatatggagtacttggaaaacccactgaaaacttgtaagtactgaaattacagattcagttcggggtcttgaaagacaactcagaaatattaaggaatataaatcaaagatatgaaaataagaagagataaaccagaaattgttatactaatcaaaatgatagacatataggcataatgaataaaagaagtatcacagaagataaaacattgttaaacttgagaaatgttaaagatgttgaaacaacatgattttatgagtgtctgtctgttgaatgtggaagaggtagaggggttaagggtgagcaccaggtttttgaaattggctgataggaatattaagaataagtagaaaatgga

SEQ ID NO: 6333 - DNA, 883 bp, mus musculus
atgcctatggatatttctagataaatacaaaggaatataaggacatagttctcactaccatgcaaattgcagacaatctgaggattaggattcacacttgaaatgatatccaacaaaccccattgtgtggtacaaaagcatatatgtagacagggtgggtagtaaagaatgctaacaattttggaggaggttaaatcaacatgtaattttagaacaggagatcttctgacctgtatatgaagaatgtggagtataaaaataattacttttgttctcttcctggtgatacaaaaagacaagaagcctcctcattgccccttttatgtccctgttgctcaaagtgtagataaaagggttaagcataggagtcaccaaactgtagaacagggacatgaatttgtttttgtcctgggagttggcagagggctgtacatacatgctaattacaggcccatagaggagagatacaatatgagaaccacatgtgttgaagacctccttctttccccctgaggactgaatcctcagcacagtagctacaatgaatccacagtaagcaaagataattgattagagaacgagggactaaaatatcctcacaatggagagcatagatacattgaatgtggtgtcaaaacgtgatatcttgatcatcgctgagacctcacacagaaagtcgtccaccttgttaccgcctagtggcagctggacggcaagggatgactgaagtagagttggccaaactgcttagccatgccatggccactaggaggacacagagttgctgatgcatgatagctgggtacctcaagtgtttgcagatggcaatgtaaggatccaaagacgtcacagctaaaatgatgcatttggtgctcccctaaaa

SEQ ID NO: 6334 - DNA, 1204 bp, mus musculus
gaaaattctgagctggaaggattctgattgtgattagtgttccatacattattttgtcttttgtctgaagcaatgctgaatacaacctcagtcactgaatttctccttttgggagtgacagacattcaagaactgcagccttttctcttcgttgttttccttaccatctacttcatcagtgtggctgggaatggagccattctgatgattgtcatctctgatcctagactccattcccctatgtatttcttcttgggaaacctgtcctgcctggacatctgctactccagcgtaacactgccaaaaatgctgcagaacttcctctctgcacacaaagcaatttctttcttgggatgcataagccaactccatttcttccacttcctgggcagcacagaggccatgttgttggccgtgatggcatttgaccgctttgtggctatttgcaagccacttcgctacactgtcattatgaaccctcagctctgtacccagatggccatcacaatctggatgattggttttttccatgccctgctgcactccctaatgacctctcgcttgaacttctgtggttctaaccgtatctatcacttcttctgtgatgtgaagccattgctaaagctgagcttaatcagtggctgctcagtactgtcacagggacaatcgccatgggccccttctttctcacattactctcctatttctacattatcacccatctcttcttcaagactcattcttttagcatgctccgcaaagcactgtccacttgtgcctcccacttgatggtagttattcttttgtatgcacctgttctcttcacctatattcatcatgcctcagggacctccatggaccaggaccggatcactgccatcatgtatactgtggtcactccagtactaaacccactgatctacactttgaggaacaaggaagtgaaaggggcctttaatagagcaatgaaaaggtggctttggcctaaagaaatcttgaagaactcttctgaagcataaataaacaattaaaaagatgagtttgtaattacattgtttcttaaattatttagaaatgtacaacagagggaactggataaaacaaaaatatatggaaaaatatgctgtagttgtatttaacaatgctttcctggattatataagggacatttgaatgaatgggatactagccatggaactctact

SEQ ID NO: 6335 - DNA, 1019 bp, mus musculus
tctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaaca

SEQ ID NO: 6336 - DNA, 2317 bp, mus musculus
ggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccagcacagtgctgaagagttctttccttatcctcatgtgtaggttgacagggtagtatagtcaagtggttataaacatgagctccctggatttaaagcctgattccacttacttgggcaaacaacctaatgtctacatgttccagttttctcatcttagaaatgggggtagtaagaattgttgttaggattcaatgggttaatatatgtaaaatgctagaatagtgcatgccgcatagtatgcaatacatgaatgttagctatagtcattatgactaatgtccctccccttgcccaagagtttgctaggtctggttaccatttttttctttcaactattctgctctggatcccacaatggtttaaagaaatttgtttttaagacaagtcaagtgcagtagtgagaaggaggggaaaagtggagtaaggagtttgatctgtaactgagtgaacaattaattcagataactcaccaccacctttggaccagcctggatccctcactgttaagtaggaaggaaggcaatttgtcccttttttttttttttttttttttgagacaaagtctcactcatctcactctgtcgcccaggctggtgtgcaatggtgtgatttcagctcactgcaacctccgcttcctgggctcaagcatattttttgtagaaagcaggctttgccgggacatggtggcatgtgcctgtaatcccggctacttgggaggctgaggcaggagaatcgctaaggtggaagttgcagtgagccaggatcatggcactgcactccaacctgggcagcagagcaagactccatctcaaaaaaaaaaaaaaaaaaagcaggcgttgccattttgcccaggctggtctcaaactcctgagctcaaagccatctgcccgcctctgcctcccaaagtgttgggattacaggcgtgagccactatgcctagctggcaatttgttccttagcagaaaagctgaaaagatcctattctaccctgccagccccctctgaggcctcaactcttccccttttccttcccctgcccttaatgctttttcttctttctctgcaggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaa

SEQ ID NO: 6337 - DNA, 2317 bp, mus musculus; identical to SEQ ID NO: 6336

SEQ ID NO: 6338 - DNA, 2317 bp, mus musculus; identical to SEQ ID NO: 6336

SEQ ID NO: 6339 - DNA, 2317 bp, mus musculus; identical to SEQ ID NO: 6336

SEQ ID NO: 6340 - DNA, 2997 bp, mus musculus
tgcctgaagcctctgctttctttggtgccaggccccactggcctggctcaccctctggtcctccatgccccctaacaggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagtgagtatgcagcatccctgtgggcatcgcagccctgcctccctgtcccctatccagaagacctctgtcacctgtaaccccttggccacagggtcagaccctcccacagaggcagagtcagttggctctagggcccaggtaaatttcagggggatgggtgatctccacactgcccagtcagccacctgatgtctccctctagcccaggcacgagtgctgacctcagcctgtctgcttccaggaaaggtgaccggatttaccaccagttgaagaagcttggcagctccttggactgggatcgagcctgtttcaccatggaccctgtgcgtgggaggagtgtcaaagctggggcaggagtaggagtctccccagggtgggacccccacaggagaaagcagaggtgttgtggccctctctcaggagctggcccatgtaaaacaccatggagggctcagctgcaaatgccacttcccacccctcgccatggccctttccatatcatggcccttcatgttccctgtcttggctctgggagctccagattcctccagatggcacatgatcaggaccccgtctcccatggagcctgaactcccagtgtcctctgcaccagtacttgtccccagctgattgtcttcctcgccatctgcagcattacaaggcttgttgcctgctcttgtgttcccttagtcctctctccccctcaaggaaagaaggaaagtactcccctcagaggggtctttgtgctggccagtgggactctgtatgggcaaggcctcactggagccctgggtgtctgcctgggcctccaggcacaaggcccatctctctgacttctccctcctccaccccagaaactctcagcagctgtgacagaggcctttgtccggcttcacgaggaaggcatcatctatcgcagtacccgccttgttaactggtcctgcaccctcaactccgccatctctgacattgaggtgcgccccccaacctggcctgtctccatctccaatctaccctggccctggccctggcccctgggccacgcctctaaatacccattttacaggtggataagaaggagctgacaggtcgcaccctgctctccgtgcctggctacaaggagaaggtggagttcggggtcctcgtgtcctttgcctataaggtccaaggctcaggtaggagccaggggcaccaggatcctgggctgggagtggcaggaaggggccaaggccaagaccacaaggccttctgtcaccccagatagcgacgaggaggtggtggtggcaacaactcggatcgagacaatgctgggagatgtggctgtagctgtgcaccccaaagataccagataccaggtgggggactgtccacagttagggaaggagttctggccaaaaagggctcccatccttatggggtggaggggttggacttaggcccctggctgaggagaggaaactgggttagaaactggtcttcagcttctttcccagctctgagggtagagctattggggactgtttgggggagttcaagtgttgggatagtcagggccctggaaaggaaggacttgggcccagcccttcgtgcatttttaaaaagttaaatagccaggcacggtggctcatgcctgtaatcccagcgctttgggaggctgaggcaggtgaatcataaggtcacgagttcgagactagcctggccaacatagtgaaaccccatctctactaaaaatacaaaaaattagccagttgtagtggcgggtgcctgtaatctcagctactcaggaggctgaggcaggagaatcgcttgaacctgggatgcggaggttgcagtgagctgagatcactctgctgcactccagccttggtgacagagcgagactccgtctcaaaaaaaaaaaaaaagttaaatagagacaaggtctcactctgttaaccatgctgatcttgaactcctggcctcaaggaagcctcctgccccagcctcccaaagtgtgggggttagagatgtgagccatggcaccaggccccttcatgcttttatttatttatttatttttgagagagggtctcactctatcgcccaggctagagtgcagtggcaccatcttggctcactgcaacctccacctcccgggttcaagcagtacttgtgcctcagcctcttgagtagctgagattacaggcacgcgtcaccacacctggctaattttttttttgtatttttagtagagactaggtttccccatgttggccaggctggtctccaactcccggcctcaagtgatctgcccacctcagcctcccaaagttctgggattacaggtgggaatcacggcgtctggccctgcttcatgcgtttttggtatctttccgcccccagcacctgaaggggaagaacgtgatccacccattcctgtctcggagccttcccattgtcttcgatgaatttgtggacatggactttggcacaggtgggcaaggggctggtcctgtggggagaggaaaagactggagctgcaccctagctgtccatcttctctcagagaaaaagaaaataagcttcagccaaatagacagagcttggggtggttctcaagggactgtattagacaagtgggggccaggagtggtctcggagctacatccttcagcaaaagaggtgagtgtaggaaggaactccgtggagtccctcatgacctgggcatcctgatgtacacccaggtgctgtgaagatcacccccgcacatgacca

SEQ ID NO: 6341 - DNA, 772 bp, mus musculus
cttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctcc

SEQ ID NO: 6342 - DNA, 772 bp, mus musculus; identical to SEQ ID NO: 6341

SEQ ID NO: 6343 - DNA, 772 bp, mus musculus; identical to SEQ ID NO: 6341

SEQ ID NO: 6344 - DNA, 1522 bp, mus musculus
tgtccgcctgcgggacctgggaggggccatcctacggcacgcccggcggcaggcagagaacatcggctatgaccccgagaggggcactcacctgcccgagtcacccaaattggaagacttttaccgcttctcctgggaagacggtgagaggcctggatgggtggggaggagaggggccaggaggaggcacaggaacagagtctacagagtgagggatcagggtggtccttggggctataggtagactccaggagcaaagctgagggtgagcacagactgaggtatacctttgtggctagaatagttctaagggttaaagtttaactaatgtactctgcacttcttaagtggtagaaaaggggaatcaggtactagtggtctgtttgaaaagcttaaagcctcatcagaggtcttcctctcttggatcccctctgtatggcattggagcatgggacagggagagtgcattgctggtgtgtgtttggctcattcagaagattgcaggtggaggaccagaaaaatggaattgcctctgagccccacacgctgcctgtccctgctctctgcttctcgatggcagcagccagtcactcaggccagggtattgccaagctgcctcatgcctgctccatggagcccataatcgtgactgtgaactgcttcctgcagacgtttcccagattctgaccttgcccctgtggctgccttctgggcagtggtgttgcagggccaaggcccacagtgacgctgctggaagctgctggcccaggcattccaagagagagttttgcatccgaaggattcggcccctttctcttgccctgtgctgggcaggtccttcagccccttctgtcctcccttctccctggcagtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagaggtgagagatagtcacaggcaggcagggggttggagggtaaagagggacaaaggctaagctgaaatatcataatgggggtattctttctgagtttagatctgacacttgtgggcaagcaaaagtgcttggaagggccacacttccatgtatacgcagggatgatgttcaaaatatttaacaatcactagagactaaaatttatccatctcagtagatgttggctgttatattggagtgggctcccaaaggcccctgttgtggatatttagttgctggattgtggggagtttcaggtgctgcagcccagcagctgtttattagccaattaagtatgtcagtattttgca

SEQ ID NO: 6345 - DNA, 480 bp, mus musculus
agattgtgtgggacctcatagctggggaacttagcagcctggatcccaacacaatcaaaacttttgtttttccaaagataagcttcagggagaggccagtttctctacctgaaagatgagggaagaaggaagagccatggagaaagagagatgagaaggaagagtcaaagtaagtgggggaggtggtgaaggttctctgagactcggaagtatgcaggttgatacataggagagtcgtgtgttgtggctgagaccgatatgagcatcccgtgtaaccagcattcaaacatcacccttcttaaggttagtttgaatttttttggtcttagaaataatctatctggcttttaaaaagccaaaacaaagcaaaagcatttcttcctgatgctaaaaaaaaataacatattcattatggacaaattggaaaatacagaaaaatataaacagcatggaaaagtcacccagagataatcactgttg

SEQ ID NO: 6346 - DNA, 955 bp, mus musculus
agaactacaaaacaatagcagtagggcagaaacttgaaagaaggcaggagatcatggtgacagtggatgggaaaaagtgagggttggggataagggttgcgggttgtcgaagggtggattttctccttcagcaactacaggagatatgatgcctcataattcggagccagaagtggggctttgggtgagatatctttgcacagataacatgtatacatcatagttcaaaacccagtagtcattgtttacagcaaataaagaaatatttagtaaattatccttttgtttatgccttaattccaaaagttgtttagttagccatgtttacattaattaccaactattaataatctgtctgcttgttagagaaagtggcttagaggtcagagaaattgacttgtgattttttttcacagttaacttaaaaacacccataggacattttctcttttcttttcttttcttttttttttttttttgagatggagtctcgctctgtcgcctaggctggagtgcagtggcacgatctcggctcactgcaacctccacctccttggttcacgctatcctccttcctcagcctcccgagtagctgggactacaggcatgtgccaccacgcctggctaatttttttgtatttttcgtagagatggggtttcaccgtgttagccaggatggtctcgatctcctgacctcgtgatccgcctgcctcggcttcccaaagtgctgggattacaggtgtgagcctctgcatctggccaacccataggaaattttcaacagcatttgctataaacatgttgttctgggcattatcctttaagtcatacatgaatagttttctttaaaattcaataccagcaaaaacactgcttttttttatattgaggtttatacagttgatcatactttcaatattcatatttttcttttctgtgatccttgttttctatt

SEQ ID NO: 6347 - DNA, 955 bp, mus musculus; identical to SEQ ID NO: 6346

SEQ ID NO: 6348 - DNA, 293 bp, mus musculus
taaactgttctatcttcatgatataggctggacagaagtttttactgttgaagcacaggctctgcaatattcgatctcagagaagagttttgagaaacatagctgtagaaaattcattagaaaaaaatcaagttgatctagtgttttatctagataaggacacttattactcatgtttctgaggtcacaatggtaaccttgaggtggtatcaagaactcagaaagtcattgaatcagcaatgaaggaaaagttaacccctatatgtgcctactaactgtaaaatacaaacaga

SEQ ID NO: 6349 - DNA, 536 bp, mus musculus
tacacttcaagtgggtgaattacatggcatgtgaattatattgtaatagggctattttttaaaaaataaaataacttggttcaaggtaattgtgtatcaaaactttttcctgacattgtgtaaattcagagaaagtgaaagaccaggataaatctaagtaaacgattgtttagataaagtatgactgtagtatgaaaaatgcttgctatgatggatatttgagaaatttctttttgagtttgtttatgtaagcagtggtcaaatacatatttaatttctcaaataaaacacactaacgaaaaggtcctataatatgtggcaaacatcatattcctgattacagttaatcagctttctgacagtctgtgggaattaaatgttgcaaagctgtagtacattatcaggaattccttacagcccagtcttatgttaacacttcactttctcccctttaaaagtcatttttattaacaacaaaattccttccttgtgatataagattttttcttttttgttacttttctgattatttttaa

SEQ ID NO: 6350 - DNA, 187 bp, mus musculus
ccagaatcccctctattatgaacccgtctctaatattttattttaaatatgtgattattatttttggttaaatgtgacttgctccccttcagaccaacagaaagctttttctagttggtctcctgagcttcctctcttccctatattatgaaaataaaaaaagtacctcattttaatcaattctaag

SEQ ID NO: 6351 - DNA, 1198 bp, mus musculus
gctttctaatatcactccccagggctgcattttaagatttcattcatttctgtgtggtggggatggtatttgcatgtagaggcagaaggaataggatactatatatacgtcactgtgtttgactatgtgcttgggtgtccataaactcctgttcctactcatggtgactgtgccacataaagacaaatatagccaaaccaatttgcctcagtttttcccttgccacctttgatctagctcattattctctcttgcacatagtgatgctcactaaaaataacgtttgaattctcttcttagtgtctttcttttcttttttctatgattcttcctttcaaaacttaatggatcaactaatgctttattcctttttttgttttttgttttgttttgtttttagagacagtcttaagagctccgttgtccagactggagtgtagtggcatgaacacagctcactacagcctctacctcctagactcaaggggtcttcctgcctcagcctcctgagtagctgagaccacagacacatgccaccatgcttggctaatttttgattttttggtggagatggggatctcacttttttgcccaggttggcctggctcaagtgacccttccgccttggcctcccaaaggctagattataggaaagagctgtggcccccattgcttacatttattgaaatttgtaggtattttaatcaaattgcaggctgtaattattcttagtgatgtctaacttttattgaataacaatggaaaacttggaattacccacgttccatctacaataaacatttgagttcagaattaaatctaagaataaggcaaagagtaattttactttttgattgattaatataagtttaaataaataatacaaacaaatagttcaggattcaaaagttacagaaaagtattcagtaaaatacttccttttcactctgttccccagtcattcagttcccctcccagaagaaaacaaatgttattagttgatctttttccttccaaggatatatgtgtgtatctcttttattcatttttaaaacaaattatagcattctgtagatactattttgcaatcaattttttgagtttgtcttagtgttcattcttttttttcagtgcttacaagttgtttgttcttttaaaaagtcgtggtatttcactgaatgaatttattacaatttat

SEQ ID NO: 6352 - DNA, 947 bp, mus musculus
cctagccttttggaaaggaatgccctggggtggctgggcggctgcccctgacaggctgtgtcacttatctattcacattgattatgaaagtcagctgtggccagatctcgcttttttccttcttctctcagcccctcttacaagcacccctgcctggattttcatgaggaaataatcagattaggcctttcacggtgagttcatatggagttctctttctccagtgtgctactaactgaataaacgtgtttagtggtaaattgtaaatgacattatgattaccaaagccagcatgggtttcatttaaaaatgatcagaattgcagaccacaaaaattgtgactggcagataggccatttggagaagtgggagaaaagaaaagacaaaaacaagggagaaagataatcattactcaaaactaaaccttccccgagtgacagaagcaggaagaaaacaaatccagaggaaggaaaaatggaacgctctatagaagtgatgctgaactgtcactgcaggctcctgccagtagtggctgaggattgagctctgaagtctgtcaccctcttaagtagttaatgtgtattctctgccataattaagaactacacccatttggtggctctggaaccctgcttacgtgtgctttatttttgcctcacgccaaaattaaaataggaggattgattaaaggtgacctaggaaaatgaataagatactgacaaactaccccatctcttagtcattggtaaactctgaaaaaataaaaaatacatatattttttaatttatgaagaccaggatttcaagtctggctacaaaagtggataattaatattacttgttgataatccctaggctattgtctttgctaaatatgtggctatatctttatactcctgggatagtatgataaaatattaaaagggccaaatgaagacataacacag

SEQ ID NO: 6353 - DNA, 989 bp, mus musculus
gaatgtgaaaattggaagcttgcttggaattgtgaactcgatttggtagtagaaagctggctactaaagaatacttagattctagaatggaatacagtcacacagccactgaagaaatgtctgtggggttggttcagattccagaagcaatcaaaatctacctttgtcaaaagtgcaagataattcacaggtcatggagaaaatgtcatttactctctagatagcctaatcctgcaacagctgcattttgaccctgatttttcctttctttcaacagtattgctagtctatttggggtaagtttgaagaagcgcccaaggtgatggtgataacgatagctgctatagaaagaatgtcagaccttgttaagtgtcttacatacaatctcaatattaatttcacttaactatgagatggattaacattagccccattttacagataaggaaacagactcagataaacaaagtatcttgtccaaagccaaaggtcttagagctagaatgtgtagttctaattccaaatcttatgtccatagccaatatatggtgggaagcacactcttcttgccactccactccaaggtttttgtgagcctgcccattgctatcaaaccctagaatgactgataggctgacaggtatctctgatgacacagctcttttacatttccagggcagtgtcttcttgggatcaggactcacaggccagaacttcttcacagcagagcaggctgtaggaagagagggtgtagacagccatgaagagccctgggctgagctcctcaggggctgacattcaatcactagttaagccttttaagctttttgagccttaattaagcatctctaaaactgacaaagtggtgcttatccttcttattccaaaagtcgtctaaagaggtagaggagcaagaatcttggaattcatctaaaatttctccttcctcctcctttccatatctgttcaatcaccaatttctgccagtt

SEQ ID NO: 6354 - DNA, 989 bp, mus musculus; identical to SEQ ID NO: 6353

SEQ ID NO: 6355 - DNA, 1031 bp, mus musculus
aaattatttttgcatgcttctctaatgtttataaaatgactctagtgaatactttctcatctttaggaccttttaatatatcttattcctcattaaaataaatttgagcatgattccaggctaaacaaatttcttaaagacagcaatggcaacatgcaaaatatctccatctagtgttttctcttttctaaacaagaacaaattatcttggaatctgactaattttgctccaggaaaaatacctttgcacacagtacccggcacaaagtttgtgttcggaaagtgctagtggtaatcacacagtcattatttctttttctattttttttttttgagatggagttttgctcttgttgcccagggtggagtccagtggcgcaatctcagctcaccacaacctttagctcccaggttcaggcgattctgcctcagcctccctagtagctgggattacaggcatgtgccaccacgccccgctaattttgtatttttagtagagaccaggtttctccatgttggtcaggctggtctcgaactcccaccctcaggtgattcgcccgcctcagcctctcaaagtgccgagattacaggtgtgagccaccgcacctggcccacagtcattatttctatcacttcacgctgagcagggtgttgtgagttctgcacaaattcatccacactctccaagggctcccagacgtctctcaccagaacaggagctctctgtccttgggagggatttttctccacccacaacggaataagatgtagttcatcttccctgggaaatgggggatttcttgctttcctccacattccttccctgacattcagtctgcatgatcaaagactctctcaggcatcaggaagaaccttccattggtacacacacacaccacccagacattctggcagcaccgccctttctcactatggtccccaagtgttctcagactacagaagaaaccctactggtccacatactcattttttctaccttttgattcccatctattatgtgtttgtgtccc

SEQ ID NO: 6356 - DNA, 530 bp, mus musculus
tcatcattatatatgctttagaaggtaaagctacttactgcttataatggttatatgtattttgtaaccatggggtgcttataatgaagactttcatatattattttttaaattttatttggatggaacataagatagacctatagtcatgacatggaaagataagggaaggcctagttacagaacctggggacaaagttgcaatttcacctctttactcctaaaggattatctttatttcttactcaaatgaaattatgggatggattatttgaactacttcagtaatttccttgccaaaaccactctcctttctatcatgatattgatgagattagttatgtgatgaaacagccctagaagataatacatctagaaggcctgttgtattacgtattgttgatagataagtgggctccttaaatctcacaagggatccttcctacaatataaagcactgatttattactttttgatgataaggtattttgacatggatacaatgaggaaataatgacacatatctttaa

SEQ ID NO: 6357 - DNA, 931 bp, mus musculus
tatattgaagagggaacaatagataaaagatcctggggcagatatctgggggatagcagaaaggccagtgtggtaggaccacattaagcaagggaagagctatccatagtaaaactggaaagcaggcagggtaggaattatcttaggccaggtaaggagcctgaattttcttttaaacaaaacagaaagttctgtgtggaagtgtgacatgacccaatttgttttatgcaaagatcacttctgctgttctgttgattgaaaaatgagcaaatgagaacactaagagtcaaattagccgaaaatgctaagactagggtgatagtgggataggactgatttgtgagaagttttgcaagcagagtcaacaggaccttttggttctgaaaaagagggcattcaaagatgactgcttgtttcctgtcttgatcacctgaaagatggctgagtcactcacttaagcaatactagggaaggaataggtcggggaaggaggagtgctagatgacaacttatgagtcatacatgtgaggcttgcaaggcccactaaaattttgggtagagattggacacagattccagagatgaggaagaggtcagcactggcaatacggacttcggacttcatagttaatggcatagaaatcacctacgataatagaggaatacagagatcatttccaagccctgaagcatgtctgtaggttttcagatttacttactgaatatattcaatgaatgtcttcctgttgcctgaaactttattacaatattattttctgatttactatagcagggaaacttttccaattgccacacattcaccaacaccgtatcttcttagttttctaacctcaacacttggaagttgtttttatttaataacgtatggatgttcttttgacatgaagtcttttggttctttctttttact

SEQ ID NO: 6358 - DNA, 268 bp, mus musculus
tctcctttttctttcgggttcacttgaactttccagagttcatcatttcctgtttaaacaatatttagaatgctattttcttataatagttttattcgtgaatacatgtttaatacatactatgaatatcttacataactaccccttgggagtaattagagaggacaatttcttgtgaaaatatttatacttttgtcctaaacttcagcttaaaattaaagggtgtggggaagataattccattagaataattgttggaccaagaata

SEQ ID NO: 6359 - DNA, 663 bp, mus musculus
caaagattcacattttttaatgtattacggacatacattaggtgctcctttgaattttgttggccccatatttttattagaaaaaaaggctcttaacaccaaaacaactgagactttctttcaatttatgttgaactaggtaagtaaaatctaagagtatggaaattttatactttatttttccagcaatttacagctagggtctgtaacataaatttgtaaaaatcatctgtccataaatatagtgatagtttaggttctatttatttatttatttatttatttatttatttgtttatttgagacagagtctcgctttgtcgcccaggctggagtgcagtgacgcatctcggctcactgcaaactccacctcccgggttcacgccattctcctgcctcagcctcctgagaagctgggactacaggcacctgccaccacgcctaattttttgtatttttttagtagagacggggtttcaccgtgttagccaggatggtctcgatcttctgacctcgtgatctgcccacctcggcatcccaaagtgctgggattacaggcgtgagccaccgtgcccggccctctttagttattttaaaataaaaattagtctagctatcttagcatggaaacagtgatggattgtgtatgaactgaccatgtat

SEQ ID NO: 6360 - DNA, 300 bp, mus musculus
tgaagaaaagaaatttgtaactccctaccttaaccctaatgaacttgggagcattttctaaatattgccttaggtacttagggacatgggagccatttcaagcttctgtgtctctgtttgaaactagaatttaggagaaaataatatataacttattgtgtacagattaggaggcaagagtccttagttctaacatcaaaagtaaaactgccataatatgaaaacattatcttcacaatagtgctgtgttttgcattgtcagccctactgatgtatggtaaatatgagcaaaagccctta

SEQ ID NO: 6361 - DNA, 991 bp, mus musculus
ttaaaatgaagataattatcattgaccagcctctatcacagttatgatgaatattaaatggggtaatgcatatgaaaggacttagaaaattataaagcagaatattaatggatggtttaaatatattgtagaaaatataatagaaatatcaagggatgattttctgcatagttattaattgatatgtatatctacacacatatgtatatatacatatatgtatatcctactctgtaggctaagttaacactcctctattagaaatgtcagtaatacatctcgcttgctcacttcctagacagaatgattcttgtaagtatttcatttatatactctccactgaaatatatactgtgtgaggatagggctggctggcagtatctcctttggccaacactgtatccccatcttagcatcatgcctagcacaataaatatttacttgatagtttgactgatggaatgatggaatggctgcctataggcatgaggagtggtgcaggggataaaatagctatccaggtaaaatttgggggctaataccccacagtcaagatgcaccatatatacagactcagatgaagaatgaaaatattaccatggctggtgtgacctggccatgcctacctctatgatttcatcttgtatgtctaacttcttattcattgcacttcagacatgctggtttttgttcattcaacagtccaggctcactgctcattaagcacctttgaagattattctccaaagtgttgacatggctgtttccttagcatccagctgtcagcttaaaggttagctttgtagaaaactcttccccaaccacacaatctaaagtagctgccccctttaccttctatcatgcagtcttactatattttgaacgtagtatcactaaccactctatttaacattataattcattgttccattataccttagtccttttcacttattttccgcatagctcctatcaccttcagatgttttat

SEQ ID NO: 6362 - DNA, 960 bp, mus musculus
aatactatgatataaaaatcattaaaaccttcattgtgcacaagaagaaactgagagtttaagtaacttgccactgtcatactgtgaacagaggatagaattgggatttgaatttggctatgctagctgtaaatattatatatacaccaatatattatactgcccatatactacagaaaagcagactttacttaccaaataagttgaaattaatatattataattttggcacaggaaaaggcaaatagagaaatggatgtaaagagatagctcagaagcagatctgtattgatatagcagttcagaatataccaaaggtgatggtcttacaaccacttactgaagaagtgacagattattcaatatataatcccctaaacattgcctattcaaatgaaaaaaaaaacataaatgagtactttagcttatatggaaaaatataactcagaataaataaatatctaatttaaaagaatagctatagacctcagagcaaaaagcatttcttcagtaatacacccacgccaacaacaacaaataaaaagtatgattcattttaccacattgatgcttaatatagctgtataacaaactgtatatatatatatactatatatagttaaaccataaatgatacactgcaaaattatatttgcattgcctgtaactaaccaagatttagtgtctgaatgcataaaatgttgctatgtcataacaaaaacaattaataaaataaatcaagaatttggacaaatcacagaaggaaaatcttaattgctaataaacattttacaaactcagtattcctagaaattaaggaagtgtttattaaagcaatgagatataatttcatatctataaaattgacaaaaatgcaaataaacatgtatataatagtacttaatgggcatggacttggagaagcagaaccttgccaacactaccaataggcatgtgtac

SEQ ID NO: 6363 - DNA, 416 bp, mus musculus
cttgaactgttcagcatatatgtacatgcatatatatatatatcaggatgtataatacatatacatgtgcacacatatatgctttcacatataaattttacatgttttcatatgtaaattcaaagacatgattatatgttttatatatatatttatatataaaatttgttttccaatgtaagagtaaactccaactggcagataaccacttttaacctgtttttatattcaggctctcttgcttgatataatcctgagttcaaagtcacttttaaataataacttactgagtttaactgattttgctttgaagtgtcttatagcataaagaatgctatacatgaattttacttttagggtaattctaaatgtatattgcatgtaatgagaaggaaacttggagcattaaggacagt

SEQ ID NO: 6364 - DNA, 736 bp, mus musculus
atttgggttctaattcctaatcctaaaccattgcgctttcaccaacagaggacttagctttccctatatgattttagcagagggataatgccagatattatcccagattccttctgtctaagggacaaagggcaccatactcaagcaatcttaggaattccaggtgagccttgatggagaaacagagggctgaaaactcctggggtttcctgagttacaaaatcagtcattcctccctggctgagctggatacatggaaatgtagtggacaagaaaagatattgcctttttgttcttagagcatatggtccagtgaagatgacagaaattaatcaaataaccacagaaatattttataaatgtcattttgcaaatgagagatttttgtgttctgactgaaaggggatgtgcatatgaatcttcagagggatctcaaataatgttctctcctgactagtttctcatgtacccttttacgtgggtggaagggacttatgctgagaaaagcacactttctttctcttccctagagggctggaatctgcatgtaggtagagcaagagggtataggttttaagggaatctctcccctaaacctatccctatcctatcaacatcttctggaaattcccacaaaccaaaatatattgggtttaacaaacaagaaaaacttgaacagaaaaaatataaaagagataaatataatattcacataaacaaactgcaaactcttcct

SEQ ID NO: 6365 - DNA, 6 bp, mus musculus
agtagt

SEQ ID NO: 6366 - DNA, 1132 bp, mus musculus
gcttagcatgtcagattacatgttttaaataattgcttctttctactttccattaaactactccaggattcacccggcgtactggcgcataatgcctaggaatgaaaaattgtttcatcatcacatcatataccttcttatgtgtttgagtggtagaaaatattataaaaatgcagcaaattgtgcattcaaaacacagagcagtctgaaagaaaccacaaattttagtaacaattggaacaaagacaatggaaacattatcactagagtaagcatccaagttttgcacttcatttggaagacattaagaatgaaaccaagaacaggacatgtgtcaattagagcgggaatactttggctcagagtgctggaaaatcagtgaagtggaaccaaacaaacaaaaattagctatttaactactttccaaaaaataaaaaatttgtttctaatgaaatgtgtacattatcccattaatcttttaattaacccctgtcagcagtgtcaagaaaaacatgaccatggaatactgattttactttaacttgaacaaaataaaaaatgaacaattgattttcattttaaatgataattattcatccaaggaattgttcctgtatcataaacctatttttctcttcctttccaagtggtatatattcctttaacacaaaagatagagtaggagtgaaatttcatcatttaacgtgggaaaagaggatcttaaaatgtaacctatataggccagttaattagaatagaaattaaccatgtttaagtttttctttgagacagggtctcaagaaagaatcctgctccatcacccaggctggagtgcagtggtgctaccttggctcactgcaacctccacctctgtgatttaagcgattctccttcctcagcctcccgagtagctgggattacaggtgcctgccaccatgcccagctaatttttgtatttttagtagagacagagtttcaccatgttggccagcctggtctcgaactcctgacctcaactgatccacctgccttggcttcccaaagttctgggattacaggcctgagccactgcacctggcctgtaatttttaattcaatttattccagtgctctgataaattggttaccaatc

SEQ ID NO: 6367 - DNA, 602 bp, mus musculus
ttaattatgttagtttagtagtctagataatgtattttactatttcattaatttaagtaaaatatacttggaaatcaattttttgatattcatatttcaataatggtgatgtatgtgattgtataacaagttgtttccaaattatataacatagaaatatctaatagaaaacaattgtctcaaaaataaaacaatataatattgttgaaacttcaacttgataatcaaacgtaagagcttcaaaatgagaatgcattttttagccaaattaacctaatcatagttgcctgggatgtaatcgagctgccatcaagatatgcatcacctcaggttagctttcgtccaactcttcataagtattaaacagtatattttggtagcattcacagagttgtgagtttgatttagagttggacctagcactgttgtaaccatctgctagatctgtgtctcactgactccagaggggacatgctggagtgagctgtctcacaacaatccatcctcataggtctactctattaagagataagttaaaggttttaaattgtatcccaaatcaacactttgtagttatatcacttaattgccattgaaaatgt

SEQ ID NO: 6368 - DNA, 122 bp, mus musculus
ataaaggttgaagatagtttcagatcaattttgcctccaatactattaaaaatggagatgattaggagatagtttagggacatgtatctcagtgggtgtcacacagtctaatctcctacaaa

SEQ ID NO: 6369 - DNA, 284 bp, mus musculus
ttagctccattgtttaacaaaatctttagctattaaaaatgctctttaaaattacatagttttattttgttatttttgtcgcatataaaacatatcaccttttgttctgtcagcttttctcaacatcaaattgaaaccatctcatagtgatggccagatggataacagttttacttatttcatttctctagtgagttttctgctttgctatcatcacctctatcagtttgactcaaaattctaagaaactttttcctctacttttttgtcttcagtattaacat

SEQ ID NO: 6370 - DNA, 596 bp, mus musculus
ctcatcctttttcttcttcagaaatatatatatattgactactctagtaatggccatgttgttatctcttttcattatttgctgtattttcttatgcactttttcctataaaggctatcatattatagacacaaaaagatttctctaagcttaactgttaggttgcatctggataggcataactacagcatgaaactttatttttttctcttccatatcaaaagaaatatgaattgtatatagagaaaatgcaaatttgtagtgttcttcttttgcccactagtaacttttctgatactggcatttcatcttccattgattttccagtgttaagaaaaacaagcttgataaaatatttcaccaaaacagatagttgtatttccttgaccactacgttcaaataaaatcgacctttttctcaatcctggaaatgagccaggcttacttctgcttcagaaattgtgtaccagactttgccttagaaagtgagggacataagcctggcttcctgtaatgagatgttagcctcatgagatctccttggagaggccttgcttgctgtatgtatgtgtgtatgtgtgtacgtaaagaaccct

SEQ ID NO: 6371 - DNA, 236 bp, mus musculus
tttgtttttacaaacatatctaacataatttatatagttatcttcatatattaacttgtatggactgtcataaatgtaaaatgaacaaattagtgtcacatgtcagtacaattttatacctcaatacatatatctctttttagtttccttaattttctaaattaaaaaaaatcaattgatcagaatagttttccatgcaataactaatattcaaaatttattatttaattaattat

SEQ ID NO: 6372 - DNA, 495 bp, mus musculus
ctaaccactcacaaaatggataatggtggaaaaatgtctgctccaaagtattttataagaaatcaataatatttttactataagaaaccccttatactatataaagaaaaaagaaagtttaaaattaaccaacaaagggttattgttcagaacccatagacacatgtactgcaaggtggccaggacgctaaaaccaagaccaaagaaatcgtgagttacatttgcttgttccgcctcaggcttgcatctctgcttctctaaacaaatcagcttcattcttcatcacaatgagaactacaacttgtacatacctttgcttcttcctaaaactcttacttagaccatcacattacttacctagacctatcgtttaagtcaaaaacaaaacatcacctcacaatgagcctcttcatgtcaaaatcagcttacattcattattttaaaaaatgggggaggggcataaaagagctctcctcaccaagatttcaggggata

SEQ ID NO: 6373 - DNA, 425 bp, mus musculus
aaatatacagtagagttatctgcatggtattacctttttggactgttggaatatataccataattttagagtagttcctatactcaacttttagaatatatttactttgttgcagttttagcaatgctaccataagcattcatattgttacacagttgccttgtcagaaacctcggataaattcttaaacatgtgttaaaggtatgcatatctttaaggctttgatacgtatgggctggataacttcaagaaaaggttatgcaaagttatattgccaacagcaatgatgtaacacaacttaacttttaaaaatatttttgaagtacttatttgcatgaattaccgaatttgtaaaccggttacaaaatatcttattcaagtaaagcccaattttagttatagggaatgtgagataatggttttat

SEQ ID NO: 6374 - DNA, 750 bp, mus musculus
aacatgtaggtattgagaaaacaattagaattttaactatttctgtccatattttgattaagaatataactgtataggatatattatacatagctctctaaggggtgcaacattatttatctgctcaatctgggaatattttcagaatttgtccatttgaaatctatctgtttaaaatgtctttggtagtaactgaagaagttgttctaacttactcagacttgcaaaaaaaaagtaaaacctaaaaagatgtgagaatgattgaaatcacatgtcaaatgtatggtttacaatttattagaaagttcacttaaacatgaataagggtaacatagattatcaatattatggttttaattttacttccaatctttcactacaaaggaagcactaaaatccttaaccatgcatgtgcgaagggaattttctttgacccagtcctgtacagatcttttattaatcatcttaattcttaattctgcactgcctgctcatttcttgctgtgattgttttgtagtgatctatataaaaatggctactacctcctatccagacacagtctcaggattttgtgtcgttgtttttgtcttttgttgatcaaaggctctatgtgcacaggctccatccactctctttctaaagcatttgtcatttccttccattaggtaatctctgcagttctctggctatggctgttaaatatctggaattagtttatctatattgagtttgcctcattgcaggttcaa

SEQ ID NO: 6375 - DNA, 794 bp, mus musculus
aagaaaaaccagaaaccaatgggcactgctaggcgaagataaagccaataggtctttaacagttagagacaagaatgatggcaaggatgttatatgtctattcattctcccatgttggcttgctggcaaaaggcagaggagtaaagagtaataatttgaaaacctgctcttagcatgtgtgatatgtcaggaacttagaaacttttatttaatatttgcaattggtagttgtaaaagtataatggccaggaagggcagagtcaagatttcaactgagggagcctgtcttgcctccactttgcctatagtcttactagggtgttctttgaaacaacattgcaataacaaccacaactcacaatttaacaggacaacttgtaatgaaacaaatacagatgactttcattacagacgggatcaaacttacttgtatggaataattacacaatgacattacagagtggaatatagatactataatggaacaaataattttgagtgaaagtgttttccctattctgacctcctctgagagtacaaaaatgaaggtatatgaaaatcctagaattacggttctgtaaaaggatcctcagtgatcttctagaatactatgttagggtcataaagcaatattgcaaagtgcttatacctttaccacgtagtcaacccaaatgggtgttattaaaaagtataattctctcatgtaatattaaatcttttatctaatttaatttacagaacttctttcaaatagttagcaaccttctagatgaagaaaacaaggaaaaatggga

SEQ ID NO: 6376 - DNA, 1129 bp, mus musculus
tcaaaaactccagaaactaaatcctgtctgtgaaacagtgtagaaaagaaatacttcacaagagttaattatttgggccacaaaatataaaataaaatctctcatttccagtggatgaaaattggcgcttctaaatcagagtgctagtaatgttcaacaatttgagcacaacacatgattggctgtgaaacagtgtacagaaacatgtagctccacctgttcagatattcaaaagtcatttcatggttattataagataaatttatttggacatgcctagtcatgcatgcattagacatgtgtctcagccaaaataaattgcatttcattataaaatggaaaaccaaagctcacaataggtccatttttcttattttgttctttttcaaatcaattattttacttcctccattctctgttttatttatttgtctttgtctttctctatctctgtctcttttaatgtaagaatatctttaagaaaagtttctaactatacgtttctaattatacatttaaagacagcatgtatgtgcatacattcgcacacacattttatatatatacacacacacacacacacatgctctttaaatgttaataattaatcacataaccctccttttggtggctttggtctcactgtcagaattgctaagtaggaaggtacaggcagccagtgatggctcccttgtcaatctcagtgagcctgagcagtcgctggagcttgcagtatcagttgctaggcaacctgttcatctgctgtgcctgatatttcaattcggcagcagtaaaggtctgttatgttatggcctttcagaactaccttcattacataatatctaccattataataaaggagctttaaatgtttaggggtgtgagagtagcaaggaaaatcagtgcagctgtgccactcagataatgtcaaggtagactttctgcatataaaaaagtataaaattatgacatatttaacactcagtccttcctggcagagaactaaaaaagcatcctaccagactatttacttgatgatatcaaatcaggtcttgttaccattctagaaaagtttctaactgctgctataatgaaggtaaaacagcaatggcctacagaaataagaaga

SEQ ID NO: 6377 - DNA, 338 bp, mus musculus
ctaaggaaaatgaagcatgtaaagttaaatgactctcccaagttcacaagaccagtaactcccagggctaggattagaacccaaatccatctggcttcagagcaggattccttaaccaccggtctattgtggcctttgggaatttaaaacctgggagagtgactttcacacttatctacagaggcctggggttctttgtatgtgctacattagatgtaatgggaagcaggaggaaccatatcacaggcagatcagtccctcgttgataattggaattctatttaaaattttgttttacaaacatacatcctctaatatttttttaaaaaagaagttcc

SEQ ID NO: 6378 - DNA, 488 bp, mus musculus
agtctttttgtatgttatgcattattattttacttactattatttgcttgttatggttctgtaatatgcactctatatctgagaatataatgaatctcaaattatcttgatttactcaaggacttttttagaaacttgaaaataacattctgattgctccatttcattgaaatattaaaacaccaattgtaatttactttcatgccaactttctagtgactggtaaattgaaaattagggtttttttctgactttgatagattcacaatctgattatttggaagtcacatactacccatgttaccaacccaatagactggaaagtgacactggaacaacctgagcatgtatgtaacacatcataactaatcttattaatgccattagtactgaattggagttacactgacacaaccttaccttatttagtccataaaattaggtagttcgaccgattaaccctgtttctaaaaggttatgtttaaaga

SEQ ID NO: 6379 - DNA, 1025 bp, mus musculus
caaagactaaattggccttatggtttttaacaatatctgcaacttttttgctgcttagctacagaaaaaaatacactacactcacgtagtgcaatcctctatcttttctgcagttgtacccaggttgcttagtactgttggagaaaatgtgcacacaactgcacattggagacaccagatgcccatgatctaacctcagtcaagctttcctaaaatccttgtttatatggtcatctccatttcccattcccatatatttgttatataacttcatcatgattctttcctcatgaattactctcaaaagattatctttacctcttctttgatcaaacagcaacttcctctatgtccatctctttccctccaacatgcattaaatctctatattcagacttattatctgcttttctttcatttcaagataacacagaggatcgcactataaaatcaaactcatgtgaatcagggctcttatccctagaaagcttgctaataatttcaaagatacaagcaatcaagaggaagtgatgaagcagagagaagtccaagacctccagtgcagcctccacacccagtatttcattcctgaaacacccatcctaacccttgttcctgatcccaccccaacttttcttactaaccactctccgccagtgcagatgatgcctcttcatttgttacaactcaatttagatgctgctgctttcagtaatccttctctgaatccctgtctgggcagagatgctcaacccatatgattgcagacaccccatgcttgactgcatcatgttactctcctcgctatattgtatatgtttttctatctcctccctggatggtaagcaacttgtaagtagaattatgtttttctgtatctctagctattagcctggtgcctgcaccaaattaggtgtttaataaatgcttgttaaagaataaaaaatattaaggatctctgccctctggtacattataggttagaatgggaaaagtcacatggggagaagtgatataaatacagt

SEQ ID NO: 6380 - DNA, 208 bp, mus musculus
tagtttttcctgcttaaaacctattggtgttatctttgtaaaaacatcttcacttgtttggaaagccatgttctaaacccaagcccttggcccactcagcctctttgcaccatgtaccagcagcccttgccttctgctgctttcttatgccaaagtcctttatgcctcagggtcactgcctcctaggggtcttctcactctccttcct

SEQ ID NO: 6381 - DNA, 983 bp, mus musculus
ccctgctcctgtcttccattgaggcagaaggtaaaaggctcccttccccttcaccgagtgacaatgcaaaattcgagaaaggaaaaaacacatctttcttgcttctattgcttgctctgttttccctgcgcttcgtgctttctccggtggtttctctccttcagagaaacgcccctttctcctgaggtttgtccatttcccagctctcaggtccagctctttcgtattctgcttaatgcattccgtacagtgctgtgtggtcttcttgagcttgtctctgcggtgtgctgtccacactgccacctgcactgccgcctaataagaggaccagccgcccgagagggggcgacggctctaatcagcgcaaccaacaggacacctccgggtggcacccaggagccccgaagagcgggcgcactcgctcgcttggctggtaaccaaccacctggctcggggctgcgacctcggtgacagaacacaataaaagactccaacagcgctggctctgcgcctctgtgtgctttgtggggagctcagtcggcggggcggacggtgcgggcagatgagccagcagccaagcagcctgggggatgatggcaggcaagcggagatccgggaccccaggtgttcgcacgacctagggtcgcggctgtccctgttggttagcagggctccaaggcgcgtggcctggactggtccagctcagacaggttgagcctgggccaaggtttccagcctgggaagcaagcgcgcgccggagttgctgggcaccacctccagtgtcctgcccttgctccatcctgcctccctcagggacagccgggtgcgtcggaccttcccgcggaggcagtggggcgctccgagatgggtttccaaaacggcgccgtgtggcccctcctctagaaaatggagggcttttgttagatgtcccacccaattttatttgttgtgtgcacttgatgtcttaatttctcagtgttcat

SEQ ID NO: 6382 - DNA, 601 bp, mus musculus
tctataagaatttctgctgcaattttcctcctttttggcatatgtagctcattttagcagcagtgactttatttgctgtatgtaattacttaattttactgggtttactcacattgttatgccattgtaacaaatttatgtattcattcatgtgtagctgcacaatatttaaagaagctgccaaatgctatcagaagcaacacagaccccaggcctaacaaatgaagcagcctggtaagatagaggggctgctggcagatgtgatactgctctgtgggagaacaattggcatggatgtttgcagataaagcaaataaagcaaagtgacatgtgcctggtatcagtggttaataaaaacaggtactgtatgctctatctgctaacattacttgcagatttcaaaacttgtagtgactagaaaatatacttttatatcactttctatgggtcaaacactgttacaaatattttatatatgttatttgttaaatttttacaacaaagatgtgagatagatccttcattatcatcacctctgtttcccaaatgaggatagtgaggtacttggagattaagtgacaggcagcatcagagatgggct

SEQ ID NO: 6383 - DNA, 684 bp, mus musculus
ggaacaagtggaacaattataactctaatagttactagcaggaatgaaaagtggtacgaccattttggaaaaaaaatagccaagttttttgtaaaattaaacattcagttaccaaataactcagtaattacactcttaggtatttattccaagtaaatgaaagcttatgcccacacataatcttgtgcataaatatttagcagctttattcataatcaccccataaaggatgtaacccaagcgctcatgaacaggtaagttgttaaaaaaaaaaaaaaaagttttggtatcgttcatgcaaaagaattctacacagcaaaaaaatagaaacaagcttctgatatataaaagaagtagtgactctcaaaaacatgctgaattaaagaagccatgaataagagggtgcatactaccatgttatttcatttatatgacattccagaagagggaaaactaatctatagtgacagaccacagagtagtggttgactggggctgggattgattgcaaatctttgtggtaatatcctgattgtgatggtagtgatgttttggattttgtcaaaacttatccacttaagatgggtgcatattattttatgtcaatgttacctcagtgaaaatttttgaaaatgttttaaaaatgtcatttatgtaaagcacaagaataaagttaaatatttc

SEQ ID NO: 6384 - DNA, 1046 bp, mus musculus
gtttattagggatatcaaagtatttcttattaataatccacaaaattttcaagacatacctatagctgaagtaacaaatactgatttttgtttctttgaagttttgttgggggttttagcccttagcctgatgctatccagtgagggacattatttagcagctgcatgatttattgctggttgcatttggaaatgttattgattgccattgtcacatgatctgtattaggaagccatggtccattctgaactgtgtatataaatattgttgattgatttccaactatagtaatggattatatggctgcctctatttgcagcccaccttagacacacaatttcttgcttataagcccttaaaggtaattatgtctgcttaagtacttcgtctttcaggggttataatctcccagcagccttgccacttactaggcatcagttaagttcttaaaatatctcttgtgttttttctagtagcagttgtctgagcttcacctggccatcctggaggtatttccatatccttattctcatttgcttcatcccatacagctgtatgtacagggaatcgttttcatgacagggaactggcaacagtcacagaactcattgccagatagttttttgccacttggctcctcatagtgaccatttcaaaagctggatatgacatttatgatagctttaagtgtcactatcatctggaaagctgaacacatacctctggagcttgatactttactgactcaagattaaactttgtcagtttgtcagtttaatcttggcctccttgattcaggaaaccaaagtacctatcatcaaataatgcactatgtattttagctccacagagtagatgacatgtcatgattgtgggtagggctaagtgacagaggcttgtctgaaatctggtctgtagataagtactcattccacagttagcaagtttcttcctacatggaaacttccggaagaacagcaattcgcagaatcatttgagaaattaactaactttagctaccatcataatgtggatgatatcttgg

SEQ ID NO: 6385 - DNA, 472 bp, mus musculus
tctttttatagaacaagagtagagggcttgggtggacaaagaattatggcaaagttaagtatatgtaggaggttttcttctgttagggcaaacgtaatcttcatgacacctggcacaagcggttcagtgttgaagctgtaatgaattcaagaaacagttcaaaagccaaaaataatttaaaaggaattccacatttcattgtattcctagaaaaccataagaaggatcccaattcatagtcctcaataacactcactaaatctccatgtctctcaggtcttcttcctgtagccactcccacacaaactgttgggtaacaatgagacttcttttgtcagattggggctagtctgctcaaaaaatacaatgttatcatttttttcccatcataaattaatacagagattgtatgcaatgtgacaacaacatttaaggtgttaagaaacataggtatgaaattagtcatgggtgt

SEQ ID NO: 6386 - DNA, 402 bp, mus musculus
tttccaggttagttcgcccaagttagttctgacatgtcaaccccttattctaaaaccttcaacaacttccgatggtttactaaattaagttcaaactctttgcttatatggtgttcaaagctctttctattccagctcctctccgccttccttgcccacattttctccctcctgtgttcctttcatcccttccattccccctgttgcactccttctctatacacacccagagtttctttcaagctagacaatttgctttccatgaatgagcccgtgccctcccatctcagtgccattgccctggggcaggaaaacagagtcatccactggccaccacatcaccttgatggtggctaacctcactcccatccatttctcccttcactgtgttcatttcagggg

SEQ ID NO: 6387 - DNA, 1213 bp, mus musculus
ctgactaaaatgcccactctaaagcagtcatgagcacaaatgggtcagtgacagaactgaaaagaggctgacatgattctaacacatcatgcatctctgggtttgccaatccctcctgtggtctcatggtcaaatctgcgctgctgaataattttaaggaaatagcggggtcttgacagctagagaagatgagctttcactcttgcacagtgtctgacaccagggttccaattttgattgtcttacatggatcagtaatttcctcttttcttgacagggaccccacactgaagtctactatattgtacagggtaaagcgtgcaataaaatacaagtacaataaactccaatgagaagattgaaaatataactgataagcaaaaggatctcagaacagtaaactggaaatacttgaactgccaaagataagatgatactggagcaatttttcaatcttaattatagtgaactctctctttttttggtcttgcatccctctgtggatgagtcaatgcttctttcttttaaattcagtaggaaatttatggttgagctagataagaaaaatgtgcagtatttgtctgatctagtttgccattatttgctgatgttagagagagtgtgtgtatgtcaggaatgttcttgcccaaactgtgagataacccggtgttgcaccctcctaccatccctttcagcactcttcctggtgagatacccagaagtttccaccccaggaagccaattctgtgtgctcttcttactctccactccctgtcatccttgacctgctgaggtgttaattctaccaagctgtcagagcagagcatgaaatgctggcctccaaagcttggctcagcttcttccttgcctagaatttcctccctgcccttctccatctgtttaatttctgcctattcttaaaggtatacatattggccagtactcttttgattataagtaactaaaatcatactcggcctagcttaagccaaagggcattttttgaactcagataaccaaggccagggcagagtagaaactagctgaccataagatgtctggagtcagggttccaaacgctgtcaagacccactgtcttcacttttcatctgtgatactcagtgattcagcttcattctctacagggaacttgcacataacattggaaacttggtcttctgcagctcaaccctttccagctttgccaacagaa

SEQ ID NO: 6388 - DNA, 1374 bp, mus musculus
tgaaacatgacctgcatgacaggctataagttgtcaatagttctttttctttggaaaagtacagttgtggcatttactcactttagcagatagctaaaagggaaaaataaggaaaaatatacactggacctgcagttaagtttttgacaatgccaaggatcaaaaacagatgaaacaacatttgctgaagatgaaaaggtattgcattggtcttaatagatgttgccatctctgggtgaggatgctgactgagcctgttctgtgtcttcatcacctctatttgtttcttcttctacgacagacctccaagagacaagatccatgtagtaagccacactaggtccttttgacccttctcattcttctgtagtctcttccctgtgacttttgacaaaaatactcagttcacaatattagctgcctgcttctgatgggtaggaggtaatcaaaatactcccaccaaagcactctatggtctagacttgatacttaaaatttagttttcagcattcctcaacaaggataccttgaggtaataggagatattttggtaagtgaaaataattcctgcttggaacacagcctactgaactcaggatttaatttcttgagtattaggcagttctcaataaattgatgtatactgaggaatgattctaaagaggttagtgatatcctgtttgagaatagatttagaaaactgaaggtactctccagctctacaattctgtattaggaacaatagggaaatgagaaagtgcctctatattgcaatctaatgagtctctgggggaagactgtctacctgcgtagtagttgagaacaagacaagctcccaaacacatgaaaatcaacttgaaataacatcaaattcagcctgggcaatatcatgagaccttatatctacaaaaaattagccaggactggtggcacacgcctgtagtcccaagctacttgcgaggttgaggcaggaggatcacgagcctgagaggccaaggctgcagtgaggtgtgatcatgccactgcactccagtctgggtgacagagcaagaccctgtctcaacaaaataaaaaacatcaaattcattccatattcaggtaacagtgacatatatctactgaattatttttcttttaggaatgtctatatctatggattgtcactataaaaaaaagaaaaaaccctaaaactgagcttgacaaagggaataaaagcatactttgtttttcttggtgtccccatgttaataaatcatttcttctctttggctcaatgagcagcattttattacaattacgttcaatagtcactaggttcctgtgtctatagaaatagaactgaagtttctgtgcatacatgggatattgaggaga

SEQ ID NO: 6389 - DNA, 1374 bp, mus musculus
tctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttca

SEQ ID NO: 6390 - DNA, 1374 bp, mus musculus; identical to SEQ ID NO: 6388

SEQ ID NO: 6391 - DNA, 1374 bp, mus musculus; identical to SEQ ID NO: 6389

SEQ ID NO: 6392 - DNA, 1374 bp, mus musculus; identical to SEQ ID NO: 6389

SEQ ID NO: 6393 - DNA, 1878 bp, mus musculus
aagacatcagaatgtgagtctagcagccttccaaagagagctaggttatggttaattaatttttgcttattatttctctgaactattaggcttttatagtgaccaagtaaattagtcatttcacagaagttgaatgataacattcattttgcttaaccttttccatttccacaaatgtctcttcttttattgtagaataaaatgttggccttgtaacttttgatgttttttgtttttttttaaacagcttactgctggttgcaggggggacagttctaaaaatttgtgattttggtacagcctgtgacattcagacacacatgaccaataacaaggggagtgctgcttggatggcacctgaagtttttgaaggtaaaatggcaaaagtatggtatgtttgataatctccctcactccttgtgaattcatatgtttttatagattttccccatttccatggttttatttctgcataatacataaagtatacaatgaaatctaaggggatattaaatatagtgttatatcctaaattttatagtaagatttaaatcttctatgcttctaagcatatgtacagttgatcctcattgttcaccaatttcttaattgcaaaattgcctatttgctaacatttatttgtaaccccaaaattaatactcatggtgctttcatggttatttgcagacagtgctttcatgtactcgcagacagtgtgcatgcgctgagcagtgcaaattttgagtcatctaacgcatgcttccagctgaggttgaacaagacaacgtttttccgtcttgtttcagctctcatgctgtaagcaggtgtccttttttgtgctgttcagagccctttttcatttttgtgatttttgttggtaattttgctacttaaaatggccctcaagcatagtactgcctaagtacaagaaggctatgatgtatcttaacagacaatatacatatgttaaattatcttcattcaggcatgagttacagaaatgttgactatgagttcaatggtaataaatcaacagtatatatgaataaggtgtctttaagcagaaatacgcatgaaacaaggctatatattgatcagttgacaaaaacatggtgaccagaggcacacaggaacctacccctgtattttccttaggagcagtgattcagtgttcactaattcagtgttctcagaaactttatagaacataaataccaggaataatgagaattaactgtgcttttgtattggtttcctagcaattaaaaattgagagccctaaagtttaaatgaggatgccttaaaaagaatgcaaatagctgggcgcggtggctcaggcctgtaatctcagcactttgggaggctgaggtgggcggatcatgaggtcaggagatcgagaccatcctgtataacacggtgaaaccccatctctactaaaactacaaaaaattcgccgggcgtggtggcgggcgcccgtagtcccagctactcgggaggctgaggcaggagaatggtgtgaacccgggaggcggagcatgcagtgagccgagatcgtgccactgcactccagcctgggtgacagagcaagactccatctcaaaaaaaaaaaagaatgcaagtaattggacagaaataagatactaagaattacaaataaatgtcaagcttatatgtttaccttcttttatacctccatatgtcactgaagttttaaaagagttgtctgtaaattatatgctaggtttctgtataaaaacatcaaattatcttttaaatgaaagaagttgaactgaaggtatgtgatttgtatgttaggaagtgtaaatgcccataaaattcagatacattcagttaatcagactctggttatagcttatt

SEQ ID NO: 6394 - DNA, 810 bp, mus musculus
atattgtaatattaaagatcaagaaacttttaataggaatcaaatacaatttttaattgagcccatttattgcacacatgagctgtattgaaaattctcccaaatcaaaaaagtcagtaatcataattgcaattaaaaggtgaatctaataagctgaatcttttttgcttagattctctttaaatcaaacaattctaaattacttttactaaaagctcaaaattgatttaatgttaactatatcctttattcataaatttgtcctctttctttttgagctctagttgatttcacatactccctcttcactaaaaagagtttattgatacactgtgtctacatgatgccatgacatctgaatgaaagatttgatatttgctatccagatgctctgccttcttcactccatctggatatttggccttgtatttacaaaccatctgggtttgttacgatactttccacttttcaaccagatgttttggcattgtgtggacaaagcatgtggcattatctataaaatgtaattatataaaaataaataacactatgtaagcaattaaaggaaaaacattttcccatctaaaaatctcaacaatatttttctcagtaatatcatcatagcaggacatattttacttgctatattttaacatgttaaatttcatatgtgaacaaaaaaggaaaattatataaatgatatatgatttgcatactatgtatacaaatatgtataaaatgatttatcaaaggaaatttctaatattttaataatttgtaatagaaaatatatgtgatttaagatatttt

SEQ ID NO: 6395 - DNA, 3079 bp, mus musculus
catagaccaaggctaggttctgagtatgttgtcctggggagctcatgctagattttgatactttttaaaattataaatattataagtggtgtctactattgagtctccaaagagaataccagaatgacacattgatgaagaaagcgtatttgtttacctactgcatggggcagaacaccatcttgactgaggcttagtagtgtcttagaaggggagcttaagcctgatactgttgtggttcagggatctccttgcaagtggtttaaggcaatctttcaatgtaggatttaattaaggctaagcaaaattcttaatagtttattattgtaaaacagatgaattcaaggaatgactcttggtaagtagttgtttgataggcaagtatgtttgactagttgagtgaactattgtcctgagaaggggcttggtcaatgtattagttcattttcatgctgcttatagagacatacccaagactgggaagataaagaggtttaatggacttacagttccacatgactggggaggcctcaaaatcatgacaaaaggtgaaaggcacatctcatatggtggcagacaagaaaagagagcttgtgcagggaaactcccccttatagaaccatcagatctcgtgatacttattcactatcatgagaacagcacaagagaggcctgccccaatgattcagttacctcccactgggtccctcccacaacatgtgggaattcaagatgaaatttgggtggggacaaagccaaaccatatcattccaaccctggcccctcccaaatctcatgtccttatatttcaaaacaaatcatgccatcccaacagtctcccaaagtcttaactcatttcatccttaactcaatagcccacagtccaaagtctccttcaagacaaggcaagtcccttccgtgtataagccagtaaaatcaaaagcaagttagttacttcctagatacaatggggtacaggcattgggtaaacacagccatttcaaatgggagaaattggccaaaataaaagggctacaggacccatggaagtttgaaattcagtggggcagtcaaattttaacgctccaaaatgacctcctttgactccattacatccaggtcacactgatgcaataggtgggctcctatggccttgaaagctctgcccctgtggctttgcatagtatatcccacctcctgactgctttcttgggttggcattgagcgtctacagcttttccaggtgcacggcacaagctgtcagtggatctactatcctggggtctggaggatggtggccttcttctcacagctccactaggtggtgccccagtagggactctgtgtgggggctccagccccatgtttcccttctccactgccctagcagaagttctccatgagggccctgcccctgtagcaaacttctgcctgggcatacaggcatttccatacaccctctgaaatctaggcagaggttccaaaacctcaattcttgacttctgtgcacccacaggctcaatactacatggaagctgccaaggcttggggcttccacattctgaagcggcagcccaaactgtatcttggccccttttagtcatagctggagttgctgggatgcagagcaccaagtccctggactgcacacagcagaaggaccctgagcctggcccacgaaaccattttttctcctaaacctcagggcctgtgatgggagggactgctgcaaagttctctgacgtgccctggagacatttttccccattgtcttgggggttaacatttggctccttgttacttggtcaaatttctgcagccagcttgaatttctcctcagaaaatgagattttcttttctatcacattgtcagggtgcaaatttcccaaacttttatgctctgttttccttttaaaactcaatgcctttaacagcctccaagtcacttcttgaatgctttgctgcttagaaatttcttccaccagacaccctaaatcacctgtctcaagttcaaagttacagaaatctctaggcctagggcaaaatgctgctagtctcttcactaaaacataacaagagtcacctttactccagttcccaacaagttcctcatctccatttgagaccacctcatccaggatttcattgtccatatcattgtcagcattttggtcaaagccattcaaaaagtctctagggagttacaaactttcccacattttcctgtcttcttctgagtcttccaaactgttccaacctctgcctgttatccagttccaaagttgcttccacattttcagatatcttttcagcagcacctcattcctgttaccaatttactgtgttagtcagttttcatgctgctgataaagacacacccgagactgggaagataaaaaggtttaatggacttacagttccaaatggctggggaggcctcacaaccatagtggaaggtgaaaggcatgtctcacatggcagcagacaagagaagagttgttcaggggaactcccccttatagaaccatcagatcttgtgagacttattcactctcatgagaacagcatgggaaagacttgcccccatgattcaattacctcccatagggtccctcctacaacatgtgggaattcaagatgagatttgggtggagacacaccaaaccatatcagtctagaactccattggttggacaaatgggtttgtctggagtttcagaagcaaacaataaagttagacattacagctttattttcctgggtagaaattccctggaacaaaatttaaagtcgtttaatataggcttagtcctcacagttaaactctgggaccccagggatatcaattcttagtatttggaaatgataacaatcatcactaactctccacaccagaagcagaacagagagggagacagagagagagagagagagagagagaaagagattctctcatataaatgtaaaaatagtcatatatgtgtatgctataaaaaatataaagacagttgctaggtaagcacattcacacacaattgcaaaaggattctacctagtaaaatgtatgagccacttgaat

SEQ ID NO: 6396 - DNA, 213 bp, mus musculus
agttttccagaaagcttaggagtattcttatattatgttatgggaagccaaagcatcagcaaaattagttttcacagcacatatattttcctgtgacataatatggaaaattgtgtaaatgcatacattaattgcatgaaaaacatgaaatgatctttcaaacaaatgggcatatctttatatatcctatttctgggtttttaggcactgcat

SEQ ID NO: 6397 - DNA, 829 bp, mus musculus
atgaagtttccactgagacagcactaattgtgagcaaagtaggatcacgggcaaacatcagcagttaggtttttcatgtgctcagtgtgaggcaactgttgtatgcctacacagtacatggccttgtgattcctgatccattcttcttgattcccttgctctatgtgtatggcaggtctttacccctgcaggtagtgtttcccaggctaccttatcagctaacttttgacagcatgtggcccctattaagaactggctagagcttggaaggcataagaaggcaaaaaggcgagtatttctcccttttttctgtgctttaagtgtggtttccatcggcaactatttctcttccatgactccaggtccctccatgctgttccagtttgtcctcatttattcctgtccagtaactctgccttctccttttccctctccagtgaaaggatagcaaaaacatcttctcttgcctgaggcttgtcagctcttctaacatctgtataaacaacttcataaattaaattatctctgtttcaaatatatgttgctgttcttgcatccagatttatataatttacaagtagagataaaaggtagagcagtctacatctcagagaattatatgcgccaatgcagttgaagaattctaacagtccaggtaccagagggagtgaggtgagaatgataggaagtaatagagagtggcaccctggaaattgttaagtataaaaagagtaatgatgaggtctaggctatgccatgggaggggacggttgaagtatttggagacatgaacactgaagaacgagaggtcaaagaacccaggagtcat

SEQ ID NO: 6398 - DNA, 1278 bp, mus musculus
ttcagccctggcatactgtgattcctctggaatagcggaccagaggaaaagtttgcaccgccgcggcgaaaccccgcgcgcgaacacacgcagactcgggctggagtttgggctataaataactgcatcactagggggagaggttcctgcagccagaatgtctagttctctttgctcttctgggtgcaagctacgtgaagaggattctgattctaagagcctgaattctttagatgcagaagtgtgatgtataaaaggcgcgggggtgatgggagggagggtggtgatctgtggctggcgggcggcgagtgcgcccggcttctaggcggcgacgcctctagggcgcagcggcgaccaagagctggcgttctaggagttcacaagccccgaggcggcccgcagtacccaagggctagcgctgggaaccgcttgaagcaggtgccgggcctcctggggcatttgggggtggctagaggaagataagaaacccccttccctcactttccttgtgcacgttctctcgggttggtcagttatcatcgctacagggagcgcgtgtcagagtctgacgcttgaaggcaaagtgcagctgcttactttttctctccgtaaatgccgccgccgccgccgcctcttcctcagaggagatgcttcccgaaagccactctcctcttcccgaaagccactctcctcttcccgactccttctcgagcgagggcgccaccggctccctggagtgcccaggtctggcagaggcgtaatggatgcttggcgcggctggcgcgcccgtctggcagcccccgccccgcccctccgacggccccgccccagccccgggacgccagcctttgcccgcgcggtcgttgcctgggtctgtcagggcgcgcccccagtctagcccctctcccatcacctgttggcccacaggactccggggcgcggagccctggagtcctaggcctggcccccagcgtccgggtgagccgagggactgcgcctccgcgggcgcaaagggaggtcggcactctgctccgagcgggaagggatacgcgctcttttgagggtttaaccagagagcggaccgagcagaagagagacgcacggatcacttgagagcggcttccgattaaacgttctcgggccgggttctgttttgttttaatttgttagtttgtttctctcttaacttggccatcactgctgtctgcttaggtcccttgcttccacccccaggctgagctgaggggtagcagaatggcaataaacagtaatctcgca

SEQ ID NO: 6399 - DNA, 491 bp, mus musculus
tgatcactttaaatctttttgaggaaaataaaattagtatattttcaggtactttaaaaatattattgtcaggtaaaattgcagcttgtcaattgtgatgaaaatttagttaaatgtatcttcaggattttaaaggagtctatcatgttatcaagaaattatataggactacaagctaattagaaatatgattaatataaaaatgtgcatcactgatttcaaaaatcttagaaatcaataaagcatagcaaattgaaaacattaaactgtataatttgaataatttacagaaaacttttttttttcaagtacttcaatgaagtgcaaacaagcccccttgaaattaaggcaccatccctaatatgaattagcaataaaatgcatatctttgctcttatcccaacactatcagttaacatagatactctttactttctgcaaaatttttacagcagattagagttaatagaataattgtattgtatctttcc

SEQ ID NO: 6400 - DNA, 1167 bp, mus musculus
aaacttccttttgaaagctgtttcttggctttgaggaaagttctgtttctctcaatggtttgataacactgaaaaggaaaatgcagttgattactacttgtttatctcatatttatgattttaaatatatctccaatatatttatgattttctcttcattcccaccgctacctccccttctgtctttctctatttcgtaggaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagttgggatctgacaaatttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctacttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaa

SEQ ID NO: 6401 - DNA, 420 bp, mus musculus
ctaaatcctttgatctctctattgtatgttctcaagcttccctccagtcctagagcaacttgctgtgagttatgagctgggagaggtgattaggagataatatataaacaattagaagacaagatgtcactgatgttgctattatgaagaaaacacacacaaatgtttttttgagaggttagaagacccctgtccagcagcaaagctttcgtatgtaggctgtgtgtgtgaatgtttgctacaatgagactctgcctctagcctgctaagtgattaggatagtatcatggtggaagatcactcatgtttatttatgactgaatgattttattgaggatggcgtagaaaccccttaccgccgcatgcactttcctactgccacgttgccaccaaatatgggttaagggcattagaaaagaa

SEQ ID NO: 6402 - DNA, 274 bp, mus musculus
aggtaaattttttctgcaagggtttttcagagtttcagagagaacagaacatcaaacttgtggaactattttatgaattcttattaatgaatattctagtagcaagttgtggggaacagttaacctctacctatcttaaatttcctgtggatttcaacatatattaaaaagaacctaataagtttgtataaccaaattatcttaggtcagttcataataagagtcaaagtggaaaaataaaattcaaaataatctagaattcattgtatttagg

SEQ ID NO: 6403 - DNA, 490 bp, mus musculus
tgggatgccaagccttgaaactcacatgtaaaagaaacttctactttgaatgctgtgacaaaggactaccagaaaagcccacatagaattgaattggatccaagtttgtcctgaaccgtttgagcacaataaccttgaactctaggcacagtataactcttgatgcaactgggactcctccacaaaagaaatcaaaatagctatgcaaacacatttttcaaagttgtgtgaatgagcattgctctgcatactcgctctaaaccttgaagcagaatattatacacagaactgaatttccatatgtggaaactgtaaaattgttatttgcaagtcatgttcatttgtataccagaaacctgccaacaatgcacccaaaattcatttgtagctgctatttatagcaatatcagcattcaagttttatgtaaaaatagcaaagtgaagctactggtataatagtagctataacatctttactcattcatacatg

SEQ ID NO: 6404 - DNA, 1069 bp, mus musculus
aaagtttttaaaaattgtctcctagttaaaatagccatgggtgggagaatgttttgaactttttaagtattcagatactttttaagtatccagtagtcaagctagagtccaccccagccttcactgtcaactactatgctatgtgatatttattcacttgatgaggtagacagtatttatggggaggacgagaaggtgaaaaaaatatgaggagaattttgagctggagaagacataagacactggtgctcacccaggacagacaactccgtcctctcaataaagcacaattggagagtgactccaagaggagagagacatttaggtgagctgaggggcaggtggggaaggtttgtcagagcagggagcaggcttcgtgggcctcaactaaattggactgagactcatggagaaatggggaaaaggattgggcaggcggagttcccctgggagagtcaagtacgattatgccaataacagaggcgaggcagaggttgggaggcaggctggaggcacgctagtcacctgggaaaggaacctctgaaggaaagaggtactaatgaatgtgatttatgtgagttcatgttcataaggctgtataaatgcaagttgttattgcttgaggaggcttaaattcaccagaaggaaagtgttacataagagagacataggaataagatattctgtgcaaattaactgaggctgctattctgtggctaacaacatcctacctccggctgagtatcctattacctagtctgagatggtcggggaatagatcagcggtactttcaagaggtggggaaagaaatctccaaagcacaccctgacagagacagaggtgctgctggagcttttaagaacaagaaagagcctcctcctctggcgaaggagtgggctaaccaatagaaatgctcgaagggagtttaggagtgaagggggcaccccaggagtgctccctgaatggagggagcatccacagaagatgctcacagcacaggcttaaatgtgagtttgaggacctctaacttgattaaaatgtcaacttttatcctcatatcccagggtt

SEQ ID NO: 6405 - DNA, 276 bp, mus musculus
ttatggtttctaaatctcatttcttactgagaaaaatcctccccatactaagcttataaaaaattctactctgatttttctaatagtattagagaagtattttttagctttttgatctttatttgttttgctaaaagttttactaagtgcctgaatacataacctgattaacaaagcacaatgtgaaatttgctttttttgtaaataaaatatgatttttgcaaataatctcactaattccatatcacatgcagatagttgtattacatgagataa

SEQ ID NO: 6406 - DNA, 1423 bp, mus musculus
aaatccaatcaaaaacatttttcaagcatcaatttaacatggcactgctctacagaataacataaaccaaattctatgcatccttctcttatttccagtcagacaggtctaataacatatatccatggagaagtataaacacactttaccattttgctaattgtcattcacaatgaacaaggtttatcttctaagaaacttgttataaacttggtctgcatttaaaattcactgattttatatgaatccagtacagagagttgacacatagagtgtcatgtgtcactcatgtgctcacatcatgtgagcctgtttcaaatattggtgcatatattaaaaatgaaagatataaagtttattttaataggtaaaggaaatatacttattttgagggtgaattctgagatcacttacttttgactttttctaatttttagggcgaggtcattgggatgaagatagtgtggtcagttctccagaccctgggtcggccagtgaatcaggtgaccgatatcgtactgagcagtatcaaagtagcccacatgaacccagcaaaattgaaactcttataagagccactcagcaaatgattaaagaagaagagaacagattacagctaaggaaagccccctcagaccaactggcttccattaatggggctgggaaaaaacactccctgtgttttgcaaactaccaacagcccccaccaacaggtgaagtctgccatggctctgctcttgccaacacttcaccatgtgaccatatccagcagagagagggaaaaatgttgagcccccatgaaaatgactatgacaacagtcccaccgcactatctcggataagtagtcccaattcggatcgcatttcaaaatccagtttgatcctagctaaagactatctgcattcggatatatctcctcatcagacagcaggagaccaccctactgtctctccaaactgctttggctctcaccggcagtattttgacaagcatgcttacacattaactggatatgccctggagcacttatatgacagcgaaaccattagaaactattccttgggctgtaatggctcacactttgatgtaacttcccatctgaggatgcaaccagacccagcacaaggacacaagggaacatctgttataataaccaacggaagctgatgttttgctgaaatattttgttctttaaggatctctgaaacatatttatagtttaataccccattaccagcatttactatgccacagattgttagagagtataacttaagttactgggtatttgatacgtgttcctataaaatcaaagaaaacatagcactagcattcagggttatacacagaaaagggagctaaattgaatacacaaatttcccctctaattatatgggaaccagaatagataaattttgactt

SEQ ID NO: 6407 - DNA, 188 bp, mus musculus
ttctgtgtgccattgctgctcaatatagctttatgtaagcatggcaagtgtttagttctaccttcagcattcaaggcaaaaggagttgctgacattgtcctcccccaaagagttaccagcctatcctatgggcaagattggaacaccaagctccccggggcatataagaacatttacaaagggtactc

SEQ ID NO: 6408 - DNA, 582 bp, mus musculus
tctcattattgacagacctttatctcctcttcagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtaagaaaaatcagtatcttttggagctatgctttaaatatagataattttctgaagcccattccaggttcttattgtattcttatgtgctttattttgagttttgaaaattcagctaaggggtagaaagacagaatcaaacaccaatcctaatttcacatatccaaacaaagaatacctatgttgaatacttcttctctgtatttgtaaaataagcatttttttattcctgtgaaagatcagctagtttggtaggttggatgaaagatagatgtagtaaacaatattat

SEQ ID NO: 6409 - DNA, 2382 bp, mus musculus
gtaacaagtgcacagagaggcaagaaaacagcatcatgacatctcaggagaagaagggctcaggagaagaagctgcctggaaaggatggagaagagttttagagaaagtgacgttataaaattatcatgaaggataagtaaaatgctgcaactggagaagagtctacagtgtgcaacatgtgtaaatgtgaagatgactgagggagccagtttgtcaggaaattgcaagcacttcattatgactgagtaacagaaacaaggaagatgaggaatgatcaatggattttataaaaagctagcgtaggagagatcacagagagctttgtactaccaagtccaccttttcttgcccaccctgccctggaatctacatggttatagcaatatcagtgatgtttgtgtgatgtgagcctgctttcaaaccaccatggaatgcctcaaaaattggcatatatccattcacctttttcctggaaactcagaaaaagacatagagggccatctgtcagcctagactattgtggttactacggtctttggtatcaggacattctagactgaaatcctgaccctgtcgtgtagtttttagcaagggatttgaccactaacagtctgagagttgatgcatgtataaggtgaggataatatgtgtcatacttcacaggattgttgttgtgtaaagtgcctcatagaggaaacataacaagaatttaaaactttcaacaatataaatgctatgggccatgtgccatttttcttcactaaactctatgataaagaaattattaatctcacaatttttgaaattgatgcttgtttattataggaaattcaggaactacaataaagtttaataaaaataagataaaataatcaagattttttgctatcaagttaatcattttagatttctttccagtctgtttctctacaaatacacatacacatacacacaaagagcatatcatttagagttctgggaaagaaacagaagaaacacgtagcttgtaatcccactattttaatatgagaaaacttagatgcagtgagttgaagtaatttgcccaaggttacatacatagcacataagtgatagatctgggttttgaaactaggcagtcaactttagaatctactctgttaaatactgttacatgatgttagttgttgttttattttgtgggggttttttttggctctttttaaaaatcattattttaagcaagataatggcaagattagaactatttttggtaatggctttctgactgcagtgtggagaatgtgttggggatatgagatatggagagcaatagggcaacactggaagcaggggaattcctgaattagccaagttgaaaagagatgacagtttcaattaagaagattttgatggaataatgttgacatgaagaattctaagaggacttaggagatacagattgtagaatttagtaagtggttgccgggaaggagtgatgaagacaggaaataagaattactctatgttcctagttggggatactaatcagtggcacatttacctagaaggggaaaacaagaaaaacagcttcaagagagaagacggtgtctgcttcttaacatatgaagtttgaaacatctatgaaatattcacttgctatcattcagtggtattgtatatatcataaattcatcttaaaaataggaacttggtctgggcaggcatataatgcttccattggcattttgctgtgcccttcatttgaacttctttgtagtattaggaaatgaagaaaatcaacaaaaaacaatgaaataaaaatagggtgatagtacaaaagaaatgagttagtaggtgggcagccatggagataaatatagacatgagaagagcttacagacagaatgtacattcttttcattagtgaaggaaaagcagtaatatttttagaaatagtaatatttaccaaattgagcctagactaatttctatgatacgatcacaggaaaaaaaaaagccaaagcttttatcttaagcaaaaacacaaacactttcttaaaacactaactttattcatttggatgaagtatacttatagattgctttagatacatttttgtgtgcttttggagttagcataatataatggaaagtcaattaatagtgaaaactcattttattttatcttgcacgtatatttaaataggataaaataaaattaaagttaatataaaaatgtatattcctggaagacactaatttttgaataagataatttttatattatgaagcatacaatcaaataatttccattttattttagggagtggggtaatttggatctcagatgattatatgttgtacattttaaatacaagcttcaagtgctgtgttctcta

SEQ ID NO: 6410 - DNA, 1354 bp, mus musculus
ataccatggtgttttctatatgctattttctatttctacagtaatcacccatccttgtccacttgctaaatggttacccattctgaacacttctatcgtgctttggagattctcacattattgtacataagtcattgaagaaaaatgatttgcatatctgtctcaccaccaccaccctataatctcacaggtggtgaacatataccatttatattttttaatttcacttctgtattctcaattcaaaatacacaatatgtgctgtcatgtattcctgatacatttacatcttttaatcattcataagataacatgtatgttcaataagcacaactactaaagactttggggttgatgatattatttctgggacaagaagataaaataaaacctgagattctaaagagttacgttctacttggcattcccaccaggacataaaagttctgataattgttagtcatgagcccagcaacataaaacatcataagctctttcatcaatgtcaacgttaaatcatatttgatgtattaagtgccagtataaaaccaataacagcagcatcctgggacatagccagaataagagctgtgaaggatcatttgccgttcataactgcattgacttgagcacaagtggggattaaagaacagcaggctacctaatcagccgctgtctggagagctgaagttgggttatcacaagctgagagggcagtgagagcgacagtaagacaggcgtacatctgaacaggttgtcaggagacaaaagtgcctgtgaagtggccatcagaattgaacaatgaagtgtgttggtcccactgagggtgagtcagtcacaccgccaggatagcagatgatgaagtatggtgaagtaggagaagaaatatacaggagaagaaatatacaggatgcttctggattatgcttgttgtctttgtttaattattaagcaactacctctgtgtcttcttttaaaaagatgcccgtttggtgaaaaataagagtgactgattataaacaaccattaaatcaaaatattaccaaattctgcacacagaccaaagttacaataatcctgttaaagagtttctaaaacattgctgtgatgcatttctgggttgtgtttgtgtaggtgtctgtgtgcccagaatccctttgagggaatcttcgcagtccatgtagttcaggcgaggctgcttcagtcacccactgatgccattcggtaggcatctaacctaactgcaactctctactcccaccaaatcacaccagtctgggacagaggccttcctaggatactgacagaacttttgaggaaaatatctttttatgagtgtgaaattctgattgtc

SEQ ID NO: 6411 - DNA, 879 bp, mus musculus
ttatatgatagtgcaatggtataagtgtcaataaaccatctaatgaatgcattttgtgacatcctgtgcttacgtgtttcttctggaggcttatctgcattatctcatagtctgtgttcagtgaatacaaaatgtctaaacactgtgagtatatgacctaatctatcagaagatattagttaaattaaaattcatattaaatggatcacagaagaaagtattggaatgtgttattcagatcagattttactgtcttctcctttcttgggagcactttaaaaggtgcaaagatgcgtttttaaatctccaaagataattctgggcatggtcttatcccaccaggggtagtgcaaaatactattcaatgcttcccttaagcctacctttacctattaatttatcttggatccctagattttgcgctgtcttttagctttgtctgtataatatggcatgttatctttatgagaggatgaaatagatccattacagtaaaagatgtatgccattaatgagtttctagccagctatcaaggtatcatcaaatgtggtttatcttggtgaatgaaagcttgaatggaaaattaagctcccacactgactggagaagttcagtggatcgttttgttctttaatgttacacttcactgaacacacttcacagagccgtgaatcatgctttaaacaagctgcctttactttaacggcagcagacaatgcagcaaaggtgaataataagtgttagcaatcttaactttcttttgcagtactctctaccacgtgcctgatggacaatttacaaagtacatatgctattttatagattggaacgtgggatccagccagtggcctgaatatgacagaaagtcaaaagggaaa

SEQ ID NO: 6412 - DNA, 1016 bp, mus musculus
gtttccatttctacagtgttgtcatcatcaccatcttcatcatcattatcatcatgttcttaataagtacatctaatagtaggtattaagcaacaagaaacactgtttccatatactggctgtcaggtgccacataaatcctttaatagaaatataattcatgaattgcagaactgcataatttaacacataatacataatgcatggcaatgactctgtagttaatggggaattcacaagtcacatttaatcatcacccattacaagtgctaatatattaatatttttattaatttaatgttattaaacaaatgctaaagttttgcctaattttattaggcaaaattaattgtatgcaatatattttcactaggtttctaaacctgaaaattttttaagcaattgaattagaaacattgttaaataagaattaaaatattagagtcctgtgtatctattgttaattcaatcaacatttaaagagcttatgtgtgtacaagcagtgccgtgagaacttgacctctgctctacacaattcagggagagagatacatagagcactggcaggccagacagaaaaacaggataatgagtggaaaatactgacagaataaaacaaaatcaagttgtgaaaacaaaagaatgtgcctggtcaagtggaaagggcttcctaattaagttaaaacttgagccatgtcctgaggtaggggataaagttgggatgatgtgaaagatgaaagaactcagcagggtaccagaacaaggagaaacaaaggaaaaatattaatggaagtcccaccaataaagggagtgtgaggagaaagagagagagatggaagcagtggggaagggagaagagggctagatcagagaagtcatgatggaaaaaaataatagatttgagtttgacttgtttcctaaaggagaaaatgctattaataattgatattttaaaaatagattatccgggtaattgtgaacctttacagaagagtggcgtagacgtagaattagga

SEQ ID NO: 6413 - DNA, 162 bp, mus musculus
tattaatatatatcttcttatgtgctgttacatgttctataaaatgtttgcttttttttaaccagcacatagcaatgtcaacgtgttcaaatccacaatatagtgttacatataaaaaaacaagaaataaatttcagaaaacaaataagcaaacaaacaaaa

SEQ ID NO: 6414 - DNA, 632 bp, mus musculus
caccaaaaggaaacctggtggaatttgggtggaaagcagtggcccgtgtgccagggctggtagtaggtctgccccactagccagttgcagcctggccctgctctcctgtactatcctgtagggtttggaagctacacagaggcactgagacatgagagaagggggtttctgaaggcagataccttcataatacctttatctcctttgactttgccctagagttttagatttttattttattcttttctaaaaaggagggttttatttagcaatattatctgaaaaattaaacctttataagtaattctctacatctaataaatattcttcagtaataggattctttggggtaaaacatctagataatcatattatgttttccattaacaaaatcacacattttagcaattttatctgtttagcaataatttccaacatcatgtaacaaaaacaaaacagcaaacaaaacacaaagtttcttagctttgtattttttactatattagttttccttagttaaagacattcttaacacctcatgtttatttgtgtataggtatgtgtgtataattatataaaatataagtttttccatatgtttcttatgaggttaaataaactattggcaattt

SEQ ID NO: 6415 - DNA, 121 bp, mus musculus
ctaataacccatcatgttaatccttcctagaattttatgtaatataattttatattataaaaataaagatcataataagcatactacaagccgactttacagataccacataaatataaca

SEQ ID NO: 6416 - DNA, 1004 bp, mus musculus
actttctatttcagtctaagggctttcaatttcacttgtaataagatgggaagtcaccagtgggctttaagcaaaatagagacatagtgtgactatgtcttattagaatcactctggctattattttcttaacccactgagggaggcattgtgcaaggagaaagactgagaggctagcccagtagtccagataatagtgaaaggtggcttagcccaagaaagtaaagaatgatcaagagtggtaaaactgacaggattttctggtgaatctatgtaatgctgagatagagaggaatcaaagatgattccaggggttttggtccagtggctgaaagaatggtgctgccattgtgaaagattattcactagacacattaaaaatggtaagacagattttattcagacttcagaatagcagagacagatttttgtataaactgaattcaattccatggaaacaaaatgaaagagactttttaaatgcagagtgtgctaaaagtagagtccatgagcacattaagagtgggaaggggagagaggttgattaatgtcattaggtcatctacatttgctaacttttaaagttagactcctatccaaccaaggaaactaggagataagggacttatctttcttgctgagtacttttcaaaaggatggctcccaagttcttgagaaggacattgctgagttgtagaagatacttctaaaagggacagagaacagatttacatttgcacatttgcacataaaaaaaaaagtaaagcttccaagaaaagggtagtcagagaactatagtcaggttttggctggaacaaagcataaattcttttgtagcatcaagctttctcaggcagggattttcaggggctgaagttgtcatcctaggaacactgccctgagctgacagaaactatactagcgtttatttaagtctgttagtataggtggtggataaaatcatttgtgctaagagtttgtagttcttatactatgaggctgag

SEQ ID NO: 6417 - DNA, 1490 bp, mus musculus
acaattcaaaatggcggacttactattacttacatttaagaaatttccgcaataagggcactaaatacatactgttagattttactcgaaaacactcaatatttaccaacgtgcaatttttaaaaaaagtttttggagtacaaatcttcacaaagcacccgcatccaatgttccagtcagtagtcagttaatgctcctgcaaacgtatcatttcctctttggtttttccttttcaaaaacaacctaaatccaagtgcgttcttccccgttcttttcaaaatccttaattttaattcatgaatttacatcaccgataccaaagcaaaaacgatccccgacgcctgcccggtacaaagcagttcggcttgcggagcgcgaaagggaggtgcgcacgccctctggcggcgcggccccgtgcgtcccagacgagccggcaccggccgcgaggacccgccgccgggaccccagcctgcgccgcaccctcgcgccctgcgcccccgcgtggcctgcgcccccgccctgccccgccccgccctcccgctccaagccggctttggccgcccggcagcaaccgcagcggcgagcctgggcggccgctgtggcaacgcagtgcccacaccgggcgccgacccagcagcaccgagcggggagagaaaggtgtgaacccggaagtacatcgactgcccgcgtcttagcggcagcaccggggcaataaatcagggccggcgaaggaaagacgcggcgcgccggcttccgaaccgcaacttgctgcgagacctgtcacttccccgcggtgcccagtcctcgcccctccctggcgctcgcgcctcctcttttcttcctgctcctcagcacggagctcccctcgacgttgctcacgtgccagactcgggaccgcgagcggcgtccgcacccgcacgcacacccggccacgctcgcactcgcgcggccgcggggccggctgcttacctccggggcctcatggtcgcgtcgctagcctgggtgtgagagggggagagggtgtgaggacgtgtgtggcgttcagtcccgaaggacggggcggaggaaggggcctggagtctgtcacttcctgagggagcgcggaggtcgagagacctgtgaggcgcgcggcggggccgggagggtcagcacattgtgagccggcaaggggacgcggaacagccgggcggcgcgcggccaccgggcacggaatccgctgtcgccaccactccgccgccgcagcccggcgagtggcggggcgcggggaggagggggctgagccgggtgggggagcgcggggcgcggcggcggcaccaggcggttcgactggagccctgcgtcagccggcggcacgcgcacacctgcccgccgccgctaccggccgcgtcattggctgccggcgccgagcgcgcgagattgaaccttccattcattccagggccgggcgggcgagcgcggccgcggtggagctttaccgcgggcgcccccga

SEQ ID NO: 6418 - DNA, 110 bp, mus musculus
gaaaacatgtttacacaaaacttgtccatgattattcatagggtcattatccatagtagccaaaagttggaaaccatccaaatgtctatcagctgacgaatgggtacaca

SEQ ID NO: 6419 - DNA, 1018 bp, mus musculus
caggtggtaacgtccttatcttggctatttggggggacaaaggagccccacatatgcaggccttacacttctcttttgccttgggtgcctttttggctccactgctagctaaactggctttgggtccgacagcgtctgctgaaaaccacacagagtctgacttccatcctgcactcaaccaatcatctgatgctgactcagaagctctgtttggagtacctaatgataagaatttactgtgggcttatgctgttatcggtacttacatgttcttagtttctgtcatttttttttgtctgtttttaaagaatagctcaaagcaagaaaaagcaagagcatctgctgagacatttcgaagagcaaaatatcacaacgcccttctttgtctcctttttctgttcttctttttttatgttggagctgaggtaacatatggctcttatgttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaaga

SEQ ID NO: 6420 - DNA, 129 bp, mus musculus
atccccttttcattgctttccactgaattattgtttacttaaaagagaataaaagcaatgacctggaaaaggtgtccctagagctcttgttaataattattctttcaaaataaatcagaaaaaaaatgt

SEQ ID NO: 6421 - DNA, 193 bp, mus musculus
ttgtaaaatgtcacatgagtttgtcactgggaggctatctgtgggtgagctgagtgatatatgtgcagtgaccaatcactggcagacgttgaaaggagtgacatgattggtccctgatcatgatgtgcttctgctatttacatagcgatttgtggactgggagcaagcagtgaggtttgtaccttacgaaatt

SEQ ID NO: 6422 - DNA, 540 bp, mus musculus
atgtttccctccatgtcctctgctcagtcctgggttctgaaacatgttcggactagatgcttttgctatgtgacctcccctggctgtcaatgaatttagacaggtttggtgatattggtctcactcttagatcatgaaagaagcttacctggaagctctgttctcatatacctgaaataaggccagctgaggagcgtagggctttactagtgctgttattaaattttggggaaaaatgcaagttcccaattcagcctttcttattaaaaataaatccaatccctctttcaagataagattgtttgcctcttattgaaactcaaaatagtaacccaagaaggaagctatatagatagcaatgagtcatggttagaaattgttttgctgcaatgatatctctgtattgctatgtgaagtttttctttgtgcaaaagggatatactaggattgagtgattgatctattcattcattattcaagaaatcactgaattcccaaagcattttcaactattatactaggtttatcagagatttcaaa

SEQ ID NO: 6423 - DNA, 554 bp, mus musculus
ctatatacattgaaaaatcttttaccaacacaaaaatgatcttattggtgtttccttaagtcccttggtcagtgttctcatgcagcttaaaatccaaattgctttaaggacaccacattttcatcctcaaatatctctccatccttgcctgtttttttgacatggtttataacccccactccaagtatactggatccaaatcgttctgacatatgtagacactgaaatcttctccgctgttgataaaactggtctatctctttttttttttctgaagagagttcttgctttttttccttctgatgatagaaataaacattttaaagatttttgctctcctaattagagctatagcacaatatgtcaatataatcattatattatctcatataaagattataatgatcttcatttttactactaaagactaaggcatagagaggttaagcaacctgtccaaggtcaaaggctgggagtgtgtcagagctgatatctgtaataaaagcaatgtaactgttattgctgaaaggcttgtctacattaatttggtgcaa

SEQ ID NO: 6424 - DNA, 270 bp, mus musculus
aagcagagtgattatgaaaaggaatggtcaatgggccttttgccaggtaattagttgaagaacagagcagttcactattggttctaccctgaggatataatcacgcaatagctttcaaactggaaattctgcaactgaatattagtaaagtaggcagtggtgccagaaagaaatgaaagtgctcccaggtagcttgtaattagccccaaagacaaggactgccagctcagaagtcaaagaagtttcataatctggtcatgtgccccttct

SEQ ID NO: 6425 - DNA, 1210 bp, mus musculus
ttatataaaaattaacttgaactttatttatatgtcttaataatcctttaaatttaagtgtaattggacatatgttttctctttgttttgaatatattgcaattactattgacaatgtaaaaaaaatttgtggctttgaatgctgtcaactaatcttatgttagcaggagaattattaataaatataaaaacaaatcaattttaatcacaacttataactttttagaatgttaatagactttgattaaataatcaaactgcttaataatcttttcttttagcttttttaatgtgtagaatttgcaacctgaagggacaggatttttcctaaagggacaaggagtcaattcttaaaatgtgttatgcgtgaagatagctactgtgtttctttcccccttcttccctctccttctctttctcacatgaacacacacacacacaattgcaagtttaccttcgcttttcacaatttttgacagacatatatattcctcattacactgtaaatgataaacttaactatttttgtttcatcttcacttctttttatatggtaatattattaattccataccattgcaaagctctaggataaaacacaaaacaaaacattgttctcatattagatttagtttagctttgatacttcctgccatcttgtctatttgcttacgaacaataatgacaaaaatggagaaacaagcagcaaagcacttgaaaaaattagatgaaatacagtgggtgggaaactatctacacctgacttagttttcctaccatctgattttcatatgaacttcaaagatagcttgaaatgaaagtaattaatggtagcatttttccaggaccacctccatatgcacgttgtgttccaagagcttttgtgggatcagattcctagtcaggtgcatattgaagaaaatagataactgataagggagacctgagcctgcccggtcactttaatccttagcaccctgtgacttttagactgatgttggaagagatacaaggcaatagccagatgcctcatgagactccagaaggagtgcattctgcctcttggcacttgcctttttaaaaatttccttgtatgaaatcctttctctcccttttagaactttcttttctccagtttttagagccctgctctccctaaagttggcctttttgtttctttttcatcctctccaagatgaaaaagagacac

SEQ ID NO: 6426 - DNA, 334 bp, mus musculus
atacaatttcatctgttaatttgataaatatataaacaggcggatcatgtaattcattttcacaaacccaccagagctcccagttcattcagagacaagatcttctaatggttaatgatatcctacatggtcactctgaactcaactttttgacattctcctcctcatccatttttttcctaccacagcaacctctcaattcttacaactcacccaagcaatatttctgttatgagcctttccagcagatcttttcaatgcctgaagcttcttccctcacacctccctatgacatactgccttgcttctttcaactctctgcccaaatctcagt

SEQ ID NO: 6427 - DNA, 544 bp, mus musculus
taaaaaatcagttacattaagtacaaatttatttttacctaatatgtagaaaaagtagatatcctcagagactccattatatatttcatttgaataaaagtagcagaggacaattatttgctattctgaataatttttttaagaacatgtatcttattctgtaagacattttacattttggactgctttgcccctgaaagccaccattaaataaaaaatacaatgattttctaaaaaagaaagaatttcacataattataatgtgtgtattcataggacatcaatattataatgattttgtctggctctatgtagcaatttgaaaatgaagctacaataatcatccctttttccttcatttttagattcaactgaagtgttggacttcattaaccttgttggaaacttaggaatataataaaactgctttgaatgttccctttaacctatgatttagatggaactgaaattcaaagcaaaatggaattgaaactagacaacacatacattggtggaattaagaacgtagtgcaatttcatgcca

SEQ ID NO: 6428 - DNA, 289 bp, mus musculus
tactttagagtcagtgagacttggcttcagaagcctggtgttccttacaatggtcttacagttgtacatattaaggattaaaatagataatgtgtataaatattgatactatagcatttggccaaaagtaagtgctcatataatgacagcagttaaattattatcactattcagtcttccttctccccttcgtgaccatactactttaaagaatagaatactttatacacatagtcttcacagacctttcctttactcctaagacatgtattccccgaacactaacctt

SEQ ID NO: 6429 - DNA, 164 bp, mus musculus
tctcaggtaggcatatggaactaacttatattactgatgaatgaaaattctcaggtttaccacgccaacaaagatagcatctaggtattttaccagagctatgtgggactatattagcttgatccttattctaaagataaccacttgtttgctggaaaattttt

SEQ ID NO: 6430 - DNA, 773 bp, mus musculus
actacgtgttctgtgaagaccattattcttcaaaagacattttatgtatctgttatattgaaataacagcgaggtgttattcagttcatacttgaaaataatttactattcatcttctttgtgattttttcaggtatattattttaaaaagtagactaataaattaattaaacattgcattctcaggttgtctcacaagtgtaagagtccaaaacatccctaaaataaaaatcaatttacacattttaaaaatggtattgttctagctcaccatttaaaatatgctgtgtgtcatggtttatatcttaccagtcgccatttttataatttatcagtgtcaatatgtccattccacaaaagaatcacatgaaagatatatttcttgggccagtgtatatttggccctaatttttttacaatgagaggaagtgcataggttttgcgtgaatatacatgggacaaatgaaacagatctgtgatgaagcaaattgcttgcatgtgtggctttatctttatagacaagtggcttactcagtcaagcatgtaagctgaacttgacttctgctctagaaattatcccaacctctgccatactgcccactatacctctcaactctgctagaacaacttcactctgcacacttcactgtggcagatactgtgctacactgtgttctagacactgcaggtaccaaggacatacccagagggctcacagggcagcaggcacaagtagttacaaaataaaatagaggaaagcataatttataaag

SEQ ID NO: 6431 - DNA, 410 bp, mus musculus
ctaaatgactttctctatgatgtggaatacaaaagcttggtaaattatgtatttccatttcctccctataagtcaacaaactaaatgaaagtatgttatgatattttcagtgagtataaaacacagatcattatttattaagagtatccagtggggaacatttggtaggaagtaagcaaacacttttcagatggaaatgctagatttcctcgtggtaactgagactacctgcattcctctgaggttctttgtgacatcaaagcagtttttgcttaactgcctgattgcttatatttccatccagctcaaaacacagggatttcatctaagttacacgacagacacatagcatcacaagcaaaatttgccttttggacagcaaaacaacaaactgtaggtagttcactcat

SEQ ID NO: 6432 - DNA, 393 bp, mus musculus
actccaagcagaactggatttcacctacaaataaaattgaatgatgggccttagttctctaaggtagctggaaaccatggcaaatgccatcagtgtattcatactttgcctgggaatatgatacaaaaatgatgcttttaagagaaatacgtgcttaactatttgcatcctacctttaacccctagtgatacccctaaattattttcttgaatcacctaagttaactatatcttgttttcttcacagtaatactgtttatcaggggattctccatgcctaggaaaagctctttgatcatccgtgctattttccagtccctaccattaaatggaaacagcttaaacttccaaatagtaataatactaatagcaatttaaaaataatagcactta

SEQ ID NO: 6433 - DNA, 206 bp, mus musculus
tattttttttccatttccattaacatttgcttagtctaaggtattatcaccttacacagagtattccagtgacattgtacctggcttctatgctaaagggacagaagccctttcccagacaatcatggacacttttatctcttcaaaacactgccgtgtaactttcctgcccaaaaatgcagtagcgctcaatgtactaagacaaa

SEQ ID NO: 6434 - DNA, 206 bp, mus musculus; identical to SEQ ID NO: 6433

SEQ ID NO: 6435 - DNA, 337 bp, mus musculus
ctcccagtctcctgaagagagtaatgcaaccaatggtcacgggaaccacttcaccttaacagctgctgagtcggccctacataaccctcaacgtccaggatgctatggatttttaaaacatttcaatcattttcatcagcaaaaggaaaaccaacaaagctaacagtagcaatagtcaagggatcctccatcatcattaagactgtggcttaagttttcttggatcagttattgtataaccttgtcagtcaagcaactataggatgacttacaggatgacaggtgtaggatggttttcaaaagtcgcattgagagctccattttatgcactactaaa

SEQ ID NO: 6436 - DNA, 456 bp, mus musculus
ctgggtttttcctctctttcgtgttcaaagcatttgaaaaaaggtgtatttataccatttaattctttagtcgttgcaactgcctcacattcttcaggtaatacagtgccagaaggaagcaatggtaattggtaatggaaaaatgtacagaaagatagaaactcaaaaatggtacatatgaaacttctgataatactaaaagaatgtaaaccattgtttttctcaatccatcagaaaaaaaaaagcaatttgaatgtgtctaccctatgaatggatcagttagtttgaggctgagggagaaatttgtgaaaaagaatcagggttgacattctgtgggctttatatatgtgaaagaaatgtatttatttccatgaaatcttttgtaaataagtgatggcttcataatggatattggtaagaggtaataaaacgtgataaaacattaaggtaaatttt

SEQ ID NO: 6437 - DNA, 363 bp, mus musculus
tatataagctagatgactgatgaatggaggctttactcctctgatttcaaaggagtgggaagacccgatctggagtattgtttgcattacttggtttcccattttcagatagttattcgcaagctagggtgctcataaaagaggatgagagaccaattatgatttatacattacacctcactgaggataatcgaagccagtgagtatgtgcaacttggagataatatcagtgcgaagagccttagaaagatttcttcaaatatgtgaaaggctaacatggaaaagaatgaatagatttctttctttatagatatctcaaacctctaatcaccaaatggacttagatcaatataataaggaata

SEQ ID NO: 6438 - DNA, 233 bp, mus musculus
gagcattttagttcagagattataaatgcagctttagatcaaatagagagaaaaacaggctaaagccattttttaaaaaatatgtaagcctgataaaaacatgatgaattctaccctagaggagttctgagagctgattgtgccctgggttcaggatgtttttcttcaaataggagaagaaatcataggtcactttgttccttcttccatggactgcccacacatgagagcac

SEQ ID NO: 6439 - DNA, 888 bp, mus musculus
gcatggcctgtagttcatcgtagggatgaaaatattctccagagatttgaactttgcttgtcagatccttctgggcccacttgaaagaggttggttattgcctctgacattggactgataaccctagagcaagaaggaagcctgaaaactttggcctatcagacttggttatgcatgtatgagggttttctctgggacttctcagggaaagaggagttttttcctcttccttggttttagctattatttctttattatattgaaaagtttcagtctatcaatcaattgctattgttctgaacaactgaccactaatatttgtacatgaatgtttgtaccaaattgattattttggccacttgaagacggctgtagtttatcaaagctaaaaaactttgaaatatacctgctttaggccaatgaagccaaagatttctaaccactctctctaggccttcttatacttcaggccatttccaaattctatagccaagatcatggtattcccctggaatcattaaactattttttcttcatgactttctgtatcatatttaaaccattcatccataacttcaagtaattcctaacctctaccttcatctctttccacactttcctattcttcagctcataggctttcacaaattttatttttccatttgatttctttaccattttgattgcaaacagaattatgaaatgtctaagttagatcatttttggtagtcaaactttgatgagcagatgcatttattaacacatctacttctagaaggcaaaagtctctcactcttcattgggtctacttatatttaaatgattttacatgtatgtaggtatggctgcctaggaagaaggaagaagagttttaaagaaggggattca

SEQ ID NO: 6440 - DNA, 2245 bp, mus musculus
attctaacaaaaagtcatgatgctggctttaaagtttactgtagaagtaagttaggttcttcaagataaaaggcaacttcattttacacaagaataagacttgatacagaatgcagctgggataacagaaggctatacacaagatgagaagcatgatgaaaatatgaccctgctcccagtcaatgttgggcaatacaagctgcttaaaagttggaacccataacatccctggcaaaacgtaggataacaacaaaaaacaaaataatggcagccactggggaaaaccaaggcagatcacttggaatatataatatgatttccatctataaaattactccagagcctattttgtttaacatttatgaacattatgaaaagcagaaagcaaaaaaatgtccaaagaaatctaaaacacaaatacaagctttgtattacatctcattttgaggttatttattgatgagatatcatagactttttatcaagactttgatgcaattatttctcattttaggtggggtaatagaggctatggaggaataaatggcaagttcaagattagccccatcattgtgaaagaaagaaatgaattggaatgtaactttcaggcactaaaatgattcaagaaattcaactgtttaagtaggtgaagttatctaattggagatacttagacttctcatcatttatacttgcttattcatgaaatacaaatttaagggataaagctgcctgtacaatttaataaataggctctctcttgccctgacacagcaatcatggaagcacttgttatggaagtgccacatgactgaattagcctggggttctgagctcccacatggaagacagctgccttggaaagttgcctgtaccctcaacagaccttgagagagcaaataaataaactgtcgtgtattaagccactgggatttggtggtgtttgtttccaaatcatactgtaacctatcttgactgatatgccaaccactaaaaaactgttaatatatttatatttaaccatccagtgttattttctatgtatagatatgtatagaaatttgaatcttgctacacatgctgtttttgtaacattttatttaccaaattatgtattatgaatattttttcatcattaaatcttttttcaaacaattatttttaatagtcatacagtattaaagttgtgtcatatttaatctagcccttcactaatactggacaattttgctgaatagtgctatactggcttactaactaacctattccatgtctttgtgcaaatttccaactactttcttaagataagatctacaaaataaaaatgctgcatcaaagttgagttacattttaaaggcttttgatgtacattgcccagttaccctttgaaaaattataccaatttataatttttctgggaatgtataatacatcatcatcaccatactattggccctgaaaattatagtttcttaaaactgaaaacttggtatatagaaactacctcatttattatttgatttgcaggcaaagttactagatatagctggtttcatggagatgttgaattcaggtctttctgtaagagtgaagaattttatgttgtatttgtgactccctaaacttttggcctcattctgaaaatgttattacacagtatttcattgtcattattgtataaaggccctgcaggttcaatttcatattcaggataacttttaacttccaacctttgaatttgttatttgtttacatatatattattaattacccgtcttattaattcataatttgagactttgatttgcataattcaggtttttaaactgaattaaacacttaaataaatattatttgtgtatcaatatatacccattgcttaaaaagttccagtttcaggatcatggatggtggacatggtgaatttggcagtcagtatctattactgacaattagagctcaagatgtaaatcggattgcactgaaaatgcccccattccatccgttgatattgggagagtgcaagtgaggtaggggatgactttttgttttgcctcttgcttctggcaggtaaggacaaatatagagcatcactccaacatctagtccttcacttcaagaacacttgcaggggaggcgtggacggcagcttcctgatttctgaatcacagttccagggatgtgttcttgaaattgacagctttctagtggtattcatctgattgtccactttcctaactatgga

SEQ ID NO: 6441 - DNA, 213 bp, mus musculus
agtgatagtgccaaaagaaaagtaacagcaaaatttgagtgaagttcagagaaagtagaaatcattcttatagtgttaagaagggacaaggagtgtttcatggagttcacatcagctgagttgcgtctaaagagcatgtgaggtttctataactgtaaatagaagctcagtaaacatcaagtgaaagaaatagtgcaataaaaggaacaaacg

SEQ ID NO: 6442 - DNA, 1389 bp, mus musculus
ttacatttccacttgtctaaagaatttttgagacatgtgccaaaatctttagaacattagagctgaaagataccttaggtaaatttctcatcaatctattaaaggatattcaagcccccaatttcagcctctgtatccaaacttcaatactgccctatgttcatatcatcactggagaggtctggcctttccttatggcctctttaatcttaattgcatcatctctgatgttttatttggctttgtttgttactccagttactcccacctgtttcccttcatggtttggtttggccccttctctgccctccactccacattgatttcaagagatcaacaaatgttagagaactgggttcaactactaccaagaaagagcttaaccctgaaacctagcatcctaggcctgcacccaaagggagaagagaagcttattctgagctatgagataatcgtaaggtatcaagtctcagggcctggcaaaggagggataatggaggatataggcaagataataatatgactgggtatgtcgttatccaggctgcaaatagaaggaggctttgagcaaaagccttaaaacagttttattttagaagggcaattttctatcatcaatgccaagagaaggctcagcagggaccctactttgtcctgctttgagcaaatgatactgagctccctaataggagttgcagggtatgaagcaacagactgcaggggcctccattactttgaggccaaccacagggtagagctcttgtgggaacagctacataacatgcatgtccagcagtgccccagggaaccaagccatcgagagctactatcacagcccaagtgctgcctctgcagaaagcagtagcccagatgctattgagaactgcttacaagaactgccacttggaagcaccctgagaacttggctttacttggaaatcacctaggagcatttgaaaaatagctactcctgagaccagaacttttaattcattatatttgtcagaggctcattaagccctatgtatattttaaacaagtactcttggtgattcttatgtctgtattcctggcttaatgttcagctatttccagccttttaaaccctgtaggagaacagggcaccagttatttagggaaagaatattggtcattctaactacttccaactgaagaaagagactaactttttctgtcaacaaatgtgataggttttggtggactgagtctcttggcaggtttgagttgagcaaataaacttcgaactaaaactaggttattgatggtcaaaggggtatctgagagaagaatcacagtaataatattgaggaggacgaactttctagatggcactgctttagagatcctagaattaaaattataatattt

SEQ ID NO: 6443 - DNA, 1008 bp, mus musculus
ttttttttcttcttcagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggat

SEQ ID NO: 6444 - DNA, 1008 bp, mus musculus; identical to SEQ ID NO: 6443

SEQ ID NO: 6445 - DNA, 1008 bp, mus musculus; identical to SEQ ID NO: 6443

SEQ ID NO: 6446 - DNA, 278 bp, mus musculus
cttggcttgtctttgtgtgactgaacacagctaatcaaagtattatatgcatatatgtagagccaggtaatataaagaccatgtagagaaactactgtatttgcaaattgatcatactactataatcccttgctttggctataatatccatggacgtcaaagtcagagatatgatttgctagagggctcatgagaataatgctcttttgtctattggaattattctaactaaatctaatcagtttttgggggtggttacatgatgtcaagttagatat

SEQ ID NO: 6447 - DNA, 1222 bp, mus musculus
tatgtaaaagtgtgagcccttttgttacttttagaatgatcacagttcttttaattagttagggtctggtgaaggggacacttgtttttgcattttaacacatgactgcacaaaagggaagctaatattatcacttttttttttggtgccagggcaaatatttttttaaaaaaggagctccagtcctgagaaattaatgaatttactggaaccatatatttactcaggaattaagaatgtttcctttttttctggggtaatctgttggtgggatgggaaggcagtttattaaaggaaaaagagttgaaaaattgttgcttccctcctcctaaaatgctgtttgaaatatttatgtctaagattgcacatctgaaaatgtggttggatggttttttcccccacttagaggagaaaaacttcagtagtttttatttcattgtgattttcttcatgcctaaggtgctaacataaaacagagatagatgtgaaagttgctatcttgtccaaggaaattttaacagagtgtgacaacttttcttctcttcagtgacttttcctttatgactgaacatggtgtttatggccggatatgagtgaattctttgttttatgaactaaatctttaagatgtggctccaagatgcttcaaggagctttatccctcactctcctatctgtgaaccatacatatgcttctgccctgaacatgaactttcttacccttggttccaaccccaaaccatagtaatgggtgtcttcactccctctgtttaatctaagtgtaaatcttagtggttctaccggtcagatctgtctgtgtctctccatctctgccattaccacatatgctcaagctgctgctatttctttggatgactgcagtctccaaattgttctcctcacttccattcctgcctctttccgtcttctccaaatagttgccaaggtaaacctgtaaaactgtaaatcagatcatgtcatcctatagcttgaaaggcaacagttaaattctgtggcttttataatcagatataaatccccaccatgccccacaatatcctcaagatctgatccctgcccccacttgtcaactaccactctctcccatggtgctgctctgctgctccacattccaccaggtagatcttctttctgcttagtgaacagtcagctcatcctcacctcagggcctttgcacttgctcctcttctgcttcagacat

SEQ ID NO: 6448 - DNA, 195 bp, mus musculus
cctagaagcacagaacaggggcccctcagaatgtgttctcagactcctgagggaaggatgctacccagctacagctggttcctcgagagtttggaaaaagtccctttatagaggcaaattattattagtagtagtattgtttaacttcttttacctaaagagctggttcattattgtttacagtttgacaataat

SEQ ID NO: 6449 - DNA, 500 bp, mus musculus
taggccatggactttattagggtcccagtcctaaggggtctatagaagcctgtctaaagattatttagaaagattatagaaaactgttcagtccaatgggtgtttatatctgttcagacccttgctcttggcttcagctctcaactgtggctttgtgcccctgttgttaagcgcattgattgtagccacttagagctgttgctgctctgaacagcattgcccaaacagaatattcatttttgcacactatttactgagtgtttaacacaatgttttactttatgtagaattttttttgtcacctaagaaacaaaacgagtttaaatatttcatttaaatatttccaaagtctaggccttcggccttggaagttctttgacgttgagtcctttgtgttttctttcagttacaattcaggtctttgagcaatgaggtcagataatcttgttccttgctcttagttcttctctgcctgccctttcttatctctcccggcccct

SEQ ID NO: 6450 - DNA, 1210 bp, mus musculus
attggtgtttcttaaatatagattacttgctgctgctttttaaattggatataaactttaaagtgaacagcattgtaggaagttgaagaggaagaaaatatattattttgagaaggtattatttaaatctatataaatccaacttaattaaggacattggataattactattaaggtcacaaatttataaaaatttacaaactaacatgaagtttaacagctttattcaagagtaaagttcatgaattgactgaaagagctcctcctaaccaaaaaaaaaaaaacttctgtatttttccatagaactaaggtcttaattccttctatcaatcatgtgttttccccgtttgcattgaaggctccctactctgtcctgcagcagcagtccctcctgttggcagggcttttctctcctcctgggggcttcctgcagtccacttcaaacagggctctggttccctagcgggcctgttaaattattaccctcaggtgttgattcatccttggcattgttgcattttaccattttgtagtcttcaggcatgggggaaggggaagagagttgaagaagatcaaagtagcagtactgaagttggagctttagaggtggggatgagccctcagcccctctgctgttcctccctgcccttcccccgcctgaccccagcctacccccaccaccccctgactttctgccctctcaagcctaatcagaagacagagggggctatgtgcttgaactgtttacttacaagcactttatttttacttttgcatacaagcaacaaacggtttaacactacatgatgttttattgtatagtacaactgtataaacagaagataacagatgaggacttactatttttttgattcggtggtttttgaacatacactctattctctgtaagacactgtgggggaaggttatgatgagcaagagactccttgttcccaggcagtgctgagtgaaatagttaataaatttttatggagcgggacccaattattacttgtgttatagagcacaaatatgaaactccatgagaaaagcacatcaaagggaaacaccagcatggtttttaaatatctgtaatcagtaaagtattgcatgttctttttagaaaatcagaaaatactcaatttattaaactaaaaacacagtcactctacccagagttaaccacactttggcacatttaattttccat

SEQ ID NO: 6451 - DNA, 443 bp, mus musculus
tcctcggtatcccagctgtgtctaaaatggacagatttgagaatgtcagttcttcaacttatttacaaactgatcaggtccaatatttatctgctgcttgctgagaacagcatcaaagtttaaaaaaaaaaaaaagaaagagaaagtttccaaccatcaagcaagtgtgcaacacaaatctaaaccatatatgtgatgagacccacatgtcattgtgagagtgttgcaggactcattaatgacacccacagtagcaagtaagtcttcaagaaacctttggaagagagaaggcctgtatatgaaatgccagaaggaaggggcaaaaggttcagaactaggactctgggtatggagttcagacacctgtgaattgggcattctgaaccacttgtacaatgtgcaaagctgattttttcttaccatagcacagggttgctttctat

SEQ ID NO: 6452 - DNA, 459 bp, mus musculus
ataccttttagttcagcaattacacctttaagaatttatccaataaacatatcacatgtgtgaaatgacatacctgtgaagttatttagtacaatatagtttataataacaaaagaataaaaataacttgaatatttgtctctaagaggttgaataatacaaaagaatatcaacaagtgtgaaagaaaagaactaacaaagaaagaagaaaataagctctttatatattaatatggaaagatcttcaagatatatttaaatataaaacaaaatcaaaatgcagaacagtatatatagggtgtgccaccatttgtgtaaaaaagataaataatatttttgctgcttatacatggaggaagatatagaagagcatttgttgtttatagggaaaggcattagaattgcctcaagggtatagaccttttgctgcctaaattttgaacattattcacgtattat

SEQ ID NO: 6453 - DNA, 1635 bp, mus musculus
aatttctttttcttagaaactttgaatgttaacttccttttttatgtgaaatgactgtaataaaatgtgcagaattgatcgcttagaagattgatgttcttaaaactgatatcttctctgtgactatatggtatgctaacaaaaaaaaaaagaaaagaaatagaaaagcatgcttctctactaatggtacactgacctttatcaggaactatttcccaggataattacagaattttaaaaagatgatttgttatattttctcctcttagttatgatatcttattttctcttactttttcttggaaaagatgcaaataagttgaatgcccatttgctataagaattaagaggtggtttttataaagttcttttgccagtaaggatcagctaggttacactacagtaactaactaccctcatttctcaatggctgaacagagcaaaatgttacttcttcctaaactttcatgtcccgcaagggtcagctgaggaactctcttgcacaaggtcaatcattgattcaggctgacaaaaactctaccatcttgaaattgaggtatacggaatagatgtctttctcagtctgtgtagcagaataagagaggaagggaaagcattgcttccacaattactcgtttggactggtaatgacatgcatcattactacctaaagcccattgaccacaatttgttacaaagacccaactatttcccaaaggactgggaagtagaatccactgaggtaccaagaaggaaaggagaactgaatgtgaattgttccagaattttctatcatagagtttatgttatgtcactgtggaaatataaatcggaaagatagactgtggctagattgtggtagactatcttagcctaagggatttgtactttaaattataggcaattgaaacccatctgtttttaagcctcagaaattgcttttcgtgctattataatactctgaggattgaagcactagcatttggagtggaggtagggttaaagatgagaacaactaatcaaagatatatattcgctataatttcctccaggatgccaatacttacaactctttcctgacattttcctagcctccactgaatttggtgtgaatgttttctttattctcccttgtatgttccttttccaaatttgaccttgctcctcatctcctaccttccccccacagccaaaatttactaatttgtgacattattagaaaaattacatgttcagtagctgctttagtaatgtttatctggctcagatgtacaatatggatacagggtgaaatcaggtaattattttaattatttctctttttaaagataatgagtgtttgaaaggtgtgactgcagtggtattagaaattatctggagagtacaggagaacctagagaataaagattgactgatttcgagcttaagtgactgaagggatgttttgggttatcatttgaaaagatgaattactagtttacatgaaaatacttaaggaaaaatcacagactactacccttagttataatgtatatatatatatatttttttttaatagcattaaatctattgtttatgttactgtcaattgtctttctacaacataggtctactcgattcttgtccctttcctgc

SEQ ID NO: 6454 - DNA, 18020 bp, mus musculus
ttttcatcttttaagtggtggaactggcacttgggcttagatatttaactaaaaccccatgttcttaaacattgtgacataaagtatctacatatctaaatacatgaataaatagaactttttttattccaaattatattagttaacatattttccagtgtttgatgaattaagttcaaattcattcaatagataaattgtaaatttcactattttttttctttttctgtttttaaacttttaggttcaggggtacatgtgcacgtttgttatataggcaaagtcttatcctggggatttgttgtacagattattttgtcacctatgtactaagtgtggtacccaatagttatttttctgaatctctcctttcatcttccaccctcaggtaggtcccagtgtctgttattccccacttcgtgtctacatgttcttatttagctctcactgataagtgagaacatgcagtatttggttttctgttcctgtattagtttgttaaggatcactttttaaaaataagcatggtgataaagtgagtaagagatcattaatttgacatgtatagtctgtggcacccattgggcatccaatgacagtatgtattcagcatatgcctcaataattcaaataagaaatttagagacacaaatttagaaatatctggcatagtgatggtcaaagtgtggcttttttgctcccgtaatttggcaagtgggagggagtggcatgcagcggcttcacttcttcattcctgtagctcagtgagcaggacagagtggtgcccagcagctttgcttcttcactctggttttttggggagtgggagggagtggcacccagtggcttctcttcttctgtagtacagtgaatgggaaggagggttacagctcttttatttccactgcccacagctcagcgagcaggagctctttcactcctgcagtttggtgagttccaggttcttgtcccatgaccaagaggaataagtatgtgggcaatggagagtgagtaaggcagagtagaattttattgggtgacagaaaaactcttagccagaagagaggacccgaaagcaagttgccatctgtgagactgagtccagggtttttatgggctaagaataggagaatgagtgctgattgttccctgggtggtcttggataaagcaccattcaattggttaaaagacatcattcagagggaaccaatcaagagagaatgggtaagatggggatagaagttctcactctacttgtggactctatcaggaactggcagttaaattttcaggctttaaactgtccttggcttgaatgttgtgtttcactgggcacctgtccctgttcacctataagaatttgtctgtctcctgttactattaattccccctctgaagaggtacatctaactgtttaggacagggacaaggacggttataactgctttatgttgagatggggcattgttttgggaaaacggcagtcacatctctctcagaggcctatctgagggtccccagtaaaaagggagccgtcatccaaggctccatttgcatgaccatttggagtttgatggcctctaggccagaagaaacaaactttttaaggcagttaagtatgcatggttcaaatatgactattatataaagaagagtaaactggggaaaatttagtgccagagatagcagaaataagaagtaaaatagactaattctgaaaaaaatgttgtggccagagctgtttcaccctggtgaaagaaattaaattttgtataggggagggcagttacattttagaagagaggtagctgtttaggggagtatataatcccatgggtattcaggactaagtgatccttggcaaagacaccttatggtggggaacagaatgaaggtgagaacagcaattatagacaagactgtaaacaagatatccatgaaaggttaattattgacacttatcttttatgatttttagcttgaggtctccaatttcttcacactggtgcttcaggtgctcttctgggtcaacagaggtaattccaccagtttgccttgcctttacttgagtataatgaatccaagaatctattctagtgaccttcactgctgaaggagtaggaataagtaaagtgtaaggtgtctcccaatccaggcctagagagggagaaaaagaaggaagagcctgtaccagtactaagtcccctgggttgaatatggttggccctggttcacagggttgggcttccaacagttatttcagttcttgtagaaaatgggccaaagcagttgcatgtttaatcaaatctggtttcttcatctagcaagaaatcactggtgagaaaagccatccatacatgatttagaaggaacttaaacccagtttcaaaggagtgtttctaacatgtagcagggcaataggaagaagagtaatcaaagggagatgagtcttttgagggagttttctgatgttccttttcataatatcatttgtctcttctactgttccttttcataatatcatttgcctcttctacctttcctgtgaattgtggtttccaagcacaatggagatggtattctatgcctagtgcctttgataatccctgggtgacagccaccttgaatgaagggccattatcgctctggagttacttagggagtccaaagccaggaattatctcattaattagtacgtttatcacctcaaaggctttttctgtctgacatggaagtgcttctacccagtttgtgaaggtatctacccataccaggaggtactggatgccccttatctttggcatatgggtgaaattcatctgccagtcttcccccgtgtagcctcccattctttgggttccagcaggggagaacctgttgattgaggaaattatttttaaggcaagtctcatgagcattaacgacctgtttgattatttttagcagatttttacctgagaacaacctttggaccaattgatacattttatcctttcctaggtggaaggcttgatgaaggattttaagaactttccattggctggaagttggtggatggtttgccatcctcctattgtacctatcgtgaggggtgaaaggtgtattcccaagaggtggcccattctatttctgcagaatattgaagttttatttttcttatggagccctctcagagcagaggggcatcaagtggatcagaaatctggggcctctcactgctgatttagctgcttcatctgccaatgtatttccctcacctatttcatccatccccttttagtggccttcacaatgtattactgcctcaccctgtggaaggaaaattgaggataatagtcagttaatttcctgaaggcatttaatgggagacccattagctgtgaggaagtctttcactttctagatagtggcatgggcatggaggtctaggaatgcattcttataatcagcataaatgttaactgctttctctgcttaattcaagaaccctcatgagggcaattagctcagctggttaagcacttgtgcccaagcagagaggcacactctcagtaatgtcagtcagggtgagtactgcatatcctgctttgtgaatcccttgttctacaaaagaacttcatttgtaaagagacttcattctgggttccttaagggggtttctttgaggccctctttggccacataggtttacactactatctgttcacagtcattttcaggctccccagcttcctctgggaggaaggtggctctatgtttagggagggacaggtccttacctggactgtagatctctccaatggcagagcttgatatttgaggaggtggttgtccattagccagaaactccccttggaagacagcagtactgccacattatgtggggtataaatggttaagttattccccatggttaacttagtagcctctggaaccagcagagctacctctgcaactcctcagaggcaggaaacccatcctttagccaccaaattaagctccttgcttaggtagcctatgggctgctgggctggactgcagacctgggttagaacttccagagtcattcccttcctttctgatacataaagattgaatgtcttacctatgggaagactaagggctgttgcctcaagcaaggcttgtttcaattggtcaaaggcccttttagcctctggttctccagtcagggattgagtcttagctgcctgagtatcctttattaggtggtataaagaatgagctatctcacagtacccaggtatccatccataatctgcagaatcttgtaatgcccaagaatcccctcagttgtttgagggttttggggaggtgaaaggaagagatgggcttaatactttcttcacctagtaccccgatatgctctgacaagactagacctaggtacttcactgaagtctgacagagctgagccttagattttgagactgcatttgtcagggttatctagagggacagaactaataggatatatatgagtttattaaggagaattgactcacctgatcacatggtgaagtcctatgttaggctttcacctagttggggtgaagttgttaagttgaggagcaaggaagccagtggtggatcagttcgagtcctaaaaccttaaaagtagggaagccaacagtgcagatttcagtctgtggccaagggcccgagagcccttggtgaaccactggtgtaagtccaagagtccaaaagctgaagaacttggagtccgaggttatggggcaggaagcatctagcatgggagaaagatgaaggctggaagactcagcaagtctgctcatccatcttctcctgcctgctttattctagccacacaggcagctagatggtgcccacctggactgagggtgagtctgcttctcccagtccactgattcaaatgttaatctcctttggcaacaccctcacagacacacccaggaacaatactttgcatcctccaatccaatcaagttgacacttaatattaaccattacaagtccaccccttgtcaacttgaacccatacatatctcctgaaatcatccataatcttcaaataaagctaatagtaaggttatatttatgcctaatacaatacgactatccttcgtacaactagaagcacactaatccttaacataaatgctattacatagagttaacaatgcttaaatgctaatatgaattcaacaaatcttttgtcacatgataaaggcaaaagaaaggaaataaaatgaagatattttcttagtacaggtgtatacatatacaaacatgttcttaacaaaagaaggaggaaatagtcatgacaattacagtcatttctgcagttggtcacgtggttatagctggtattgatgactaccttcctctactgtctattctgtattccctttgccttcagcaagcacctcagcaggttgtggtttttaccctgtagagtgacccaaaccttcattcctgaagggtttgggccgtttgtagtccttcctggattgggttgttgttgtttcccattgactttaatcacagggcatggtaatactaagagacaccctaagggatctcctgtattccacacatattctttcttacctccattgtggagtagtagactgatttcatcttgttagtctgggtcaatcacccagccaacactgtaactcccttcttagcctgttgactcagagtaggaggactccaaagtgtccgggtggcaatcttaactatcagtttaatggaatcattgttgtgtctcctggtggcaacattcctccttctggaactaagacttctaggccagcagaatgtaatgtctcaggaacaggaagcaaacatttttctagggggtcactaggagtgatggtgtgtggtgccacttccacttccatcccttgattcctggacccatgaattcttgaattctgactatgggagaaagagtactatgtagtaaatgctgattcagagcatacattggcttctgaagaactttgtcccagctctgcaaagtattgtcacctacttggcatcataattgtgacttcaaaaggccattctaccattctatcaatccaactgcttcaggatgatggggaagatggtaagaccagtgaattaaatgagcatgaatccactgctatacttctttagccacaaagtgagtgccttggtcagaggcaatgctatgttgaataccatgacggtgggtaaggcattctgtgagtccacagatggtagtgttggcagaagcattgtgtgcaggataggcaaacccatacctggagtaagggtctatgctggtgatgacaaactactactctttccatgatggaagagatacagtataatcaacctgtcaccaagtagctggctgatcaccctgagaaatggtgccgtacagagggctcagtgttggtctctgctgctggcaaattggacactcagtggtggctgtagccaggtcagccttggtgagtggaagtccatgttgctgaacccatgcataacctccatccctgccatcacggctactttgttcacaggcccattgagagatgacaggggtggctggggaaagaggctaagaggtgtccacagaacgagtcatcctatccacttgattattagaatcttcctctgctgaggtcacgttttcatgagcactcacatgaggtacacatatcttcacagttttgacaactcagacaggtccatccacatacctcttccccaaatttctttgtcaacagtttttcaatcatgcttcttccaagtcctgaccatccaaccaaaccattggctacagcccatgaatcattatataattgcacatctggccatttctcctttcatgcaaagtgcacaaccaggtgcactgctcaaagttctgcccactgaaaagctttcccttcaccactgtctttcagaaatgtcctagaaaggggctgttgtgctgcagctgtccactttcaggtagtgcctgcatatagagcagaaccacctgtaaaccaggcccttgtgttctcttcctctgtcaattgatcacagggaactccacatgaggctgttggtgcaggttgttgaagagaagacagggtgacaggagtagagaccatgggcattggagccacttcctcatgtaacttatttgtgcctttaggacctgctcgagcactatcacatatataacacttccatttgatgatgggatattgctgtgcatgccctactttatggtagatgggtcaaaaagcacccagttcatgatacgcagttcaggtcatgtggtgacttgtgacccatagtcaaacgttcagtttctactaaagcccagtaataggccaagaactgtctctcaaaaggagagtagttatctgcagaaaatggcaaggccttgctccaaaatcctagaggcctctgctgtgattcacctatgggggcctgccaaaggctccaatcagcatccttatctgtcactgacacctcaagcaccattggatattctgggtcatatggccttagtagcagagcagcttgcactgcagcctggatctgttgcagagccttctcatattctggaccccactcaaaactggcagcctttagggtcactcgataaatgacccagagtgacacacccaaatgaagaaagtgttgcctccaaaatccaaatagccccactaggcattgtgcctcttttttggttgtaggaggggccaaatgcagcaacttatccttcaccttagaagaaatattttaacagatcccacaccactggacctctagaaattttactgatgtaatcttagtcggatttatttcctatccccggcaggcaaatgtctcaccaataagtgtgtttgctgtttctcgcttaatgggtccaatcagcataatgtcattagtgtaatggatcagtttgatatcttgtggaaggaaaaagcaaccaagatctctgtgaacaagattatgacacaaagctggaatgttgatatacccctgatgtaggacagtaaaggtacattgctggccttgctagctgaaggctaattgtttctggtggaccttatggacaggaatggagaaaatggcatttgccaaatcaatggctgcataccaggtaccaggagatgtgttaatttgctcaagcaatgaaaccacatctggtacagcagctgcaattggagtcaccgtttggttaagcttatgataatccactgtcattctccaagatccaactgtcttctgcacaagccaaataggagagttgaatggggatgtcataggagtccttgatggtgggactaatctctgcaatccctccaggaatgcaatattgtttttgatttactatttttctaggtagaggcagctctagcagctctaatggctttaatttggcctttccaccataatagccctcaccttaccagtcagggagctaatgtggggattctgccagctgctaagtatgcctatgccaattatgcattccagcactggagaaatgagtctggggacccactggatccactgtaagtcagacctgagctaaaactgcattaatcacccgaattccataagcccctgctttaactggaggaccacaatgacattttgggtcccctggaatcagtgacagctcagagccagtgtccagtagtccccaaaatatctgattattccccttctcccagtgcagttatcctggtaaaaagccagaggtctccttggggaaggatgggagaaatattaacagcataaattgtctgtggtgtagtggtgtccttcctcaatgggacccggcctcccttcattcaaggggttctgggtctgtaaacaggtacaagtctgaaattggttgtggggctgtgattctctgtttttataattaaaattagtctttttttacttgacctggaagttttctgcttatacaaattaagtaagaatgcagtagacttcctattaatttaacttctagaaataccatgattaattagccagtgccggagctctacatgagtcagactattccgattgctgctttgcctctgctgtccattagggtgactatgcccactttgcctttgacagttgagtgccacctcttggctcctgccacctcaagatccaattattcccatcgcatttaaattttataattgaatgactgtggttcctacggtaagatctggcatacagagaagaccaatgaaagagctcttcaaggatgcaggtactcccctcacaaatttatttggcaaggtattggtgaacggtatgtcttctggatcctccctgctgagacgggtaggtctaaagtgactaagccactctagcatcccaatttcccttagcctttggatcccctcctctacattaaaccaagggagatccagcatttccagcttgcttactgtgggctatcttttgatctatatttcagctaaccaagcaattaaattattagaacttttttttaactccccaagctgcaacattaaatgcagaatacctgcttagtggccccaaaatgaatgaattcagcctgatccaactttatgttccttctatcattattccacaccctaatatccattcttatgcctgttctccagatttatgcttatataaattagaaaattcaagcatttttggggggtgtagcacaactcatggatcacactctgaacctcacttctaggggcctttagtctagtgataggtctagaagcaaacaggggtgttagtggtgggttctgaggagactcaaccttgtctttcctggcaactgcctgaggggaggccatcaatgttgcctcagccagtgcatagttaatctcctcagacaaaggtgaaaaggctgatggcagcataagtgggggaggggatgttgccaccattggaggtgggaaggctgtttcctctggcaaaaaggctcgtcagagtttacaagcttagtgtccccagcttcatcagggtcctcccacatgtccccgtttcaagttgcaggggcacattattttccaatcaatgccctcactttaattgtggacatctggtaagactgagcatgcacttttcattgcaggtcagccactcacatgataaaaacttgtgtctgatttttggcaatttctgccagttgtctacaagagataagactatcactcaaggtaatgttagaagacttgaggcacagtatgtgcttctggagctgggagttagaatctttgagctcattctttcctttcatcactttttccagcaaacttaggagcaaccagccaacttcattgtattccttttggttcaacacatatggtaaaaggtattatacatagattcattaaactccttgcctctcacaagcagtgaatcagaagtatcaaatgcatttattttgcataagtctgtaaacagttcacaccaaggactatcagtgttctccatactattaggagtagagtccttagcatttttgagtctaatcagattaagcagccaactccagaaaccccaaaaccaactgaagaaatccatccttaaaattattttcctctagaacaactctggtaccaaaatctgtattagtaagggttctctagagtgacagaactaataggatatatgggtatatgaaatggaatttattaagaagagttgactcacactatcacaaggtaaagtcccatgataaaccatctgcaagttgaggcacaaggaagccagtggtggatcagcccaagtcccaaaacctcaaaagcaggaaagccgacagtacagccttcagtctgtggccaaaggctcaagagcccctggaaaactactggtgtaagtacaaaagtcaaaaaactgaagaacttggagtatgaagttatagggcagcaagtatgtagcatgggagaaagatgaaggctggaagactcagcaaatcaacccatccatcttctcctggctactttattctagccacaaaggcagctgattagatggtgaccacccagattgagagtgagtttgcttctcccaggctcaaatgttaatctccttcagcaacaccctcagagaacacccagaaacaaaatttgcatctttcaatccaatcaagttgatgttcaatattaaccatcacagagaccttatatcctctgttagccagaaaattaagaatagctctactgccctcctgaataatttattcagttgaggcacaaagaagaatgccatttacatattgtaaaactttaacctgggtgtaaaataactcagatcttttgacaatgcctgcccgaacaggtgggggctgtctcagaattcctgaggtaataccgtccaggttagctgggtggtctggttggagggatcctcaaatgcaaacaaatatttgaagtcagggtgtggcagtatgcagaaaaaggcatccttcaggtccaggattgtgaaccatttagttctctcaggtatttgaattagcatggtatagggattgggaatcaccagatgaattggaaccacagcttcatgaatgaggcacaggtccttgaccagtctctatttcctgttgggtttctttacccccagtatcgtagtattacaagagttattgcaggatttgaggataacttgcatcctcaattatcgatgatggctcctagccctttcctagcttctggttttagggtatattgtctctgattagggaagtaggtgggatccttaaggtggatttggactcgtatggcagttgtggctcagccaattttcctgtgagttgtgcaaacttcgggattaacatcagtctccaccaggaggagaaaaagagtctgtcctggagccataaggatggtggttcccatgtgggctaaaatataccttcctagcagaggagttgggctttcaggtatgaaaaaggatgagtaaacaaatggactccccaactacaaccaaggggtaaatggttggggaaagtattgggttaaaggctttcctgagacaccccttcatagtcttgctaatggaggaagggaagcctggattgcagagaacagaaatggcagctgcagtatccaggagttcctcccttcctcctccagaatcacctggggctcctggatgataatggtggtttgagccatcggagctggggagagtagccctgggacccatcagtcctgctagaccatttaggagactggctctgaatccagtgacctgtgtctccagggacagtccaccctccagtagtcccctccgcagattggacagggttgaggttacttcctcatgctgcctgggcagtccttcttaaagtgccctggcttgccacattttagcagttaacaggtgtatctccaggattctggggttggtaagcctgccaggtagccattagaatctctgcctttttcttatgttttctctctctctcgagcctccttctgatccctattgtaaaaggccaaggtggtcactttcaggaggttctctaaagtactctctggtcccatagcttatttctgcagattcctcctgatgtcagggtccacttgagtaataaacttatcctttaggattagttgtccctcgactgaatcaggagatagagaagtgtgctttactaaggcctctcttagcctttccaggaaggcagtgggattctcatctgatccctggtttatcatgaagagtttggagtaactgagaggcttagttttagtccttcataagtcttccaatatgtacatctgaaagcgtttcctcttcaattctccacgtcatcactggggtcccagttaggatcctctaatggtactgctgtttttccaattggataagtctcttccccttccttggcactatatgaaatacaaagctcatccccaaacttatctgccacttggagggctgcctgcttctcagtggtactcagggtttgattcaaaagtaacataaggtccttccaggagtcttcaaatacttgggttaaattctggaaaacctctctatacctgtcagggttgtctcaaaacttagcaagatcccccttaatttttcttaagtgctgtagagtaaaggggacctggaccttaacggggccatattcacaaggctcttcacatcccttttaggggcatgactgaggctggggctcacctaaaacaaacaggagaagcttgagagagaacctggatagggaggagaggatggaccaggaaaagcagcaccagaaggggctgattcccgctctggaggcgcctctggggtttgcttccctagtctcttgggattgtcctttgcagcctgtcctgagatgaccgctaggagggctggatcaatcctacaatgtcagcaaaggttcagattatcctgcaaggcaaagaaagcctgcacatatgggacctcagattatttgcccttgagtacacagaaaaggtccagctgcaggatagtattaaaattaatagtttcctctggcaactaagtctctccatcctgtaacttataactcggccatgctgttgtgcaaaggaacataaggtattttttgttgttgttgttgtttgtttgttttttattatactttaagttctgggatacatgtgcagaacgtgcaggtttgttacatatgtatacacgtgccatagtggtttgctgcacccatcaacctgtgatctacattagatatttctcctaatgctatccctcccctagctccccatcccccaacaggccctggtgtgtgatgttctcctccctgtgtccatgtgttctcattgttcaactcccttctgagtgagaacatgcggtgtttggttttctgttcctgtgttagtttgctgagaatgacattttccagcttcatccatgtccctgaaaaggacaataactcatccttttttatggctgcatagtattccatggtgtatatgtgccacattttctttatccagtctatcattgatgggcatttggcttggttccaagtctttgctattgtgaatggtgacatagtaaacatacgtgtgcatgtgtctttatagtagaatgatttataatcctttgggtatatacccagtaatgggattgctggatcaaatggtatttctggttctagatccataaggtgttttctttccagaatctgagggtcgaaggagtcccagagattcaggatgtactcaagaggagtgcaggatgaagattgttcattacccatctgaaaagggggaaaatggcatcccttagttcctttctttcttccagctaaaacctggggtatgtgagggagagaaaaacaggtgtccctttctttctttcctcctttccttccccaagtcctggcagccactacaggagccacccatggatgtaagggtgacctccaaccaaggggtgagagggcccacaggtggggctatttgtacttacctacactgcaccctaaccctctgctgtcagtaacatttgggtaccctaggcctcatctatgccatggatgtgagtgagtcatccacccatgaagcaggaaggcccagttagctgggatagtcatgcctatgtatgctgtgccctagccttctgctgtcaactgcctctggttccctcagatctagttttcttctcagagctccaaaccaaagcttggaaaatactttggagtaatgttaaggtaaagctgtggaatgagatccttctcaaacaaaggtaaaagtgggagtcctgggaattggggacctggcctaataagatccctcccaagaggaaaaaaaatagtcccttgcacataaaagctcctagtattcacaggattatgttgactactaacatagtggaaaaaacaacttaaaagcagagaaggaaaggtgacttgaggaaatagcctcttgctctgtactaatgggtttcttcaacaggggaaagaaatctctcttaattgttacatcccgtgtttcaaagaatagataaaaacaacatcattctggattaaactcctgatgactaagccaaatgctcattctacccagtaatgttatctctttggaagtcttggtcagacacctgaatctgctgtcagggattggaggcggtttaggcatcttcaggtaacactaaggtgtggccttggccagataccttcagttgccccaggaccttattctgatcccacatgatggctaggcatctgtgaagggaaactggatttgagcaaggccaacattctctacaccctagggtgaaggggagttgacaaagtcctccccagcaagcctgtcctctgagtcttttagttcagcagctacactatcttctcttaactggctgacaaaggtctggtgtttaatttgttttcagaaaaaatctgaggatgaggagcctcagaatgaaagtaaagagtcacaggtctgctcttactcacccttccaaagattctggatgagcccccagaaatgtgtggcgtttttgctcctgtagttcagtgagctggagagagtggcacccagggattcattcctcccctcctgtagtggctacttctttcctgttgtttgggagtgttactgctgtttttactcctgctgcctgcagctcagtgagcaggagtgttacagctttttcacttctgcagtttggtgagttctgggttctggtcttgtgaccaagaggaataaggtacacagacatcagagagtaagtaaggaagagtagaattttattgagcagcagaaagaacgctctcagccatgagatgggacctgaaagcaagttgccatctgtgaggctaagtccaggggttttatgggcttagaatggggagatgcgtgctgtttggtccatgggtagtcttggaaaaagcaccatttgattgcttaaaaggcataattcagaatgaaccgagagagtgggtaagatggggataggagttctcaccctgggcatggactctatctgataccaggagcttggttttcaggctttaaactgtccttggcttgaaggttgggtttcaccagggactcatccctatctgcctagaaatttgtctgtctcctgttgctatcaaaggtagccaaatgtgacaatcatagaagttcaaaggaaagtgtatgtcaacaatagagtttcattttgagcagagaaaaaggctcactggtttcagggaactgtagaccatttgtggtcttaccaagaggctgaaagggtaggggaagagagccagggttgagtgcaatgaaaaatgcaagttaaggaaacaaatatattcagaaaagaggttttccagaatttaactattaatggaaggaaagagtagggaaagtgagaataaagaatgaggaatatttgattagttttaaagctaaagagaaatgtccgtttcagaaagaggtgagagaaaaatatccaatcacccatctattaaaaaggaggatagctatgtgagggatgtacatcccctgtaatacaaaaggaggaagaatggaagaatacatgggggcccataaacatgggctcagaagatacatcatgtgatttggaagggttcctgtctgagggcttctatgttggtaaagcagaaggtaaatctatttgctgagaaaattgatgagatattttttaacttacagaaccctttccaagcactctagaaattactaaaaaatagaagaggcaagagatattaagagatatgtagagttattaagtcaattaaaagcaataatattgaaaagccagatggttaatgtttaacatataattttaaatttccatatttgcataattttcatagattacaaccacttccctctccatttcattcaagcttcacaacaacaataaacttcaagagctctattatgtaactacttcatttaaatatactaaatgatatcaattacaattaaattaacaatgatcttcccattaagagacaatcatcattaacgtttttctgtatttgttcctatatatgctatcatagatatgtcttccaaaggacccaaactggcccaaactgtacatttagttttgtaatgtaatttttaaaattgaaatattaattttgtacattttctacactaagattataatcagcattgtattatatcagtgtactaatttgggaggaaataatttttacggtattgataattcctatatttttctattttttaggattctcagggaagtttaataggtttcttaatactgtcttgtgcagaagtcttcaagatcttcttcatggccagccctatggtttcattctgtactgcacgcttcattttcacaaccccatctgttctttcccttctccaacttttgaaagccacatttatttgaacgatttggggagcaggtagaaattgttattcttctgaggaaatgtcttgatttttttgttagcctgtttacctcaactggtggagtttagttctgaggttattgaacatagttatgactcttcacttgctttattatagaggagttttgtgattagcaactttcgcctgcacagtgccttccttactgagaataaagaataattctcatttgtaatcatctagctgtttatgcagccactataagatgacagtgtggcgatgttaatgaggaattacaattctatacggcagtgttatgaagaaaagatacttttggatccttagatttatgttacaaataatgccctctttctttggcgactcttattgttagattaactcatcaccaaaaccacatttgagtaggacactaaatgaatattttctttaaaaacttctaaggacttacacaaaattgtaatcttgttatttttaaaatcaaggagttgaaataggaaaaacaggagtggggaataggaggaaaaataaaagaaatgaaagtagacatgacaaattttaactttcagcaaataaaattgaagccaagtttttgtgagacttagcaaacaacctttacccgatgctgtgatccagatatagaaaagaacacaaatact

SEQ ID NO: 6455 - DNA, 335 bp, mus musculus
aataatatatggaaagtattctttgctctgagaatataggagaatatgcaggaaactctgtggccctctgaagtgatcagtgagtgtctaatgaattattgtcatacaaacacatacttctattatcctgtagttcacaaattctaattgtgtcctttcctttctacggtgataaacactactgtgaatgattcactactttaatattctttagctaattttgaactaagatcactattcttgggaatttggggaatttgggaaatttggggttctgatgagtaattctaacattataatacatcttaaactactgtaaaatccatttatactaa

SEQ ID NO: 6456 - DNA, 600 bp, mus musculus
acctcaagtagtctgaccaggggacacatgagagcttttcattgattgcattcccacaagcatatttccgtcacaagtggggcatgtatctcttgtttggtttgtttttagtttcaatagcatataacttgcttatttcgcttctatggatactacctgtgccactaaataggtccccttaaacctcttgcaaaaaagaaggaagtattatttactctacttttctcttttaaccctgaaatgaacatacacattgttaaaaatatttatggcattttattgctactaattatgaaaaaaaaaagaaacagcaggaaacacaaaagagcaaatgtcggtctacatttaaagcaaccataatgaggactctcccagtgttttttcaacttccttaatctatggaccattttcagctaaaaaataattaatgataagtacactttaattctaagtatcaatttttataatatcagctaaaaacataccaacaaaacttatatatgttttgatataattgtataaaataaaatttttatgtaaaataagatataaacttattttacttatagctctgaaatctattaaatttcattttcaaat

SEQ ID NO: 6457 - DNA, 481 bp, mus musculus
tcaaatcattcctaattgggatctcttaaataactccctcctgggtctagagaggaaattgaatcaagcattaaatcaggaagtcatctttatctttaaatatattgttattcataatcaaatatgctgatattgatgttgccaaagattaagaaaaagatcttttttagtactttgtaattaaggaagtactagttggtaaaatcatggttaactgatagtggtaaaaaccaatgaaatattaaatgcatattgattactgtgggcaaatggaattgcttacttgaagtatttaggatacagaactaatgatgaaaatacaaacctatagacaacaggagctgatttaataaccagatgagtaacaatagatctcattactgtgaatgatgttgtagaaatagggatacggaggagacagtattcagggccaaacatataatgagaaaggaagttcagtgttgaaatagtaataataatt

SEQ ID NO: 6458 - DNA, 333 bp, mus musculus
tatattatataattggtttaatgctatttagcattatttttaatatttaaacagaatcaattttaaaattttatttttaaattttagaataaaatttaaatattattttgaatgttgtgaaggtgaatatagcaactttgctctgtagaacagggtaatagaaggaacctcatatagatagattcattagacaggattttcagcatctctcccttggaaattagaaactggacatgagatgcctcaatatcattgacaagattaatacatttttgtataaatctaattgcagccatgggaatagattagagttcctaaaaacttctgcagagt

SEQ ID NO: 6459 - DNA, 336 bp, mus musculus
ttcttgtagaagttcaagctcattgtattttaagatacacttccgggagaatcagtataccacacacgcacacacgcgtgcacacacacacacacacacacagcttggttgcttgagtttgagcccctcgctatgaacttttattgctttactagacacctgaggggaactcagaaatgatatattttatcttatttttcacattattgtatattttcttgtgtcataacttactgtgtgtgatacttacctcacttggtggattgtgcttcactatatttttttagtattcttattacttcctcgactaacaccttctttaatcaactttcttta

SEQ ID NO: 6460 - DNA, 1622 bp, mus musculus
aatcatctgcatgttccaatatttacttgaactagtgaatacacacagtaattaggctactttcatcaatcataattacagttttatacttttaatttttaggattcataaattaaaactaaaacttatcaaatttatgactatcagtaatgtcattgtcccttaagagttaacaaaagagcttctgtacagtaaaagaaactatcatcagagtgaacaggcaacctacagaatgggtgaaaatttttgcaatctacacttctgacaaatgtctaatatccagaatttgcaaggaacttaaacatatttacaagaaaaaacagccccatcgaaaagtgggcaaaggatatgaacagacacttcttaatggaagacatttatgtggccaaaaaacatatgaaaaaagctcaagatcactgatcatcagagaaatgcaaatcaaatccacaacgagagatcatctcaagccagtcagaatggcgattattaaaaagtcagcacttttggaggccgaggtggacagatcacgaggtcaggagattgagaccatcctggctaacacggcgaaaccccatctctactaaaaacacaaaaaaattagccaggcgtggtggcacacgcctgtagtccccgctactcaggaggctgaggcaggagaatcacttgaaccctggaggtagaggttgcagtgagccgagatcgtgccactgtactccagcctggttgacagagcaggactctgtctcaaaaaaaaaaaaaaagtcaggaaacaatggatgctggcaaggctctggagaaataggaacacttttacactgttggtgggaatgtaaattagttcaaccatagtggaagacagtatggcgattcctcaaggatctagaaccagaaaaacatttgacccagcaatccctgagtatatatccaggggaatacaactcattctaccataaagacacatgcacacgtatgtttattgcagcactgtttacaatagcaaagacgtggaaccaacccaaatgtccatcaatgatagactggataaagaaatgtggtgcatatacaccatggaatactatgccaccataaaaaggaatgagatcatgtcctttgcagacacatggatgaagctggaagccatcaccctcagcaaacaaacacaggaacagaaaaccaaacaccgcatattctcggtcataagtgggagctgaacattgagaacacacgtggacacagagagggaaacacacaccagggcctgttgggggatggggagtgggggatgaggggagggaacttagaggatgggtcaataggtgcagcaaaccaccatggcacacatacacctatgtaacaaacctgcacgttctgcacatgtatcccgttttgtttgttttgttttttgtttgttttgtttttttaaagaagaaataaagaaaaaaagagttaacaaatattctgcgaataattttggaagaatcttaaaggtaaaccttgtttaattttctatgccagaatttatctgtcttccctttgttttaacataattcttccaacatttcttttaacaaaatgaaagatgatagaattgttacatacaaatctgcttaaagtgctacatt

SEQ ID NO: 6461 - DNA, 255 bp, mus musculus
tttttttctttcctatctgaacttactttttttctggatgtattattagaaatgagtcattctagtcctccttcagtgtcccttttatgtttccatctttctatctcatgtgtactttaatataactaattctgtcatattgttctcttcttttatgtatctttatgcatatttgtctattctaacacttttctattgctatgtttcctctctagaatttgtatttgtttctcattcaatagtctttttttttta

SEQ ID NO: 6462 - DNA, 375 bp, mus musculus
aagatggggagtaaggggcagagagggaataagaatgaaatcatactaatgccatttaatatgaaaaaatgtatagttagaattctgataaatttgtcacttctgatttcaaaaattagtcttcatagaaaaaatgttagtgatatttgaggaagggtattgcatcatttcaaaaataaataagggaagttattttagatgttgtgccaccatttaaaagtccattcttgcagacagggagcagtggcattctgcatgattcagtgtgcccagaaactgccacataggtagggatgacaggaaggaaggagtttatcaatgaaccagtggttttcaaagtgaagcccctagagaagcaacagcagcagcgtctga

SEQ ID NO: 6463 - DNA, 204 bp, mus musculus
ggaaagaattaactcctggtaatcaaaaatttctgaaaaatgctgctctccgctgttgcacactttatttccttttgttgtccaattaatgaaagattagtagaaaatagtctggaaatgaggccttaggggcaagaaattttcttatcaagacatcacagtaactgtaatcagttaacagtaatttatgcatatcacaaagta

SEQ ID NO: 6464 - DNA, 672 bp, mus musculus
cattgaactagaacattagtccttatacaaataactatattagggaatattactggtttctacagggaaaatagattttctgctagaatagaaatgtgaacacttcctctactttaaagtacaaaaaatattctatttcacctttcacaatgccaaaggcacctctgtatcactcaaaagtatgtgttgattggccaggcatggtggcttacgcctgtaatcccaggactttgggaggttgaggcgggcggatcacgaagtcaggagctcgagaccatcctggctaacatgatgaaacctcatctctactaaaaatacaaaaaattagctgggcgtggtagcacacgcctgtagtcccagctactcaggaggctgaggcaggagaatcacttgaacctgggaggtggaagttgcagtgagccaagattgtgccactgcactccagcctgggtgacagagcaagattctgtttcaaaagaaaaaaagagtatttgttgataaataaaagttaaactttaaaaaatatattgttttcccatcacttttattgtctgattgaggaaaattacctcatatttgtctcattcagttcatctttcaacatgggattctaactatagaagttgtcatgaaaccaaccaaagttatcaacagagccctggctttagaaga

SEQ ID NO: 6465 - DNA, 1192 bp, mus musculus
tgacatcatcgcttggctggactctggaaagcaggaaactgctggagcgtgtttggggcatcagtgatgtcacccgctacaaatgctgggtggggttactggactgagggccatgaaaaaagaaagctgcggccccggcccgtggactcactgccattctgctctttctcacgtttcagttcagctcggtttgttttccgtccccctccctctactgtaaaagtatgtactcagtgtttcgtttcctgctggatctgattcaggtcagtgatgaagttatttgtgaactcagtggggaggtgtttcctcccctttgtaccggccctacttagggatgcacggttggttatacgcttgcttcactcggttaggcatggaggagaattcattcagccctcataggtttaaatcaaatgcatgacccttcacattttccagagatttacggccagttacaatgagacaattaaacattcacccccccgccaagctgcacttggagatgtgtaagcagtaatgtagtcatgcgctccccatgatgtgagagcgtgcagaacgccactccccccagcaggtccgccaggacctccgcagggagcatcttgcctgcaaaatcacacatccctttttccccctctctccactttccctactacttttccactcccacacccacaaataaacaaagaaaccttgagcttattttacaaaagtctttgaaatggccctcgtctctccaatgctcctgggtcctggtttggccccatctgtgcaatctctctgatgagtgtgaaataagccaggtttggctcatgctctgccggtgagcttgccctccccatgagcctgtcctctccatctggcctcactttgtttgtgtccctgtgtcctttgtctcccatcctgggatcctggtggtttcctcctcccctcccagcatgagtccttttccccagggttcttccctatctctacatcagaatttcctgctttctcccaaatatgcatttccctggcccaggcatccactgcttcctctcatcgtgaggtccctgccgcaggctgctgatggtattgtggccgtgccttcctccacaacccagggaaagctacgtgtgtgtctgtcccatagggaaggagtcatccctgtctcctcagtgtggtgtgttcaggaggaaggaaagtaaccagc

SEQ ID NO: 6466 - DNA, 1192 bp, mus musculus; identical to SEQ ID NO: 6465

SEQ ID NO: 6467 - DNA, 1009 bp, mus musculus
tgcaacaagtatttattgagtccataatttgcccagcactgggctttggtactctgggccttgatactctaggttgtgtcagagatgtctaatatatttaaggtgacagagttcacaaatgagactttatgaaaatgaatatccctttttaagtctcgagaaatatgatgtgcacccgcttgaggctttattaaatctccagcgagcatgaacttgtttgtgacccaattgtagaattgttgtatgatgactatcccactggcaggcacttcttgtccaagagaatgtaattggatgttggtgactcaagcaatcctgggaagactcctccatgaccaaattaaagacaacaggggcttggtttgtactcagctctacaccaatcagcatgagacaaagaagagatccatggcaaagtggggagactactgtttattttacaagctagagaaggaaaactgcagttcctgagttgcaaaactgctaagaaatgggagaacacagaactttacaggctgaaccttggtgtcttagttattcctcttggctacagaatgccaaccagtaggagattcatcactgagatattacagggaaatgaagccaggcaagaaaaatatgtattccctttcttctcagcccataaattttgttattaataaatcagactcttatagaacagcttgccacggctgtctctagaaatgtttttattagcagaatttttattaaaataaaatacacagtagttttaagagtgaacattatagttttaggtcataaggggtgtcatggagaacacatgtggatgctacttgccagttacttgatctaggccttgactcttggttttctgttgctcggataagttagcatgatttgacatgcagttaaaggtgtggtaacctgtgattgatttcccattcttgatgctccctgcctggacttctcggaaaatttcaaaacaattcattcttctatgagggctgcctccttggttgcttcggct

SEQ ID NO: 6468 - DNA, 1009 bp, mus musculus; identical to SEQ ID NO: 6467

SEQ ID NO: 6469 - DNA, 1009 bp, mus musculus; identical to SEQ ID NO: 6467

SEQ ID NO: 6470 - DNA, 1009 bp, mus musculus; identical to SEQ ID NO: 6467

SEQ ID NO: 6471 - DNA, 851 bp, mus musculus
ccttctatacctatcagaaccttcatcagagccttctatacccaccaccattgaagagtaggcccctaccatgccgagagtaacaaatgacctcctgaggagtttaaactccatcattagccttcaatacagaaactgtgcactgatgtttcagctcacccttccagcaacccacaagtaaaagtggggatcttatactctcatcagcaggggtcaacaaggtatcatagagtgggactaaacagcttctgtagatctcattatttccatgaacgagtgtcaacaaaggaatccagacacctgttctttcctttaccccaacatccaaagcttcaccactatcatcttccttgaatccacagtgacttataaatattattacaccttttcttccttttaatgttaatcatctctcatcttttacactaattttcacaaaggtcaactatcctctgttctactccttttctccattctttcaaaaattctgaaagctttttcacgatttcatctagatattatggctcatcattatcaaatgttatgtatgctcttctctgattacaatatgctcttcctctgtaattatttcaccttcttgctctaacagaattctgagtgttctgactactccaccttctttgcagccctcttaagtggtaacttttatattctacccaagggcatgtgttgaggaaatgtccttattattcctccttgctgttttcaaaccattctccttccctcctccctaaaatcctctgtctttgaatatcatctcattagattgtatcctcaacatgattatcatctaagagggtccttgtctcattctcactgattccttgatg

SEQ ID NO: 6472 - DNA, 568 bp, mus musculus
acacatagcagcagctcaggaaagatttgtagattgaaaacatgaatgattctattttaacccatcgggcaatgtttgggatagagtgagtcttatgctccagaactcaagttaggccatatgactagaaagctttctgtatctaaaagtatgtttccaataatgaatggatgaaatcaaatttaaaagttgtttttctttttatatggcattatagtcattttgatgtgacactgacatcgttcttgttatgttgtttcccttttataacacaatttgaataattttaggacaactctgtaagatttgcaacaattgaaggcaaagccagaaaatgttatttcaagagtcttatgatttgcaatcctcaccagaactgtgtaattttgttgtctcttgtggtacaggcatgaggtggaacgtgtagtccaccctaggaagaggaagaggagcaaacatttaaacatgcagacacgttaacattgaactggctatttcttttattgatatcaacacactttggctgccccaacattcagcgatactcaggatagtcacagaattaaag

SEQ ID NO: 6473 - DNA, 559 bp, mus musculus
gctatggtacgatatgaaggacacttcacttctgtggtattttcccccaaaatctgtaagcccagtctcatcatgagaaaacaccaagacatgcaaatgaaggacattttacaaaatacctgacaagtactcttcaactgtgtcaaggaaagactgggaaactgtcacagaatggaggaggctaaggagacacggcgagtcattgtaacatggatggtgggttgggtcctggaacagaaaagggacataagtggcaaagctggaaaaatatgaatgaagtctctggttaacagtgtcgtagtactgttcattttgcagttttgataaatgtgccatgttatgtgaaatgttgctgttagggaaaccggatgaaggatgtaaaggaactctcagtctgaagtcatttcaaaattgaaagttaaaaagttcagtgaaggatgaagaacaaatacattttttcttatggttcatgtgaatgggtagaatatcaaaataaccaagtttagtaatgttctacaagtaaaacttgcctatttttcatagtagactccacacaatt

SEQ ID NO: 6474 - DNA, 1436 bp, mus musculus
cttttgataaactagctggcttgattctgtagttcttttgatgagaagtcagccagtgtcacatttcctaatcatggactagctgccacacggtacttacaccatgcctcagatttctggatcagtggcagttttctctaagggaaaagccacagggtagcacagtgggcctagaggagccaactgcagagtgctcagtgggcactttaaacagggtggtgcagacagtggctctgagcacctgtctgtagatcgctgttcaaatgcacgcacgctctgttaaactctcactgtgtacaaataggatatatttatagggtttaattcagcatggctctaccttacatactgtttgaaatgctaaaaagcagataaaggccaggcagggtggctcacacctgtaatcccagccctttgggaggcgaggtgggtggatcacctgaggtcaggagttggggaccagcctggccaacatggcaaaaccccatatctactaaaaatacatagctgggtgtggtggcgctcacctgcagtcccagctactggggaggctgaggcaggagaatcacttgaacgcaggagaatcacttgaacccaggaggtggaggttgcagtgagctgaactcctgctactgcacgcctgggcaacagagcaagactctgtcttaaaaaaaaaaaaattaggaaatgatccttcatatgatactcagattcactagaagattcttttcattgttttttctaccacattttacatggttctatttacagaaacctaatgtgcatacatttcttatacacatctgttgcatgacactttccacactatccatcccataatcatgaatagacctattcagaggcctaggcactgcaagtcctcaatggaggtttttcctgtaccattgccctcttcttgcataaaagggtgggtattttatgaatatcaccagtaaaaagcttcttcagacatttaattatctgtgatggtgccattgaggcactggtgccaagtttagaaggttcaaaagtgagttagtcgaaaagttctgacagtacccttagctaacagacagcagcaggctgccctcaagaacccatctcccttgtgcgagcaggccagctttccccaagcagacacgtctctgtctctggcaatttgcattttgtttacagaaggagactggatgagtccagacgtattgcttatcctgatctggtttaatggcagtgtttttgtaagcagttcctttttctaattttcttccagtgacaggagcatctggtgtccctgagaacagcccaccttgtaccgtgaacatccctattgcaccgatccacagctcggctcaggctatgtcccccacgcagagcatagggctggtgcagtccctactggccaatcagaatgtgcagctagatgtcctgaccaacca

SEQ ID NO: 6475 - DNA, 2567 bp, mus musculus
ctgctagcagctactggagaccctgagatcccggtcatcatgttgcccatttggggaagtcagagattgtgctgtcttcttgatgatctggtttagatttgctttttcatggctttttaaaagaggactcgattggccgggcacggtggctcacgcctgtaatcccagcactttgggagcctgaggcgggcggatcatgaggtcaggagatcgagaccatcctggctaacacagtgaaaccccgtctctactaaaaatacaaaaaattagccgggcgtggtggcgggcgcctgtagtcctagctactcgggaggctgaggcaggagaatggcatgaacccgggaggcggggcttgcagtgagccgagatcgcaccactgcactccagcctgggagacagagcgagactccgtctcaaaaaaaaaaaagaggactcgattaaaagtgcacctgtatagcatctaaagatcagagatgccaaatattaacacctttgttaatttgtaggaaacttaaacctaggttttaagcaattcaactctaggtgctcatataactattaactattgttgttactcataagtgcttagtgagcctgcttcctctgccctaaagttccctatgaccatgggaggtgggaaggtggggcatgggaggtttatctgtgataatacatgtgtgcatgtacagaactacctttttggtgtttttcaaagaataaggaatcaattttgctcgaacctagctcccaaaactcactgtagaagagaaataactgtctcatggagattgcattgcagttttccaaggatgaaagatactaaccacagttaaatctcaactccattatgaagtgaataccttttgccactcctttcagaagaaaatggaagcagtgagaggttgaaatgatttctggattccatagacaaaaaccaatcctgaaacagaatccaagatttctgggtcacattaatgaatagacctggtttattcccagcttctcactctggtgtgtcgtaaagatttgcctgtaatgagctctgagctacttatacttagtcatctcccatgaaaacaagtattacatacagatgggccacccctgcccctcatcaggtgagctcatccgctttatagaatgagatttaagtccttgttattgaattctggaaagagtgaacgttcggctgaccagttttattattcacccaggcttcacaaaggagccagtctgtgtggatttgtttccctacacttcctagaaacagctgctctatgtgctgaagaataagaagccatccattggaagtgctggctcatttcttgaacccatttcagagttcctgtctgagcgatcgcttcaagtaaagaaggcgccccagagtaagtcataggaatttttttttttttttttttgagatggagtttcactcttgtcgcctaggctggagtacaatggcatgatctcagctcactgcaacttctgcctcccaggttgaagcgattctcctgccttagcctcccgagtagctgggattacaggcacgcaccaccatgcccagctaatttttgtatttttagtagagatggggttttactatgttggccaggctggtcttgaacgcctgacctcaggtggttcacccgtcttggcctcccaaagtgctgggattacaggcgtgagccaccgcacccaccaccatgcccggcagtcataggaatttcttaagcttcaaccaccactcaggacagcatgcagacaccttgcaaagcatcttgctctttgtcctctgacctgcccatgcgttcttccaggtcactgttatgaatcccagcatcccatttgccacttagctctggctggctcccaggctctcccctgcacccagtgatggtgcagcatcctcactgcaggcacagctacgggatagctcttgtcccgggaaagagcggggagcttggatgataaaggcaaccagtcacattgccttctcccagttgtgacagccatttcccattgtcttcaaccctgagggtatggacaacctagtgcttcctctctccactcttctccaaaagtagaaaagtgcccagacctgacaccatttcccttctgtcctgggaaccaagggtctctatgtctcctgttggttcatcctccagctcatgtgaatgatctgtggttcctcctttcacatgaatcaactcagtgtctcctgtgtcaccttgaaccactaatcagaatcttgcactttcacccagtaacaggggcatttccttttatttcagtgtctggggtcactgaaacaggggcttgaccagtgttatattttctttctctccccagtaaaaaggcaggcagtccagacaccacagcatgtgcatgccacacgcatgcgcccccccaacccctatgatgagaagacacaccctcgagtgatgaacttctttctgtgctggagcccatggggtcctctgagtcccacttcctgccttcctcaggtacctgcttctgactgcagaaggctcttccgtcccaggattgtggtttctcaccagtttctc

SEQ ID NO: 6476 - DNA, 1382 bp, mus musculus
ccagtctgcaaagataagaattggtaaattggaggaagggaaagtgtgcttcatttagtgatctgttgccgcccgaagtgtggcgttctgcctgcatcagctgcttgtccttgtgcgggatggtggggaggtgacatttaggaaatgtgtccacccaggaacacttggtatttttcagagtaactgtgcatggaaggacacaggcgcgtgcacatgtgagggggtgctctgctggagcgaagggcgtgggcgctagagccacagggagctggagggaagggcgtgggcgctagagccacagggagctggagggaggggcgtgggcgctagagccacagggagctggagggaagggcgtgggcgctagagccacagggagctggagggaagggcgtgggcgctagagccacagggagctgcaggttgtggtgcttacgcccagcccagggcctccaggatctcagggctcccgcagtgagcttcataaatgaaagtagaaagctgttatttgtgtctgggcagccagaaacacttgcttcttctcaaaggctctctgatgccctgagattctcctgccacactctggagtccaaagagctatttattactcagggccccaagtatgttcttaaaaagagggaagatggtccctaggcaaggaaacccacattgcctagaaaactgttggcttatatcagattatacgaaaacaatcaacaacaaaaccctggcctaaaaattatgttatataatgttttaaagcagtttaaagaaacttattccatgggcctaacacaccttcttcagggaggtgtttgaaaagaaacgcatcctctgacctttgttacaagactcctacattctcttggcttttcatgggcaagccctggcaccatcttggaagctgctgccatctgtagcagttgcgctgccgggaacatgaggctcctgtcacacccacagatgtggcctgtgtcctgggtgggttcgtctgagtgctggctctctggagcaggcccagtggaagtgggccttgttttcctcgccgtggtggtgagagggtgggtcctctttccttttgcagggattacgttccttctcctttcctgctcctgtgaggacagctcggaacctgtcttagctgtggcttctctgcagaaagtaacaaccttgtcttggttgtcactgatggcctccaggacacagtaggcaattcagccagggcttaaggcagcgactcttagtggggcacctagaccattgattagagaagacaacctggtatgccggcaaggtgtgagcaaaggctgcaggcaaggtgtgagcaaaggcagtaactggaggcctgatttggtttgcagtgcctgtttgcgcattccctc

SEQ ID NO: 6477 - DNA, 1262 bp, mus musculus
acaccggagagcagagccttctcggtgctaaacacgctggtctagtccagtccctttgctttacgtaaggtcccagctaaagtcacttaggtgcttttgagaaaaatgatcccgattcctgctgtgctgtcctgtgctctgagccttgactgtaagaggggagctctggcgctgagaggacaggaaaggggtggggggatggcgtgggccggagccatcgaggagcggggactgcgtctaaagacactgtccaccccgcggcctggcccttgtcagaacccacgggcctgccctccccatcacagctccatcttcagaaaagggctttggcttgctgtgacattacagaattgtgcacttttagaccttaggtcctgtagggcatttaattcaagcccctcgtgtcacagataagaaaacagaggtcgggaatggttgatggttaagacggcgcgtggattcccagggcctagcctgggtcctttcttggacacctgccaccttcccacatgcaggggcagggtggggagccagcccctcgcccccaggggcgagagagacagatagtggccaccgcagtctgagcacccactgtgcctggacaggtccctggtgggaggggtttgggctctgctccgctgatttgcaaggcctggggtgtcgtccacctcaggggagctgcctgtgctcgcagcgggactgagcagatggtcccggctgggagcccattgttctgcttcctggagggaccttcagggttgaagtcccttctaaaaacctgtggctttcctgcctgtggtggtgctgggaggagaaggtcacagaggccctgttccgactcaagtgctgccttgtgtcctcctagggaatgaaggtcttcttcatggtggtggcagcggtgtacattctgtacctcttgttcttgatagtgcgggcgtgttccgagctacgtcacatgccttatgtgggtaagtgctcctttcagaatcggtgcaggggtggcttgggagtgactcaggtgggggaagaagtggttggagtctcccaagccaggggccttccttgagggcccagggactggtccattcccacaggctggggaccagggcacgtggtccctgggagccacaacaggccttacaggttactctggcatttgggaccatcagagtggcctgggtcctgcgggactgtaccctgcagagcagggcgagtcaccctgagcttgcgggatcctttcctgaatctgtccccaccagagg

SEQ ID NO: 6478 - DNA, 519 bp, mus musculus
ttatttcaaagctttctaagtgcacttgtaaactttcttccattaaaaactataatacagtctgggcgtggtggctcacgcctgtcatcccagcactttgggaggttgaggcgggcggatcacctgaggtcaggagtttgagaccagcctggccaacatagtgaaaccctgtctctactaaaaatacaaaaattagccgggcggtggcaggtgcctgtaatcccagctactcaggaggttgagacaggagaatcccttgaacctgggaggtggagtttgcagtgagctgagatcgcgccactgcactccagcctgggcaatagagcaagcctctgtctcaaaccaacaacaaaaaaacgaaaacaaaaactataatacagtgagaaaagtgaaattttatttgatgatgaaagatctttcagtgatttgagacatccttttgaatattaacaaagtgacatagacatagtgataacaaagttgtatttcaaagggtactaattctagggtagatcctga

SEQ ID NO: 6479 - DNA, 519 bp, mus musculus; identical to SEQ ID NO: 6478

SEQ ID NO: 6480 - DNA, 2145 bp, mus musculus
gtaaaggcttctagggaaataattattccaccttcccaccaggactaacccagcctggagtgaacgcttcgggtatgagagagagccaaccttagaatgggaaagcccgcattctagttcagctgaggtgccttggctgggcaggtgccaccagctgttgcttgcagtgttgatgtgactgccctggtaggctggacagaactggtgtcccttctctgctgctgtggactccactcaggctgtccccagacagactgtcctttaggcgagggtgtgaggtcagcccccctctcctgctggaacttgcacacagcctcttgagagttcacgtcctgcctcccgctccagcccagtgcgcccctctgtaaaatgaagatgataatacctgttctgcgcacagcacaaggttttgtaaacatctaatgagataatgtagtatcttgatttgctatctaagtcatctaaatattttatctaaattgccagcattgactatgatgtgctggactctgtactaatagcttaactaggctatctcattttatcttcataaccaccatctagggtaggtattgcatgcagcctcattttacatgtaaagaaatggaggtttagattaagtcacctgccaaaggttgtatagccaaaagaggactgaactctgaggcagtgattcccagctcttatgagtatagggggtcactggggctcttaaaatgcagattccaaatcagtagctgcggggtggacgtgagatgaggaaccgcagatgcatttttggtgaactcctgggatctggcgaagtctatgctgtgaagttctcagaccacacttcaggagcgaggtgtctagacagtttgaaatgtatttggcaggtgtttgaaattctataacacaagtgtcagctcctgtcagcttcccggggtctacagaagctccctccgaactccctccggggatcactccttctagtgaaacaggtggaggggagggttagcaaccatatgaagccctgtgtgccacacgtggtggcagcattgcttcttacctacttcatcacatttaattctcacaaaaataccgtggtagacattgttactcccatgataaagatcggccgagcctggtggctcatgccggtaatcccagcactttgggaagccgaggtgggcagattgcttgagccaaggagttggagaccagcctgggcaacatgagaaaaccctgtctctacaaaaatacaaatattagccgggtgtggtgtcacatgtctataatcccagctactagggagactgaggtgggaggatcgcttgagcccaggaggtcaaggctgcagtgagccatggttgcaccactgcactccagcctgggtgacagagtgaaaccctgtctcaaataataataaattaaaaattttaaaaattggccgggcaccatggctcatgcctgtaatcccagcactctgggaggctgaagtgggtggatcacctgagttcaggcgttcgagagcagcctagccaacatggtaaaaccccgtctctactaaaaatacacaaattagccaggctcatggcgggtgcctgtaatcccaactactcaggaggccgaggcaggagaatctttgcttgaacctaggaggcagagattgcagtaagccgggatcgtactgttatacgctccagcctgggtgacaagagtgaaactttgtctcaaaaaaaaaaaaaaaaaaagcctgagttttagtgagaggttgaccaacgtgcctaatgtcacatagtgaatgagagatggagccaggagcagacctgggatttgactctgaattctaaactctatgttcccataagaaggacaaatgaggaccgctgaagaaagagggttcaggaaggggcgtgtggaagcatgagtaattatcttacttgcttgagtcacaggaaaccactcagaggctaacactgacttggggttaaccagatgcctggcattgttctcagcgtaatgcccttcagaggtatttagcctttgtaatccttaagacagccctatgaagttggtactgttcctgtccctactaaagacagggacactggggcaaagagatgaccaagagctaggtgaagcctgctccagagaccaaccaca

SEQ ID NO: 6481 - DNA, 3529 bp, mus musculus
gtctcctcttccttccttctccttcaactgcattctcattgacctgagaatttctctactctttcaatttctgaggtctcattcatttttcagtgttcagttctcagatgatgtcccaaaacccatccagtttctcaggccctgactcttctttgccaccccgacagcttatatctacaccccagaagctgattctccacggctggagctgaccagattccagatcacagtcgccacactcccaacctgctaactggctgctcctctctcttccctgttcctatgacaagcatcgatattcttcagtctcccacgggctctactcctaagcagggaggccctcaagggctattcctgcattgttctgtactagagtgtgagcttcatgtgggcaaggctcaggtctgttgtgatcaatgctgtcagcccagggtctagagcagtagtgcccaggatggaacaaacatgcagcgtgaatttttgtacaaatgacatgaacagctccatctattcatgacataccacatacctttgctttgccacatgaattttaaaaatatattaaagtagaaaattatctcaatagatgcagaaaaagccttcgataaaattcaacaccctttcatgctaaaaacgctcaataaaccaggtactgatggaacgtatctcaaaataataagagctatttatgacaaacacgcagccaatatcatactgaatgggcaaaacctggaagcagtccctttgaaaaccagcacaagacaaggatgccctctctcaccactcctattcaacatagtgttggaagttctggccagggcaatcaggcaagataaataaataaagggtattcaaataggaagagaggaagtcaaattatctctgtttgcagatgacacaattgtatatttagaaaaccccattgtctcagcccaaaaactccttaagctgataagcaatttcagcaaagtctcaggatacaaaataaatgtgcaaaaatcataagcattcctatacaccaataatagagagtcaaatcatgagtgaactcccatttacgattgctacaaagagaataaaatacttaggaataaaacttaaagtgatgtgaaggacctcttcaaggaaaactacaaaccattgttcaaggaaataagagaggacacaaacaaatggaaaaaaattccatgctcatggataggaagaatcaatatcgtaaaaatgactatactgcccaaagtaatttatagattcaacgctatttccatcaagctacaattgactttcttcacagaattagaaaaaactacgttaaatttcatatggaaccaaaaaagagcccatatagccaagcaaaaagaacaaagctggcggcatcatgccacctgacttcaaactatactacaaggctacagtaaaaaaacagcttggtactggtaccaaaacagatatatagaccaatggaacagaacagaggcctcagaaataacaccacacatctacaaccatctgatctttgacaaacctgacaaaaacaagcaatgggtaaaggattccctatttaataaatggtgttgggaaaactggctagccatatgcagaaaactgaaactggacctcttccttacaccttatacaaaaattaactcaagatggactaaagatttaaatgtaaggcctaaaaccataaaaaccctagaagaaaacctaggcaataccattcaggacataggcatgggcaaagacttcatgactaaaacaccaaaagcattggcaacaaaagccaaaatagacaaatggaatataattaaactaaagagcttctgcacagtaaaagaaactatcatcagagtgaacaggcaacctacagaatgggagaacatttttgtaatctatccatttgacaaagggctaatatccagaatctacagggaacttaaacaaatttacaagaaaaaaacaaccccatcaaaaagtgggcgaaggatatgaacagacacttttcaaaagaagacatttatgcagccaacaaacattaaaaaaaaagctcatcatcactggtcattagagaaatgcaaatcaaaaccacaatgagataccatctcatgccagttagaatggcgatcattaaaatgtctggaaacaacagatgctggagaggatgtggagaaataggaacacttttacactgttggtgggagtgtaaattagttcaaacattgtggaagacagtgtggcaattcttcaaggatctagaactagaaataccatttgactcagcaatcccattactggttatacacccaaaggattataaattattctaatataaagatacatgcacacgtatgtttattgcagcgctattcacaacagcaaagacttggaaacaacccaaatgcctatcaatgatagactggataaagaaaatatgccacatatacaccatggaatactatgcagccataaaaaagaatgagttcatgtcctttgcagggatatggatgaaggtggaaaccatcattctcagcaaactaacacaggaacagaaaaccaaacaccacatgttctcactcataagtgggagttgaacaatgagaacaatgagggcatggggtggtgaacatcacacactggggcctgtcagcgagtggaggcaaggagaggggtagcgttaggagaaataagcaatgtagatgacgggttgatgggtgcagcaaaccacaatggcacatgtatacctatgtgacaaacctgtacgttctgcatatgtatcccagaacttaagtataattaaaaaaaagaaaaaagaaaataataaccaatatttgtggatcactgttttctgcatttgatacttatctgctttatttcttacaaaaaccttatgatgaggcagagggaacatattgttaaatttccactttagaaatgttaaactgagactcgatgggcaagtaatgagtctaatttcttcacctgaatttggtttcatcttctcttaacttcttacagactttgcttcatctagaatctcctattggctttgtctcatgtgactgtcccctgctttcaactcccactctctcaatggcttactctctcttgcctaacaattggaatattgtactaattaacctcctatttcttttttctttttttctcttttttttttttttttttttttttgagacagggtcttgctttgtcacccaggttggagtacagtggcttgatctcggtgcactgcaacctctgcctcccaggcttaagtgatcctcctgtctcagcctcccgagtagctgggaccacaggctagtgccaccatgccctgattcttgtatttttttgcagagacaggggtctcactatgttgcccaggctggtctcgaactcctgggctcaagcaatccacccatgttgggattacaagcatgagctaccatgcctggccctatttccattcttaacaaaattctattttatacttctaccagaattaccttcaaaaaatacaaatttgatgtca

SEQ ID NO: 6482 - DNA, 825 bp, mus musculus
gaaactcttatgaacacaaacataagctactttagttattgggataatcaagaagctgccatacagaagagttgattaggagagagaaaggattttaaggtccaagaacaagtgaaagggtgagattcatgctattgactagagacagctacataccacaagaaaggtttctcaggtcatttttggaattgccttgccattcctctaagagttatgactccatattcaagagtttctactttaggcccttcagccaggccgatgggaaccttgcccagaagattgtcggggtgttatttgttttcatgcctgtccaggtcacagcatgacacagaaaaccttgccaacttttaattgtgttatgtagctaaataaatagggaagccgttctggaggggctctcaagatttacctgatgccccagctgcttgaccaagtggagccaacagcttgaaaagcgctgcagccacgactggcctgaccttgatcttccttagactggctgttaatccccaacttgtggctgggtctggaaagcagtgtgtgtaatagattgcatgtcatcttgtatgcttctagggcacagacattggcatacagtattttctgaataacttctgaaggacttcagcgaaggtagtagcattcggaggtggaaaagttccttagctttcagattctgcgttgatatatcattagctgaaacaatattgcaaacatcactattgccttaagggagagagaagagtcacttagtttcctgcaatttctgagatgcttcttttaatattgtaaaactcttgctaatatgctctttcaacaatg

SEQ ID NO: 6483 - DNA, 452 bp, mus musculus
agaattgagcttttatttctatatgagctaaagacaattgaagagactcttggagaaaatcttaggaattcttgaattaatttgccttgaagaaaattttgtcccaatttcagagatcctttaaatatgttttaccaagtttgatgcgggcttttaaaatttaattgtattaatttttgtgtttattttaggtaaatgagagatatcttgacattctatccctagagagatacatatttgtgtatctttaaaagttaacacttccttacatagtgacattacactgagcaagatggattaatcctacagataacgtaataaccagtccatattcagatttctgtagtggatcccctgatattctttatagctggattgttcaaaccagaatcttactcaatactgctcattaaatctggttgttacgcctttttaaatctagaaccatctct

SEQ ID NO: 6484 - DNA, 1615 bp, mus musculus
tctcctaagagaaaatcaactctgtaatgtggttccagaccgagacgggaatcacagcgtgtccccttgagctgacagcattgtgagggggagtgtggggagtcaggaagggttcaccattaggctaggaggggtgggttgttctcctgagaatggggctgcaatgtttttggaaataagtgggccccttgggcttgtctccttggttttgtccaggctcagtggagcactgttggctgggaggaaacatggccttcgatgttgcccacttggcagtttccaccattgttgactcacttaggctgatggcagctgcctctgctgggaaggaagcgtttttcccacaacatattaaatgcggcactggaggatggctggctggtccaggggccggatctggctctgttgctcacaatgattctgtttggcaagcgtttttaaaaagccttggtaagttccagatggtgaccacttgcctcatttatcctccatttgaaaaatttcaaaaactattcatttgtttgcataccaaggcagtacagaatcttctacagtggcacttcgatggtaagaattggggtttttttcctgtgattctttcctccgtgttgtggtttatttagcagtgattggcttctttgtctgcttttagaattgggtatatgtttggatcagctgtatgcattaggacccattgtatgcattagtatcagctgaatacattagggtcagtcatatgtattaggaccagctatatgcattatggtcagctatatgcctcaaggtctgctatctgcatcagggtcagctatatgcaccagttatgtgcattgaaaacagttatatgcgttacagtcagctctgtgcatcaaagtcagctgtatgcatcagggtcaggtacatgcatcagggtcagctccatgcatcagggtcagctccatgcatcaaggtcagatatatgcatcagggttggctgtgtgcgtcaaagtcagctatatgcatcaggttcaggtatatgcatcagggttagtatatgcattaaggtcagctatatgcatcaggtcagctatatgcattgggatcagctatatgtatcaggtcggctaaatgcatcaggatgagctatatgcatcaggatcagttatatgtaccagggtcagctatatatgcatcaggtcagctatacgtgtcagggtcaactatatgcataggctcagctatatgcatcagcgtcagctatatgcatcagggtcggctatatgcatcaggtcagctatatgcatcaggtcagctatatgcattagggtcagctatatgcatcagggtcagctatatgcatcgggtcaactatatgcatggggtcagctatatgcatcaggtcagctgtacaccttagggccatttatgcacatgaaggccagtgatctgcatgtccctgctctttaatctggcagctcttccccagccaatgatctatcaatgcctacctgaaaagtgacaccttctgtggggcaatttataatccctgctgctttgctcgatagtttgaaacaaagctacatataggacttatttgcatgaaacacataatgtgggtggcccaactttgggtatt

SEQ ID NO: 6485 - DNA, 718 bp, mus musculus
cagcagctctgagccagcccggtgctaggtgatgggcaactgcagtgcccatgccacaggctgggtcagattttcttgtggggacgcggtcatggggatgttgctagggacagtgaagttggctgtgtttatccaaatctggtaggaatggatccttctaagaaaatatgctttcgacttcatgattttccagcagcactgaaggccctgcacacatggggctgctagctggggcatgggacacatagggtgtcgcggcatccagccccacacagtggtcactccgggtcccgtgggcagcctgacccaacctaagtggttgtaatgtttctgacggccttcacagcaatgttgtattattccatcacatgtatggaacgtgtccagaatgctggggcaagagaaataatattccctgcctaggtatccactctgcttttctcagaagcaaacaaacacatctgaggagagaaaaagcacaaccccatgtttgatccttccccgtgtccagccacttcctacaccatcctcaaatctgacctgcactcgaggactcctgcgtgctttacaagcatcttgttttagttcttttgtttttctgcaccaaccacgtctttaccagtttaccgaatgcccgccacatgtgaggctgtagactgaattcatttcttggtgaatgctattgtgtgcctggccatgagttttgtcctccaaacag

SEQ ID NO: 6486 - DNA, 1064 bp, mus musculus
agtacaagtgaaaccatcagctatggaatgagcaggttgtctcaaatcccctttcaagtttaagtgtggggaccacatctgaccagtgtgtaaaatcaagccccatgcagaaggatcccagcaagcgtcctttatgtatgaaaaggaagaagaaaatttccccatgaaacatattcaaagtagagaacaatctttttgattccattgttattttaattgtatacagacataggagtctttgcataattagacttttccttctttcaggactgtggatgcaaagccctggacccccagacgttataggacattactcctcagctttgcagcccggtgatgtgaagcgaaacaccatttccccttttttatggcggaagaaaacagaacacaactgcaaaggggcttttccctcccctgctcatcctctttccccaaatgaattttggtttgctgtggactctattctgctgaggaactgttcttgttgggcaaatgtagatcttgtctactctgtggcaggaaaaggccttttctttcattttgtaagaaagagcacagagttcctcctgtacctgctccagctgtgcctgcagcccctcacggccgggtgatgccattcccaaactgctcagcccccagcactgtggtggccacagctgtgggtgtcttgctggggctggagtgtgggctgggtctgctgggcaacgcggtggcgctgtggaccttcctgttccgggtcagggtgtggaagccgtacgctgtctacctgctcaacctggccctggctgacctgctgttggctgcgtgcctgcctttcctggccgccttctacctgagcctccaggcttggcatctgggccgtgtgggctgctgggccctgcacttcctgctggacctcagccgcagcgtggggatggccttcctggccgccgtggctttggaccggtacctccgtgtggtccaccctcggcttaaggtcaacctgctgtctcctcaggcggccctgggggtctcgggcctcgtctggctcctgatggtcgccctcacctgcccgggcttgctca

SEQ ID NO: 6487 - DNA, 956 bp, mus musculus
agtacaagtgaaaccatcagctatggaatgagcaggttgtctcaaatcccctttcaagtttaagtgtggggaccacatctgaccagtgtgtaaaatcaagccccatgcagaaggatcccagcaagcgtcctttatgtatgaaaaggaagaagaaaatttccccatgaaacatattcaaagtagagaacaatctttttgattccattgttattttaattgtatacagacataggagtctttgcataattagacttttccttctttcaggactgtggatgcaaagccctggacccccagacgttataggacattactcctcagctttgcagcccggtgatgtgaagcgaaacaccatttccccttttttatggcggaagaaaacagaacacaactgcaaaggggcttttccctcccctgctcatcctctttccccaaatgaattttggtttgctgtggactctattctgctgaggaactgttcttgttgggcaaatgtagatcttgtctactctgtggcaggaaaaggccttttctttcattttgtaagaaagagcacagagttcctcctgtacctgctccagctgtgcctgcagcccctcacggccgggtgatgccattcccaaactgctcagcccccagcactgtggtggccacagctgtgggtgtcttgctggggctggagtgtgggctgggtctgctgggcaacgcggtggcgctgtggaccttcctgttccgggtcagggtgtggaagccgtacgctgtctacctgctcaacctggccctggctgacctgctgttggctgcgtgcctgcctttcctggccgccttctacctgagcctccaggcttggcatctgggccgtgtgggctgctgggccctgcacttcctgctggacctcagccgcagcgtggggatggccttcctggccgccgtggctttggaccggtacctccgtg

SEQ ID NO: 6488 - DNA, 1179 bp, mus musculus
gtatcaacgtccaagtccggtgaatgactggaataaagactccctttaataagggatgctaatttaaattgaaactgtttctgtctttctgtacaggaaaaagtaatttttttcaaaaataaaccaaactggccgggtgcggtgtctcacccctgtaatcccaccactttgggaggatgaaccagacagatcacttaagctcaggagttcaagaccagcctggccaacatggtaaaacctcatctctactaaaaatacaaaaattagccaggcgtgatggcacatgcctgtagtctcagctacgagggaggctgaagctggaggatcacatgaacctgggaggcagaggttgcagtgagctgagatcacgtcattgcactgcagcctgggcgacagagcaagactctgtctcacaaaaaaaatgttggggaaaatattttcatatacttgagaagctcctgtggactttatactcgcaatcgtcatgcgtgagtggcattttagtgccgcgttcctgcactcctggcaggctggctctccatgcagcacagcacacacacaaggtctctgttctctattttttgaaaaaactggaaattttatgtagctttggctacatctcaagaacagctctcttcatttttgtttttctaagtagcaagttagatttctaatcctattctccccaaatgtatgctttcctttaagaacatatgtggaccacgtatgttcttaattaacgacaccgaataaaacccaatgcactttgtcctcacctttcagtcatcactgctcaatttaaagactggtccttacagtctcccacttagaagcaggtcagaagacttcaccatttgagcccctccttcctgggccagaattgaggatccctggctcactgtcccactgggctccagccatcccctggcctctgcaaggggagatctgtgccaggcactcctctctgcttattccctcagacagctaatgaaagatgggtgcagttgccatggcaacccttccccgccaatgcgctgccatgaagatacagaatgtctagtctaaaaatactcttttgctctgttggctgttttcagggtgataaactcagaaaatctcacttcttcagtgccctattcacttaacctgtcttctctgactaaacaagattgctggact

SEQ ID NO: 6489 - DNA, 9500 bp, mus musculus
acccctgtacccctccctccctgcactttggtgtgttggttcattcatttattccacaaacatgagggcaccctgtccaggaacacagattaaaaggacacccgtggcctcatatttcagccagcgaggcagccaatggacatttcccaaatcacacaggccccaggaccaaaaagggcagtgagggagagcgtttggggtggaggctcagccagagacccaggagggcagcgtgggcattcccgtgatcccttctgcagtgcacaacactgcagcatgagctcgatagcgcctgactgggcaagcctgcagctcagctccttgtccagccggacccagtcgctccccgggtgtgctgggagaacacagggtgaggtcatggtgcaccagtgcccttcctgttcctgcacaagttggctttctaagagctactcagtacaaatgagtgtcattttctctttattttcattattttattttattaactgaaaaatattaattgtatatattcattgggtactagtgaagttttgttatgtataatgtataacgatctgatcagagtaattagcatatctattgtctcaaatatttatcatttcctgtggtgaggatgttcaatatcctccttccagctatttgaaactattatatattacactgctgttaagcctggtcactctgcagtggcatagaacactaggactccttcctcctgtgtggatgtgactttgtgtgctttaacaaatgtctccctatgtcccctcctcctaaccttcccagcctctagaaacctctgttgtacgttttacttcaattagatccactgtttttttagctttcacctatgagtaagaacatgcggtgtttaactttctgttcttggcttatttcattttatgtaatgttctccagttccatccatgatggcatgaatgacaggatttcattctgttttgtggctgaatagtgttaaagtgaagtaaatatggccagagaagggctccgtacttttatatttgagtccttctggataggtagacaagattgaaaccccaacttaggagtatgcacctgtaacaatcgctgagtcctggccaatccccgcagctgtacttcaaccactcatacactggcgagtgctcaaactgtgttcaaataaggcaaacagcaacctgtaaccaatccagctgttgctgtacctcactcccgatttctatacgccgctttacttttacgtctgtaaatttgttctgacgacgaggcacccctgcagtctctctgaatctgctgtgactctgggggctgtatgattcgtgaatcattcgttgctcaactaaactcctttaaatttaatttggctgaagtttttttttaacaatagtattccattgctaaaagaaaaaccttagataaattaaatgtaacagagtttaactaagaaggaactcttcacgaatttggcagtcaccaaaccagaacaggttcaaagaccccacactgcgtccgggtgggtgagaattcatggagagaaaaaggaaagtgaggcacggaaaatggaagtgaagtacagaacctcctgtttgttacagcacggggtttgccttttttgaacacagtttcagcagttggctgcctgtggtcggctgattagtagtgtgctaatcactacttggtgattagtacaacagtaagttacagtttgtttaccctcccgttagctgacagctcactgtgtatgaaggaacctttagacccaacttataaggaggcaatgttaggcgaaattcaatttaatatgaactttaaagtagttttttccaattctgtgaagaaagtcattggtagcttgatggggatggcattgaatctataaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgacactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcattgtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatgtggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttgttagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatatagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgggattcttaatcctgagttctagtctgattgcactgtggtctgagagatagtttgttataatttctcttcttttacatttgctgaggagagctttacttccaactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttgactttcaagtcaaccctaagccaaaagaacaaagctggaggaatcacactacctgacttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccctatcaaaaagtgggtgaaggacatgaacagacacttctcaaaagaagacatttatgcagccaaaaaacacatgaaaaaatgctcatcatcactggccatcagagaaatgcaaatcaaaaccactatgagattccatctcacaccagttagaatggcaatcattaaaaagtcaggaaacaacaggtgctggagaggatgcggagaaataggaacacttttacactgttggtgggactgtaaactggttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcatatatacaccatggaatactatgcagccataaaaaatgatgagttcatgtcctttgtagggacatggatgaagctggaaaccatcattctcagtaaactatcgcaagaacaaaaaaccaaacaccacatattctcactcataggtgggaattgaacattgagatcacatggacacaggaaggggaatatcatactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaagaaatggaaaaaaaaaaaaagaaattcaatttaatagagtagagaccacatttcctgtatccatctctccctgaatggacccctgggtagattccggaccttgggtattgtgactgtgccatagtaaacacaggtgccgttgcctcttggatgaactgtttcctttccttcctacagatgtccagtgtgggggcagctgaggatcatgggggttctgcttgtaattttatgaggagcctccatgctgctctctacagtggctgtactggtttccattcccaccaacagtgtatgagagtccttttttctccacatcctcgccagccagcctccttcactgaaagaagaaataataatatatgttatgatataatatatctaattaagtattgtcactatgttctatatttatttagcatattacataagatgttattgttgtatactaatttgtattaggtattaataatatactatttagaatataaattaagcatataaatatataattaaatcaattccctgccatgggtcgtgggtggcattgctcatccccatcctccttctcagcgatggggactttgtccccctcagcacagatcaaggaagaaaatctgcagggagaactgtcctcttaccatagggacgagagtccctccgagacaagacagtggttttgctcgttggctcagctgtcctgttccagaacgggggctcggcctcacccgtgcagaactaaaaattgcactgaagagcttgtggtcttgtttgttccaaacaggcagtctctaccccaaccccacaggcaaactccaccactacagctagggtgacggaacatcctcagtcagctttaaaaacagcatttgcttccttcagaattgggaggtggagccatttaactgaaaagaagcatttcctcccctctgtgtgggccttggggggctcctccccacctctgtcccccgccctgggatgatggccaatcaggccacaccatgacccacaccccagccctcaccctggccctcttcacagccacaggacaaagtgctggctctccctcccatgccaggggctgcagacgtgtcccagccaacttcaacaaaccgcacatgctttccacacacaatcaaaccaaccgctggctgtggtcagcatcttcaagtctgagaaaggcaggatacaagacatctgtggtagttccaaaaggactttgagaagaaaaagttcttgagtatgcattgctctctggaggacactccaatgggaaggcagatgcgtagttgaaatggggtccccaacccggcatggcttgcctgggcagccctgggaaggggcaaagcctcatggactgctccagggagggccggccactcctcttgctgctgtggggagacggaactgaggtttgcagacctgccctgtctcggacggcgctcgctgaccaggcacggtggagcctggggggtccaggccaggccctaaaagcctattccaggggaggcagggctcaggccagggcgcgccaaccttctagagcctggatgcagcgttctcaaggctgggaaaaggtgggggtgccagagactggacaacattcagtctgcagtctggcgcggtgtccccacattggtttgtgaaatggcgactgagcttccacaagattcaagagggagctgtgatcagataacagcgtatttcttggtgataggaaagaagcatttttaactttgtttaatccagtatccatggttattccactctggatttcctcctacacacacatgcacacacacacacaccacacacaacacatacacacagataacacacacaacatacacacaacacacagacatgcaacgcaccacacacacaacacaaaatatacacacaatataagcagcatacacacaatgcacacaacatacacagcacatacaacacacacaacccatgaaacacacaacacacatacataccacgtataacacacaatacacattcacatatacacagcagacatacacagcacatacaacacaccacatgcaatacaacacacactcatacacaacataaaacatacaagcagcacaaacaaaacacacaccacatgcaacacacgacacacatacatgatacatacaacacaatacacaatacacacacaacataaacacacagcacatacaacacacaactcgtgcataccacatgcaacacacaacacacacaacatacacacaacacaagcaacacacacaactcatacaacatacacaacacacagcaaacatacatgctagatgcaacacaacacacatgacacacatgcatgccatatgcaacacacaatacactcacacaacacacaacatacagacaacacataccacatgtgacacacaatacacacaacatgcacagacaacacagaaacaacaaacacactcaacaggcacaacatagtcacacacacacacacacacacactgcttgaaacttattgatagcatggaacaatttgaaagcattactgcaaactaggacaactgaattttaataaccatgatggattgatcaattctgtatgttccttattaaagcaacagtgacaagggagatgctgtgtgttcattgttgatgctgctttgttcacagatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaaggtgggtgggcaagccaggtagttccttccttccttccttccttccttccttccttccttccttctttcctccttcttttttcccctccctcccctcttccttcttctttttctttcctccttctctccttccttcccttcctccttcctgctctccctctttctttctctgcttgcttccctccctccttcctgccctccctccttcctccttttctactctttccttccctcatttcctccttccttccttccctccctccctccttcctttcttgtaaaaccttcacggaaagtacagcatctgtcaaaatttacttcttttatatcaatcagaaattttcaaacactacagaatttccaccaagtaagttatttatatcattatgtgatcaattttgcacgaacaatacaaatcaaaattgccttagcttgaaaattttgatgagcacgttgtctcaggactttgacatatgtacatttttatcaagagtctttgacgttttttaccttttctctagatcttaatgaaacaacacacttcatcatcagttatgatcgtcttaagaattattctgctttccttcttcgaagttcaaaagaatatttcaaatctgccttttatcttttaaaatgtgaggcaaaatctctacattattatttttactgaataggttttaaaaacttaagttgttctttccgactctctttgtcactaataaccacttatttgagtgacccaagcctctatgcaccgaaacccctccagtgggcctgatgggtcaggtgggtgcatggggaaccatggtaggtgcctggccttcttaaatttctcaggccaaaagaactcttactaattttatgacatcattgtttcacacctcttgtaacatacttgaattcatttaactaaatgaaagttgacattcgtgttttgttcttaatcatgctcactttttaggccaacaggacgggccgcagatatgggtctgcagggactcagccctcaaaagtatgatagagtatttgcaaacatttttaacatgttactaacagaatgcaatagcagggcaaaatcggaagaaagagtaaaggggttcccaggacaagatggatttattctaataaagggagcagagatgggtgcattggtgaagagacgtgggtgtccggtgagactgcacagtgggagggtggacacacaggacagctggcagcaccgggtgcacggtttcctcagaaaaatctactaggttatggtcttgaccactctcctaacctttctcaatgatccatttttagaaaaaacctcatttgatggcggaagatgaaccttcaggg

SEQ ID NO: 6490 - DNA, 9553 bp, mus musculus
acccctgtacccctccctccctgcactttggtgtgttggttcattcatttattccacaaacatgagggcaccctgtccaggaacacagattaaaaggacacccgtggcctcatatttcagccagcgaggcagccaatggacatttcccaaatcacacaggccccaggaccaaaaagggcagtgagggagagcgtttggggtggaggctcagccagagacccaggagggcagcgtgggcattcccgtgatcccttctgcagtgcacaacactgcagcatgagctcgatagcgcctgactgggcaagcctgcagctcagctccttgtccagccggacccagtcgctccccgggtgtgctgggagaacacagggtgaggtcatggtgcaccagtgcccttcctgttcctgcacaagttggctttctaagagctactcagtacaaatgagtgtcattttctctttattttcattattttattttattaactgaaaaatattaattgtatatattcattgggtactagtgaagttttgttatgtataatgtataacgatctgatcagagtaattagcatatctattgtctcaaatatttatcatttcctgtggtgaggatgttcaatatcctccttccagctatttgaaactattatatattacactgctgttaagcctggtcactctgcagtggcatagaacactaggactccttcctcctgtgtggatgtgactttgtgtgctttaacaaatgtctccctatgtcccctcctcctaaccttcccagcctctagaaacctctgttgtacgttttacttcaattagatccactgtttttttagctttcacctatgagtaagaacatgcggtgtttaactttctgttcttggcttatttcattttatgtaatgttctccagttccatccatgatggcatgaatgacaggatttcattctgttttgtggctgaatagtgttaaagtgaagtaaatatggccagagaagggctccgtacttttatatttgagtccttctggataggtagacaagattgaaaccccaacttaggagtatgcacctgtaacaatcgctgagtcctggccaatccccgcagctgtacttcaaccactcatacactggcgagtgctcaaactgtgttcaaataaggcaaacagcaacctgtaaccaatccagctgttgctgtacctcactcccgatttctatacgccgctttacttttacgtctgtaaatttgttctgacgacgaggcacccctgcagtctctctgaatctgctgtgactctgggggctgtatgattcgtgaatcattcgttgctcaactaaactcctttaaatttaatttggctgaagtttttttttaacaatagtattccattgctaaaagaaaaaccttagataaattaaatgtaacagagtttaactaagaaggaactcttcacgaatttggcagtcaccaaaccagaacaggttcaaagaccccacactgcgtccgggtgggtgagaattcatggagagaaaaaggaaagtgaggcacggaaaatggaagtgaagtacagaacctcctgtttgttacagcacggggtttgccttttttgaacacagtttcagcagttggctgcctgtggtcggctgattagtagtgtgctaatcactacttggtgattagtacaacagtaagttacagtttgtttaccctcccgttagctgacagctcactgtgtatgaaggaacctttagacccaacttataaggaggcaatgttaggcgaaattcaatttaatatgaactttaaagtagttttttccaattctgtgaagaaagtcattggtagcttgatggggatggcattgaatctataaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgacactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcattgtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatgtggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttgttagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatatagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgggattcttaatcctgagttctagtctgattgcactgtggtctgagagatagtttgttataatttctcttcttttacatttgctgaggagagctttacttccaactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttgactttcaagtcaaccctaagccaaaagaacaaagctggaggaatcacactacctgacttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccctatcaaaaagtgggtgaaggacatgaacagacacttctcaaaagaagacatttatgcagccaaaaaacacatgaaaaaatgctcatcatcactggccatcagagaaatgcaaatcaaaaccactatgagattccatctcacaccagttagaatggcaatcattaaaaagtcaggaaacaacaggtgctggagaggatgcggagaaataggaacacttttacactgttggtgggactgtaaactggttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcatatatacaccatggaatactatgcagccataaaaaatgatgagttcatgtcctttgtagggacatggatgaagctggaaaccatcattctcagtaaactatcgcaagaacaaaaaaccaaacaccacatattctcactcataggtgggaattgaacattgagatcacatggacacaggaaggggaatatcatactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaagaaatggaaaaaaaaaaaaagaaattcaatttaatagagtagagaccacatttcctgtatccatctctccctgaatggacccctgggtagattccggaccttgggtattgtgactgtgccatagtaaacacaggtgccgttgcctcttggatgaactgtttcctttccttcctacagatgtccagtgtgggggcagctgaggatcatgggggttctgcttgtaattttatgaggagcctccatgctgctctctacagtggctgtactggtttccattcccaccaacagtgtatgagagtccttttttctccacatcctcgccagccagcctccttcactgaaagaagaaataataatatatgttatgatataatatatctaattaagtattgtcactatgttctatatttatttagcatattacataagatgttattgttgtatactaatttgtattaggtattaataatatactatttagaatataaattaagcatataaatatataattaaatcaattccctgccatgggtcgtgggtggcattgctcatccccatcctccttctcagcgatggggactttgtccccctcagcacagatcaaggaagaaaatctgcagggagaactgtcctcttaccatagggacgagagtccctccgagacaagacagtggttttgctcgttggctcagctgtcctgttccagaacgggggctcggcctcacccgtgcagaactaaaaattgcactgaagagcttgtggtcttgtttgttccaaacaggcagtctctaccccaaccccacaggcaaactccaccactacagctagggtgacggaacatcctcagtcagctttaaaaacagcatttgcttccttcagaattgggaggtggagccatttaactgaaaagaagcatttcctcccctctgtgtgggccttggggggctcctccccacctctgtcccccgccctgggatgatggccaatcaggccacaccatgacccacaccccagccctcaccctggccctcttcacagccacaggacaaagtgctggctctccctcccatgccaggggctgcagacgtgtcccagccaacttcaacaaaccgcacatgctttccacacacaatcaaaccaaccgctggctgtggtcagcatcttcaagtctgagaaaggcaggatacaagacatctgtggtagttccaaaaggactttgagaagaaaaagttcttgagtatgcattgctctctggaggacactccaatgggaaggcagatgcgtagttgaaatggggtccccaacccggcatggcttgcctgggcagccctgggaaggggcaaagcctcatggactgctccagggagggccggccactcctcttgctgctgtggggagacggaactgaggtttgcagacctgccctgtctcggacggcgctcgctgaccaggcacggtggagcctggggggtccaggccaggccctaaaagcctattccaggggaggcagggctcaggccagggcgcgccaaccttctagagcctggatgcagcgttctcaaggctgggaaaaggtgggggtgccagagactggacaacattcagtctgcagtctggcgcggtgtccccacattggtttgtgaaatggcgactgagcttccacaagattcaagagggagctgtgatcagataacagcgtatttcttggtgataggaaagaagcatttttaactttgtttaatccagtatccatggttattccactctggatttcctcctacacacacatgcacacacacacacaccacacacaacacatacacacagataacacacacaacatacacacaacacacagacatgcaacgcaccacacacacaacacaaaatatacacacaatataagcagcatacacacaatgcacacaacatacacagcacatacaacacacacaacccatgaaacacacaacacacatacataccacgtataacacacaatacacattcacatatacacagcagacatacacagcacatacaacacaccacatgcaatacaacacacactcatacacaacataaaacatacaagcagcacaaacaaaacacacaccacatgcaacacacgacacacatacatgatacatacaacacaatacacaatacacacacaacataaacacacagcacatacaacacacaactcgtgcataccacatgcaacacacaacacacacaacatacacacaacacaagcaacacacacaactcatacaacatacacaacacacagcaaacatacatgctagatgcaacacaacacacatgacacacatgcatgccatatgcaacacacaatacactcacacaacacacaacatacagacaacacataccacatgtgacacacaatacacacaacatgcacagacaacacagaaacaacaaacacactcaacaggcacaacatagtcacacacacacacacacacacactgcttgaaacttattgatagcatggaacaatttgaaagcattactgcaaactaggacaactgaattttaataaccatgatggattgatcaattctgtatgttccttattaaagcaacagtgacaagggagatgctgtgtgttcattgttgatgctgctttgttcacagatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaaggtgggtgggcaagccaggtagttccttccttccttccttccttccttccttccttccttccttctttcctccttcttttttcccctccctcccctcttccttcttctttttctttcctccttctctccttccttcccttcctccttcctgctctccctctttctttctctgcttgcttccctccctccttcctgccctccctccttcctccttttctactctttccttccctcatttcctccttccttccttccctccctccctccttcctttcttgtaaaaccttcacggaaagtacagcatctgtcaaaatttacttcttttatatcaatcagaaattttcaaacactacagaatttccaccaagtaagttatttatatcattatgtgatcaattttgcacgaacaatacaaatcaaaattgccttagcttgaaaattttgatgagcacgttgtctcaggactttgacatatgtacatttttatcaagagtctttgacgttttttaccttttctctagatcttaatgaaacaacacacttcatcatcagttatgatcgtcttaagaattattctgctttccttcttcgaagttcaaaagaatatttcaaatctgccttttatcttttaaaatgtgaggcaaaatctctacattattatttttactgaataggttttaaaaacttaagttgttctttccgactctctttgtcactaataaccacttatttgagtgacccaagcctctatgcaccgaaacccctccagtgggcctgatgggtcaggtgggtgcatggggaaccatggtaggtgcctggccttcttaaatttctcaggccaaaagaactcttactaattttatgacatcattgtttcacacctcttgtaacatacttgaattcatttaactaaatgaaagttgacattcgtgttttgttcttaatcatgctcactttttaggccaacaggacgggccgcagatatgggtctgcagggactcagccctcaaaagtatgatagagtatttgcaaacatttttaacatgttactaacagaatgcaatagcagggcaaaatcggaagaaagagtaaaggggttcccaggacaagatggatttattctaataaagggagcagagatgggtgcattggtgaagagacgtgggtgtccggtgagactgcacagtgggagggtggacacacaggacagctggcagcaccgggtgcacggtttcctcagaaaaatctactaggttatggtcttgaccactctcctaacctttctcaatgatccatttttagaaaaaacctcatttgatggcggaagatgaaccttcaggggccctcttgaagccgctggtttttcgcgttgacgagaccaccccggctgtggt

SEQ ID NO: 6491 - DNA, 1021 bp, mus musculus
aaaatcagaagaggagagagagaaggaagtaacaggagcgtggaggaaggaaagaaggaaagcagaggagaattcagtccactgggataatggaaaggcataagtgactgggaagcaggaggctgagaatccattccatgcttctgagcagttttctgtcaaataatccaggatagtattaatgtacttgtaagtctagggagaagactctggattgacctgctgcttctgttacatagtaattgtaactattaaactttgacgtcagtgtgatgatgaggattgttccctttgaaggcccagtgggtcggctgttcccttctcacctctgacctttgcactcttgtctattcccgcccgcagaggcgacaggaagaagggtattacagccgcctggaagccgagaggcgcagacagcacgacgaggcggcgcgcaggttgctggagcccgaggcgcccggtctgtgccgccctccgcttccccgggactacgagcccccgtccccgtcccccgcgcccggcgcccctcctcccccgcctcagcgaaacgcctcctacctcaaaacacaggtcctctcccccgactcgctgttcactgccaagtttgttgcatacaatgaggaggaggaggaggaggactgcagcctagcaggtcaggataagtactccagcacaagaaagtctcatggggaccttcttcctgcccctcttaaaccacggccacccccctgccagccacgcccggcctccgatggcgtctttctctccaactcattccagccaccctcagccaaagccaacagtactgctcacaaaaaaggccagcccctgccccctccaaaaaaatccagctcctaccatcccagccactgcaaaggtagaggtaaaagagtgacaaatcagctctctttgtcttaatgattggaacctcagcatctctctgcacacttgccctgtagtatggtccatggcgatcatacttgccttggaatttggatgtcatgtgatcactggtctcggc

SEQ ID NO: 6492 - DNA, 6229 bp, mus musculus
tccatcctgaactgttgcctaagtcactgaagagatgtccatgccccactttccaagggtcacctgcacctcgggcccttggtcagggcaatcctactctctaacaagtcccctgctgcaggggtcacggttcagccacctaaaggggttggctcattggcatcactcccccagcatgtttccatcttttttcagttgatcagtatgattgtgtttaaaaccgtgtgttattttacagatgttacttatgaggtgctttcagtattagaagaagtgatgatgaaatctgcttttatattaaaaatcatgttaccatattgggaagttgcactggtcaagttcaagtcacacaggtaactaaagggtacatggcagagtggtttgcagtggttggaggccattctttcttgatgcccttcactttcgatgctttttgctgttggagtagaagtgaagagaacctggactgacttgagcagacctgaaaataaaacaccttcatagagtcgcttcaaggaccgcctgtgattatattggaaacattgccttttggtgcaggtgatagaattatttttcaggatccactttttaatattttctggaagtcttagaatgagtgaaacatgttcagaatcatgaaacatagataagccagcttcgtccttacattctgtttctgtttcctgaggagcaaacacatgtatggtcgccaccagaaggtctggtgagctgatctttagttccttaaaggatattaccctaattcattcatttttatgccttgagaacccactgaaatcctgggatgtgcatttttgtttttttctttttgagactgggtctcaccctgtcctccaggctgaagtgcattggagccacctcggctcactgcagccttgaactcctgggctcaagcagtcctcccacctcagcctcctgagtagataggactgtaagtgtgcactactgtgcctggctaatttttgtactttttctagagatgaggtctcagtccattccccaggctggtcttgagctcctgggctcaagtgatcgtcctcctgactcagcctcccgaagtgctggaattataggagtgagccactgcacccagcctcagtattttctagaagcaatgaaatgagttagacagtcctttgatgacattttattctgtagaagctactaaaaatggttcatcaaacattaaaacactggaaaatgtttttaaaatcactagttagtgaaacttttgttctatgtgtaagtggttttgttttgttttgttttgttttttgagacagagtctcactgtgtcaccctggctggagtgcagtggtgtgatctcagctcactgtatcctctgcctcctaggttcaagtgattcttgtgcctcagcctcccaaatatcagggactataggcatgcaccaccacgcctggctgatttttgtatttttagtagagacggggtttcgtcacattggtcaggctggtctcaaagtcttagcctcatgtgatctgcccgcctcagcctcccaaagtgctgggattacaggcttgagccactgcgcccagctggttctgttttgcttctcgtattagcaagtattatcatttctctttgcttttgatatctagactgcagcagttattgtgatgttggtgtcaatattatttttgttttttgcttgttttttacttagagagtcttagtctgtcactcaagctagagtgtagtagcacagtcatagctcactgcagccttgaactcctgggttcaagcaatcctcccgcctcagcctcctgtgtagctaggactacaggcagtgccactgcactctgctaatttctaaattttttgtagagatggggtttcccaggctggtcttgaactcctagcctcaagcgatcctcccaccttggcttcccaaaatgctgggattacaggcatgagccactgcacctggcctaatatttatttttgaaatgtggagttttacctcttttcccttcaatttcataggtttgctgactgcgccatattgttgctgacacaactggagactggacttaggaatgtttttgccacacttaacagatgtccaaaaagactcctgactgctgaggtaagcttgtttttattattgattgtgatcattgttgctgtattaacagttttctgttaccaattaaaagtttttaaaaatgttattctgtttcacattaaaatgattttaatttagctaagaactgtggaaggcctatcatttctataggatttatatttatgttatttatgattgtttttgatatttctgtaatatttctaaacagtctttaaaactcaatgataccgtgaacgtagtaggcactggttctctctctagctgtgttgatggtgtgtcactgtaaccgcgtgagatggctgcggtctagccgggagactgaggtgaccagtggttgaacctgaccttgggaaactaatcaaaaccttctgaacttgagtttctccatcttacaaatggaagacgtaggatttggaggtgacttggtgtggtgccagccctgcagcaggtcatgaaagcctttgtctcagtttcttgagcccctccatgtgtgtacacacacgcgtacacacagctgtctcagagttccacattgacccccggtcgccctgtctgaggcaagcgtctctgagtttccagcctacctcctctggctcctagaatttctcatttctgctcctttttagtagttatgataagatcctgctgcttagtgacagagatctcgaaataatatggctgcagtgactgaaataggatagaagtgcatttctgcctttcccagatgtgagtagctcccactgagatggcagcacccccatcatcagcactcagacccctctgtgtcgtcttccagtgatgagggccaggccttccttatggagactactacttcctggctccagccggctgtgtcagccatcacatctgctttccagccagcaggaagagcaaagattggtgcatgcccctctctaaggacacttcctggaggtagcacaggccttgggccagggcttagtcgcacttgctgccagggaggcatggaagcgttcctggatggccaagtgcccagcttcccacgggacgatctgttgtggagggagggcaggtgcagccgctccacacctcggattctcgtctctttctctagcttggcttttgctttttgcccctctttgtaggcattcctcaatgctctgccgtcaaccccatcctctgtttcctctccctgggagatctcatacaattctctgccttacattttcatctctgggggaacaacaattagaaaatactttgaacccagtgaaaatgaaacccaacacatggaagttttggacccagcaaaagcagtgctgcgagggcagcttacggccccggagccgggctccccagtgttgcttctcactgacccccatctgatctctgcagttagacctgcttatgttcactaaatatcttcatgtgagttttcctcagcacctcacatttatcttctttcagaaaggcgttgtttcccacagatttgtcctctgacgctccctctgtcatctcagcctcaccagctgcagactccagcagcgtctcgtgtttccccaacacctcccgtgtccactcagtggccagcacagccggtggtttccacccagctgaccttgtgctcttcctgtccaaactgagaagccccccgcctggctcctcggcccacccgagctcatctcacgattcttcctccttctcaaatttcattctcacagtcctgctgattcttttttttagttagttttttttttttggtttttttttttgaggcagggtcttgctttgtcacccaggctgaagtgcggtggtgcagtcatagctcactgcagcctcaatccccgggctcaagcgatcctcccacctccgccccccgagtaactgggaccatagatgtgtgctactacacctggctcatttttacattttttttttccttgtagagacagagtcttgccatgttgaccaggctgatcttgaactcctgggcataagtcatccttctgcctcagccttccaaagttttgggattgcaggtgtgagccaccatacgtggccccactgattattttctaagctgatattcttacgttatttatggttttttttcatttgtttaacctcctcgatgatgtcctgctgcctgccagatggagttcatcctcttcacgtggcagcaaggcctcgggttctaaccctgccctcctctttggtgtgttccctgtttggatacctcagtgaaatttaggcttcttgtcagctccagaacttgcttgtctttcctcttactttgttcctcacccccagattttccgctccaggtcaggggctgtggccacaaaagcgaccttccagaggctcatctactcaaaggtggaggctgcttttctctgtgttctgtttctgtctcatcttggaggcagtcctgctttgccttactcgtgtgcatttctgcagaggtctctgcgggttctctgaggcaggcctacacgttgctgtcgcctgctgcccatgcccagtgccttccatgtaggccactcagcgcggtgtggagcgaagcttcaggaaagagctgggccccacccattagagcccttgcttcatgatacctgcatggggattggctgcacggtggcacgcaccatcactgtagggccatgcggtgcaaataaatttggatatttacttgtcatttgacttcataaataaataacatggctgtttccacagaggatataatctatcaaagaatatattattagcacaggctttcacccagaataaacaggatcagtttttaaggcagtacatatatgaagatattttataaaacttaataagacactgcagatgctgttattatttactgattacttttgtgtcatgaggtttcttcaggaccagtggaagatatgaatatgagtgagattttctgacttcagaagcttatttatcatgggagagtgagaaggcatttatactaactctgtaaaacaaagtagaagctaatgtgtgtagttgatgtaggtaaatgaaaaattctgctttttggagaaagtgggaatatgtggtagacgttggatatttagaactcagagggaattttagggctagcaatacagatttcagagctaaagataacagattttagagtcatctgtgtagtaatgttgaagaatattggcaatatgaaatttaaaatagattattaaacatttattattaaacattaataaatcaaaaaacatttcttgagagctagcttacacaaaatcctgatttcatcacatcacaccgcatggccctacagtgatggagcgtgccaccgtgcagccaatcctcatgctgtcaaatctcactgaagtgatttcatcaggctgtctgtcaaatctcactgaagtgatttcgtcacgctgtctgtcaaatctcactgaagtgatttcgtcacgctgtctgtcaaatctcactgaagtgatttcgtcatgctgtctgtcaaatctcactgaagtgatttcgtcatgctgtctgtcaaatctcactgaagtccccaaaagccttttgagataggcattcttaacttctccttttgcagagaaaacctgcatctgtggagttcaatcggttgcctgtaggtttcatgtctagaaaatgttgcagttgggatcagaactcaggacagcacatgtctgtaggccgtgccgatgatgctgagaagcagcgtgcatgaaataaaataaaaacagacaaggctattcattggagaaaataggaagctgtgctcccttgtgcacaaataccagtcgtcaggagaagtattctgttgtatgagcagcgatttgtgagggcctgggattgtacattttagagataactgggctaaagctctgttgagagcagtgtcctaatgcggcttcatggccagctgcactgtgtttttgcgtcttttgtaatgtgtttattttgtcagtgacattcctctcatagtgtttctagatgaatgtttgttttaacaaaaaactttgggatgtgtggccatgtaccagaattttttcttattttgcatagtgttagtgtatttgtattttgctttaattgtttattttcatttctttccttttc

SEQ ID NO: 6493 - DNA, 6039 bp, mus musculus
gcatcactcccccagcatgtttccatcttttttcagttgatcagtatgattgtgtttaaaaccgtgtgttattttacagatgttacttatgaggtgctttcagtattagaagaagtgatgatgaaatctgcttttatattaaaaatcatgttaccatattgggaagttgcactggtcaagttcaagtcacacaggtaactaaagggtacatggcagagtggtttgcagtggttggaggccattctttcttgatgcccttcactttcgatgctttttgctgttggagtagaagtgaagagaacctggactgacttgagcagacctgaaaataaaacaccttcatagagtcgcttcaaggaccgcctgtgattatattggaaacattgccttttggtgcaggtgatagaattatttttcaggatccactttttaatattttctggaagtcttagaatgagtgaaacatgttcagaatcatgaaacatagataagccagcttcgtccttacattctgtttctgtttcctgaggagcaaacacatgtatggtcgccaccagaaggtctggtgagctgatctttagttccttaaaggatattaccctaattcattcatttttatgccttgagaacccactgaaatcctgggatgtgcatttttgtttttttctttttgagactgggtctcaccctgtcctccaggctgaagtgcattggagccacctcggctcactgcagccttgaactcctgggctcaagcagtcctcccacctcagcctcctgagtagataggactgtaagtgtgcactactgtgcctggctaatttttgtactttttctagagatgaggtctcagtccattccccaggctggtcttgagctcctgggctcaagtgatcgtcctcctgactcagcctcccgaagtgctggaattataggagtgagccactgcacccagcctcagtattttctagaagcaatgaaatgagttagacagtcctttgatgacattttattctgtagaagctactaaaaatggttcatcaaacattaaaacactggaaaatgtttttaaaatcactagttagtgaaacttttgttctatgtgtaagtggttttgttttgttttgttttgttttttgagacagagtctcactgtgtcaccctggctggagtgcagtggtgtgatctcagctcactgtatcctctgcctcctaggttcaagtgattcttgtgcctcagcctcccaaatatcagggactataggcatgcaccaccacgcctggctgatttttgtatttttagtagagacggggtttcgtcacattggtcaggctggtctcaaagtcttagcctcatgtgatctgcccgcctcagcctcccaaagtgctgggattacaggcttgagccactgcgcccagctggttctgttttgcttctcgtattagcaagtattatcatttctctttgcttttgatatctagactgcagcagttattgtgatgttggtgtcaatattatttttgttttttgcttgttttttacttagagagtcttagtctgtcactcaagctagagtgtagtagcacagtcatagctcactgcagccttgaactcctgggttcaagcaatcctcccgcctcagcctcctgtgtagctaggactacaggcagtgccactgcactctgctaatttctaaattttttgtagagatggggtttcccaggctggtcttgaactcctagcctcaagcgatcctcccaccttggcttcccaaaatgctgggattacaggcatgagccactgcacctggcctaatatttatttttgaaatgtggagttttacctcttttcccttcaatttcataggtttgctgactgcgccatattgttgctgacacaactggagactggacttaggaatgtttttgccacacttaacagatgtccaaaaagactcctgactgctgaggtaagcttgtttttattattgattgtgatcattgttgctgtattaacagttttctgttaccaattaaaagtttttaaaaatgttattctgtttcacattaaaatgattttaatttagctaagaactgtggaaggcctatcatttctataggatttatatttatgttatttatgattgtttttgatatttctgtaatatttctaaacagtctttaaaactcaatgataccgtgaacgtagtaggcactggttctctctctagctgtgttgatggtgtgtcactgtaaccgcgtgagatggctgcggtctagccgggagactgaggtgaccagtggttgaacctgaccttgggaaactaatcaaaaccttctgaacttgagtttctccatcttacaaatggaagacgtaggatttggaggtgacttggtgtggtgccagccctgcagcaggtcatgaaagcctttgtctcagtttcttgagcccctccatgtgtgtacacacacgcgtacacacagctgtctcagagttccacattgacccccggtcgccctgtctgaggcaagcgtctctgagtttccagcctacctcctctggctcctagaatttctcatttctgctcctttttagtagttatgataagatcctgctgcttagtgacagagatctcgaaataatatggctgcagtgactgaaataggatagaagtgcatttctgcctttcccagatgtgagtagctcccactgagatggcagcacccccatcatcagcactcagacccctctgtgtcgtcttccagtgatgagggccaggccttccttatggagactactacttcctggctccagccggctgtgtcagccatcacatctgctttccagccagcaggaagagcaaagattggtgcatgcccctctctaaggacacttcctggaggtagcacaggccttgggccagggcttagtcgcacttgctgccagggaggcatggaagcgttcctggatggccaagtgcccagcttcccacgggacgatctgttgtggagggagggcaggtgcagccgctccacacctcggattctcgtctctttctctagcttggcttttgctttttgcccctctttgtaggcattcctcaatgctctgccgtcaaccccatcctctgtttcctctccctgggagatctcatacaattctctgccttacattttcatctctgggggaacaacaattagaaaatactttgaacccagtgaaaatgaaacccaacacatggaagttttggacccagcaaaagcagtgctgcgagggcagcttacggccccggagccgggctccccagtgttgcttctcactgacccccatctgatctctgcagttagacctgcttatgttcactaaatatcttcatgtgagttttcctcagcacctcacatttatcttctttcagaaaggcgttgtttcccacagatttgtcctctgacgctccctctgtcatctcagcctcaccagctgcagactccagcagcgtctcgtgtttccccaacacctcccgtgtccactcagtggccagcacagccggtggtttccacccagctgaccttgtgctcttcctgtccaaactgagaagccccccgcctggctcctcggcccacccgagctcatctcacgattcttcctccttctcaaatttcattctcacagtcctgctgattcttttttttagttagttttttttttttggtttttttttttgaggcagggtcttgctttgtcacccaggctgaagtgcggtggtgcagtcatagctcactgcagcctcaatccccgggctcaagcgatcctcccacctccgccccccgagtaactgggaccatagatgtgtgctactacacctggctcatttttacattttttttttccttgtagagacagagtcttgccatgttgaccaggctgatcttgaactcctgggcataagtcatccttctgcctcagccttccaaagttttgggattgcaggtgtgagccaccatacgtggccccactgattattttctaagctgatattcttacgttatttatggttttttttcatttgtttaacctcctcgatgatgtcctgctgcctgccagatggagttcatcctcttcacgtggcagcaaggcctcgggttctaaccctgccctcctctttggtgtgttccctgtttggatacctcagtgaaatttaggcttcttgtcagctccagaacttgcttgtctttcctcttactttgttcctcacccccagattttccgctccaggtcaggggctgtggccacaaaagcgaccttccagaggctcatctactcaaaggtggaggctgcttttctctgtgttctgtttctgtctcatcttggaggcagtcctgctttgccttactcgtgtgcatttctgcagaggtctctgcgggttctctgaggcaggcctacacgttgctgtcgcctgctgcccatgcccagtgccttccatgtaggccactcagcgcggtgtggagcgaagcttcaggaaagagctgggccccacccattagagcccttgcttcatgatacctgcatggggattggctgcacggtggcacgcaccatcactgtagggccatgcggtgcaaataaatttggatatttacttgtcatttgacttcataaataaataacatggctgtttccacagaggatataatctatcaaagaatatattattagcacaggctttcacccagaataaacaggatcagtttttaaggcagtacatatatgaagatattttataaaacttaataagacactgcagatgctgttattatttactgattacttttgtgtcatgaggtttcttcaggaccagtggaagatatgaatatgagtgagattttctgacttcagaagcttatttatcatgggagagtgagaaggcatttatactaactctgtaaaacaaagtagaagctaatgtgtgtagttgatgtaggtaaatgaaaaattctgctttttggagaaagtgggaatatgtggtagacgttggatatttagaactcagagggaattttagggctagcaatacagatttcagagctaaagataacagattttagagtcatctgtgtagtaatgttgaagaatattggcaatatgaaatttaaaatagattattaaacatttattattaaacattaataaatcaaaaaacatttcttgagagctagcttacacaaaatcctgatttcatcacatcacaccgcatggccctacagtgatggagcgtgccaccgtgcagccaatcctcatgctgtcaaatctcactgaagtgatttcatcaggctgtctgtcaaatctcactgaagtgatttcgtcacgctgtctgtcaaatctcactgaagtgatttcgtcacgctgtctgtcaaatctcactgaagtgatttcgtcatgctgtctgtcaaatctcactgaagtgatttcgtcatgctgtctgtcaaatctcactgaagtccccaaaagccttttgagataggcattcttaacttctccttttgcagagaaaacctgcatctgtggagttcaatcggttgcctgtaggtttcatgtctagaaaatgttgcagttgggatcagaactcaggacagcacatgtctgtaggccgtgccgatgatgctgagaagcagcgtgcatgaaataaaataaaaacagacaaggctattcattggagaaaataggaagctgtgctcccttgtgcacaaataccagtcgtcaggagaagtattctgttgtatgagcagcgatttgtgagggcctgggattgtacattttagagataactgggctaaagctctgttgagagcagtgtcctaatgcggcttcatggccagctgcactgtgtttttgcgtcttttgtaatgtgtttattttgtcagtgacattcctctcatagtgtttctagatgaatgtttgttttaacaaaaaactttgggatgtgtggccatgtaccagaattttttcttattttgcatagtgttagtgtatttgtattttgct

SEQ ID NO: 6494 - DNA, 655 bp, mus musculus
gagacagccccgtcttagcctggtcagggcctggggcagtttggagactgtttgctgagggcaactgaggtcgcagtgagccaggcaggccctggggtgcccaccgcacaccccatctgtgccaggctcccagctcagggcaccggtgggcactccagtgatgttccctggcaggcggagggctcatttctcgcctccttctgaggcaaggagggcagatgttgagcctctggggtccttggcccaaggctgcaggtcctggctgctcacagccagcgggtggagccctgtccggccaacacactcgctctttgtctacgtctcagcaggggaaggtacccggggtggtgtccggctgggtgggtgtccaggctttggcagcagtgccagccttccatccggccctggagacgccccccatgagttccggggttgcttggagaggtcaggatgggcagaaatttgcaggggcagggagctggcaccggggttggagaggccttgggcagacgcagcccctccaccatggcagggagctggcctcaggcagcaaggcactgcgggtgccccagagacacagacaggctgcgtcaggctgaaccccagaccagctgagccagggtggcaaatcccatgtccgctccagacagccctg

SEQ ID NO: 6495 - DNA, 194 bp, mus musculus
ggcaaatgagtttatcatttcaacaccatttattcagtaacttcttatgtacttactgagaataccacttaaatcatattttaaattcatactgtgcccaagtgtaagatgtgagtcttgatatataggatgtatatgcatgcatacatgcatgcgcaggctggcttctgtttccatcttaattcatatggtaa

SEQ ID NO: 6496 - DNA, 454 bp, mus musculus
gttcttaggattccatgcttttaccgtaattagccaattgcctttttgactattgtggttgctcttatttagagaaatgtctgatcagcactcccattgaacattcctggagggaaatcttttttgcgcattcatattaaagttctgaagggcaaattcacttgtgcgagactcacaacgtatcagcaagtttctttgtaagttttgttatgtatattaattcggtgttcagaaaatctttacctgtgttcccatcagagacatttgagtgtcaagccttttccagtctggacattttgatttcggtaaacatgttcccttccggcctcagcagagttgcttcagaggcaatttgtactgcctggatttcaatgtctcgttgctacatctttttttcacctagagcattgtgataaaggctcctcttattgctagttttgtccttgtgatactt

SEQ ID NO: 6497 - DNA, 893 bp, mus musculus
aaaattaaaacattactctcgcctctactgctgctgcaataatttcagggaagatgagagactgtgtggattccagacaatgaacataattcatagcctgctctaaagctctgtaggacactttcttttaaatgtgtaagacattaacatatcagtcattttaaagactcatagagaatgaaagacttaccagatagtttttgatgtgtgaaatttagggaaatgggaggtgagatatgtagacggcaatggacacaagtgtgtgtattacctggtgatgtcacagcactataaggggagaggagacaaaggataagaaaggacctatgaagaacttaaaaggtcagtaaaaggaaaaagaaacaagaatatcattatttttaattgtttgtgtaaaaagacaaatttggggacttttttcttaacggtaacagctggagatggtaatgaattcacagaccaagagtaggcctacactcacacaaatgggtagttcttttattaatgtaggaatgtagaaaacttgccagtgtttaagatgtaagttcccatgtgtctctttccattttcattatatgcctatttcagtaaataattgggtaaaaagcatgttttcttaaaaaatacactaaaatggtttcagatggtgatcatgtttttccttattggatataaaataacagatacacactttaactattccacaaaaattacagtttcccaaaccaaaaatagtacacttaatatatatgtgttttatcttcattgccccttttccttaaaatgtttagactgacagctcttattaataggtaagttgattacgggtatcttcttttcattcaattgaatggcctactgcagtttttgaatgaaggagatattcctacatt

SEQ ID NO: 6498 - DNA, 1064 bp, mus musculus
tgaaagcagctctggcagtgactcatgtaacaaactgaaccagtagaaaagaacaggcataaatctgtgttggttaaaatttgaggacaagagtttagaaaacaagagaattaggaacatagaaaggagagagttgaagacagctattgaacatactctgaagaaataggtgagtgaagaatgttaggatatttttagaatgccatgaaatgtgttgaccctgatccttctgcatttcacccttccctcaacacttcctcagaaggtatcagaaaacaaatacgcatttcagttactttcattgaatttcagaagaaattaagatggctagttactaggtagaacaacaacagattaaggttatttggatgccaaaaattgggaaagcatactagggatgtgatacgagtgatacagcatgaaactgtagctttctgaggctacttatttagtagtcaaaggatgaactttttatttctcacttaaatgttaaagaaaaaaacaacaaacattcataagaatacttttattttaaataagtataagagataaaaaatgtcctgcaaaatttctgacttaattgtctgggtgtggcgcaaacatttatttttgcaaatgtcaccaggcaattctagtaagcatctttgaaccactactgtgcaccctgacagcctccatgtctgggagaatttctggtaaaggtgatgtgatgacaatgatagtgactgttctggcttttcaaatggcagtgggagaggtttgcccattaaaaaaaaataaatatatgcactctaaaacaaatattggatctaatgtttttagtgagttttcatttgccttttaattaattatattttacctgtgtttttcttttaattgcaaggtctaaacattctttatagtttctgtctttaatggcgtttttaatgacatcatcttccaaaattatatagctattcatttatacgtcttgtgatgttttcaatatactatcagtatctttctgttaattaggagagggaaatagcgcagaggagtgagtcccagttatcactgggttttga

SEQ ID NO: 6499 - DNA, 1951 bp, mus musculus
aagttcctaagattctattttccattttccttacatctcacttgactcactctatctagttaattcctttccatcctatagctttagctctaaatcagtgaattccaattttttatattatacttcaagctctacgttacatgtgcacaacatgcaggtttgttacatatgtatacatatgccatgttggcgtgctgcacccactaactcgtcatttacattaagttatctccaaatgttatccctcctcccttcccccaccccacgacaggccccggtgtgtgatgttccccttcctgtgtccaagtgttctcattgttcaattcccacctatgagtgagaacatgcggtgtttggtttttttgtccttgtgatagcttgcgagaatgatggcttctagcttcatccatgtccctacaaaggacatgaactcatcattttttatggctgcatagtattccacatggtgtatatgtgcctcattttcttaatccagtctatcattgatggacatttgggttggtttcaagtctctgctattgtgaatagtgctgcagtaaacatacgtgtgcatgtgtctttacagcagcatgatttataatcctttgggtatataacctgtagtgggatggctgagtcaaatggtatttctagttctagatccttgaggaatcaccacactatcttccacagggttgaactagtttacagtcccaccaatagtgaaaaagtgttcctatttctccacatcctctgcagcacctgttgtgtcctgacttttaatgatcgccattctaactggtatgagatggtatctcattgtggtattgatttgcatttctctgatggccagtgatgatgcacattttttcatgtgtctgttggctgcataaatgtcttcttttgagaagtgtctgttcatatccttcgcccactttttgatggggttgtttgtttttttcttgtaaatttgagttcattgtagattctggatattagccctttgtcagatgagtagattgcaaaaattttctcccattttgtaggttgcctgttcactctgatggtagttccttttgctgtgcagaagctctttagtttaattagatcccatttgtcaattttggcttttgttgccattgcttttcgtgttttagacatgaagtccttgcccatgcctatgtcctgaatggttttgcctaggttttcttctagggtttttatggttttagatctaacatttaagtctttaatccatcttgaattaatttttgtataaggtgtaaggaagggatccagtttcagctttctacatatggctagccagttttcccagcaccatttgttaaatagggaatcctttcctcatttcttgtttttgtcaggtttgtcaaagatcagatggctgtagatgtgtggtattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggccatgcgggctcttttttggttctatatgaactttaaagtagttttttccaattccgtgaagaaagtcattggtagcttgatggggatggcattgaatctataaattaccttgggcagtatggccattttcatgatattgattcttcctgtccatgagcatggaatgttcttccatttgtttttgtcctcttttattttataggtaactcaggctatcactggaactacagagacatattttcaattatgaactagacattacatcacatttcaaacttaaccttacagtaactacttcactgtgttgaaatccttggtttgcctgactctcccaatacagattgagttatttaaaggaaggaattttcatgtctcc

SEQ ID NO: 6500 - DNA, 663 bp, mus musculus
aaaaaaaaaaaaataggagagatatgtagaaacagttttacatatgcatccactgaccttctagtacttcaacacttaggatttgagtttacagtgagtcaggagggtaaaaatgtttatggggataactgcttcacccataaagtaatttagatagagtatatatttgcatatacagtctcaatccttccaaaaagcagtatcatttcctaatacaaaggacagtagtacatgtcagggtacaactgggaaagaatttcacccaggaccttgagagcacaagtgtagacaaaataactaaatctgtcagtgtcagcaaattactcacaaaacctatcctcaggagcagtgtttgcactctcactcagtcacgctgataccatggaatctgttcaccatcgacagagaagaggcagaccctgccagaatagcacaagtattgactgagtgcatatcctcagacacccatcttcacagaaatgtttcacctggggtctgcctcccaggtcctatcctccctccctgtgacaccttgctcctcacatcctccctgagggcactttttgttgatagaatcctgacaaatacctgtctgaaatatcataaagccattgaaagctcaattgatttcacttacaatagaaataatatctagatgtcatt

SEQ ID NO: 6501 - DNA, 952 bp, mus musculus
aaataagggcgatgaaaccattgtgtgatgccttttatttcacagctctgctcatctgccgcacaaatagcagaacccatggttaatcactgcatacccctgggtcccagggcactcgtggagctttccatatggtctgctcaaaacggggatttatgcatatatgaaatacaaattatgcaaagagatgtaatcatatagtgaaaccaggtcataagagaaaaatacctgttcaacaaaaacagaaacctacttaaaaaacactccacatttctggttcccaaggcaaagcaataatgtgcacactatataaatcttcatcctaacattaactgggataatctctcagacatactcaactggaagctttcattttcactcatccaggaaaaagaggagaaaaagtttaattgattatttccattttgttcttccttaatgtcttaagctttttaagtcttgctgcctattgggtgacttagtacctctacggtaaagtctttaagttttttttttttccctctaatttcatctataagctttagtctgttctttttcctgctggtttaaatagattatttttagctttagacagggtaaccacataaataggggcacttttgaaagtcacaagaggcactaaacagaaaagacactgcaacgacggggaaaaacagagactgcgctgggccagctgcgaggtacacagtcaccttgcctagggttcgctttgtggccaacagaaagatattcccctaactggtaaggtcagtccgaagagcacttacataagcagaaactattttgactgtacttggatcctatttcccacacatttcacattccttatgacagtcaatgagaaaggcagaaaaatgtcagagttttcatgagacatatccagtaacaagaaagcatggaaatgaaaatggaaaaaaaaaaagccttttgg

SEQ ID NO: 6502 - DNA, 1071 bp, mus musculus
gaggcaacattttaatacttaagcctggcatatttttaatataaatagttgaatttgaacaaaaagttaaaaattaatgttagacttttagctttaccaattttttgaacctgtattgtagatcctaacaagtttcatttaaaaaggaaaaggttattttttaaatggttcccactgggtatacaatttgttaactctcatgatatagttaattattcttacagagcaaaaaaaaaaaaaaaaaaaggaaagtatttatttttgttaagttcaatatgacctgatagaacttcatcaaccaaatattaatgtctttgcacctgtcttatacaagcagagaatagatgcagatggaaataaattatgtcatttttttctcaaataattatcttcagaagtcatattttacaatgcaaaacattgagaagaatatttttatttaacttgttcaatttttacagctaaatgattttaattatagtaaccaggtagtacccatattccctagaaaaatttgaagaatgcaggattcattacatgtatgcatatatatgttatatatatgttatatatgttatatatatgttatatacatatatgttatatatacatatatgttatatatatacttataaccctgatttctaagtaaataccatcacttccccattctcccactattgaccttgaaaagagagttctgcttcaatctgtcactacttgaccaccacacaggacttacgcaggcttcacggtggacagtcttctgcctgtttctgcaaagaaaaaccgggaggtggggctgtgctgccgcagaatctcctgaagtaccccacagctaatgctgttccaattcggtacccccaaagcatatccttgccaatgcacttttcacccagcagtggtctgctgtcaaaggaattcaggctacaatagcaggaaacgttagaagcaccttaaaagtataatttatagtattatgataatagtactcttcacactaatagcttctttataacataagcccagtctactttcttattcttgttgccaattactttctgatgtgaa

SEQ ID NO: 6503 - DNA, 1017 bp, mus musculus
taacccctcctaaaccaaagtcaaaagaggaggtttaatgtctcgcttggaggtcttagtatccactgctttgtaggtcatcaagtatgagtcacatatgagcaagtaaaggttggggagctattgatagtagagtaggggattgcagttcgggaagtgttgtggaccctgagtttgccagggtgaaattcagcatgtgggctagagagagagattggaagaggagaagagaagaggagagcatgagctgctctgtgactgtcttagatctttcaggaagggcaaggggacctcagcagaggaaatgagaattaaattggcagatgcctaggggataaggataaactcaaaacatgcacttgactatgtcagcggactggttgggtgtaaaggatagggagaaatctcagaaaaatgaaaaaatgaaaaatgaaaaaatgaaagcacgggcccatcagaaaatgaattttaaaatatggaaaaagtagaaaatactagtgggagtcatctaccatggtaccactcaaggaagaactatcccttctctccttacctcttctactgcttgttctgaattggaggagtcagagaatatggatagccaagatagagcaggagaaaagaagtcctaggtgagaaatgagtgaagaagttgtcccttccctttctttttcatgggctttattcttgcatcagccaatagctaaggcagggaagtaatctcaactttaaattagattcagagctttgatgagactagcattttaattactgaactcagattttatttttggcaaagaactcactgtacggaataaatgtaagacaaattttaaaattttatttactttatgatggcatctttctgtcatttttatgcaatacaacagttactgtttcacaaatagaaacaaacaaaaatgtggttcctttctgaagaataatttggaagtggaacaactgtatttgaaaagacacattagtgaatgttttaaacatgttaggaagcgttacacc

SEQ ID NO: 6504 - DNA, 1017 bp, mus musculus; identical to SEQ ID NO: 6503

SEQ ID NO: 6505 - DNA, 646 bp, mus musculus
tacagtctgtggagaaaggtaattgccaaatttaatgatgacaaaaggaaggccaaaatatttgcacttgtcaatgtcaataataattcttgtattggagttttataatgagcagaatttattgagatagaaatgaccatacataaccactccattaattgcctaatgtcaaacagcaaaatcaggcagcgaaagcaggatgaaatggcttcaataagtgagaggaaattcaggtataagggcaagttgcagtgggaaggcaaattaactttattccacattcatacttgcaagtgtttcaaaaccttcaaaaatctttgaaatatcttgtgatcagtaattcaggagtacatatttcttcctctttcatttatgcggtgtgacaagtgaatccgagttttgaaattcttgcttaatgtattctctttggtataagaatgagccatattttgaataaccatatcctgtagatgtgcctaaaattcacgtaatttgatcaggttgacaatcagctcttttattcattatttcaagtaatatttaatcttgttactatatgtttattacttaccagggatggtgaaaaggattgaaatgatcgagccttcaaaaaacttatggaagacttagataatagccaaatgga

SEQ ID NO: 6506 - DNA, 646 bp, mus musculus; identical to SEQ ID NO: 6505

SEQ ID NO: 6507 - DNA, 544 bp, mus musculus
cattaataccattacttatctgatttattccactttctttaaagacaaggccacttaatgcaacattaaactccttgtggctctttttgtccattgaatattccctgactgggacagacactcaaaagactcagtttaaaagcactagaaataagacttctctagtatgtcattaacatggtattcagttaagctcatttgttaactatttttaatttttaagaattgcttttacaaattttaatcttctcttttaatttgataatttgcatccaaaaccaaaactgtaagacaatgtacattcagagagcatttgctttcatatacaacatatatactcatacctagttttgtctttatccatctgtgtaaacatttttactaactcttacttcaaaatccaattgcttttttctggaaaaatatatatattatatatatatatgtgtgtgtgtgtgtgtgtgtgtgtgcgtaatacatataatattcccattccttcacacaattgcatatgataaacctaatttgtacattgcttttctca

SEQ ID NO: 6508 - DNA, 856 bp, mus musculus
tgtcaaatcaaagaagaacttaggagtggggggctttgaccaacacaaatattatgttagctccaattcacagaagctctttatagacgcaagtgctttgagtgccttaaatgacaaagtttttgtttagttccatattttacattgtatgctgtaaaatacaaatatagtactttgtatgcaccttttgaaactttaaaaattattatcatgaacatgtaacctgattaaattcaacgtggatttatttttctattcactccttcatggtgtctttgtataagcctttgaggaacttcttttcattgatgacactaaggagaaaaaaatgtcactttaattatctctttttttctgtttgtttgttccctttcttggttgaaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtgatggcaagccttacccaaatatcgtttacacagagagatgactatggcagtgatgtttaatattattaaatccaggcatttcgaatctgtttttcatgatttatagagggtttacacaaagtgccacttattaaagagcttccacagtgaagatggagaaggtgaacttgctttgaatattccagatgtgtttggtcgtgcgt

SEQ ID NO: 6509 - DNA, 311 bp, mus musculus
tgggaccatttgggtttgcacgaatatttggcaaggagagcagtgtgtttggttcagattaaaagtgggagtcgacagatattagaggtccttaaaggttggcaaatgagctgctgctctctgcagaactgaaatatatttagaattacatagaacttaatggtgtacaggagaaacgcctgcttaactacaaaactcttatttatgatggaaaaataaaaacaccatatgcatactgccattcccagaaaatactgtgaaaatattgccttgttgtggctacaaattgtgtaaccccacctttggtgaat

SEQ ID NO: 6510 - DNA, 520 bp, mus musculus
catttagccagtgggttacagaaacagtattttagtcaggagactcttattccagtgccccttttcatttccctcacttcatgttgactcactctgtgaaagagctcaggtcagttacaagtagaactagccaggaagggacagagtctcaccacaactgataaaggagtatcttttcaacaattagccttcagcagagggaattaattagtgaattccttaaaagctgttttctatgcaccgacttcagacaagtgcagttttggtgggatgtacttctattgtaataggaacccaaacctggtatctaatcatcaggatattattaattgcatgattgtaagtatcatttaaactgactcctcagagggaactcctaattctatctcaaatatttcctatgtaaaacggaaataactatatcttacaaactcatatatgtatactcggaacttctgaatggtatttctgggttttaagacatgcatttgaaaattatcttgatttccttctcccaaag

SEQ ID NO: 6511 - DNA, 1505 bp, mus musculus
gtcataaaattcctccataaaacaggatgcaagattccatcactgaagcaaagagtacaaagagccggtgtataaatatctaattgtaccaaaggactgggctttctcaatgactgctcatctggagtctccagggcatgctcgctgtggtttcctgatttttagaagccagtttaaaaaatgagtgcattaaagggtaatttgcctgaaagttcaggaagtaaagggggtggtgtggaagcaggctgaaagggagaaagaaaagaggaacgtagtgagaagacagaaaatgagaaagaaagtggtagaaagacagggaactagaaatcagaaaggttgtctccacacaaagttagacatgactgtatttgtcgtctgttttcatttccctgtaggatgttcaccatggaaacggtacccagcaggccttttatgctgaccccagcatcctgtacatttcactccatcgctatgatgaagggaactttttccctggcagtggagccccaaatgaggttcggtttatttctttagagccccacttttatttgtatctttcaggtaattgcattgcatgattacccctaattttcttgtcctttgctggtgttttaaattacacgagattactgaattgtcccatgggaccaagaaccagtgcagaacaagtgcataacccagagcactgtttgtcagggaaggttgggctgatttgatgtgttgtttgatgtttatttcaagagctcccatgtgcttgttttcctctcttcttgctttcttccatttgctctcttctctgcccaccgtggtgtgtctttctcttcccaggttggaacaggccttggagaagggtacaatataaatattgcctggacaggtggccttgatcctcccatgggagatgttgagtaccttgaagcattcaggttggtacttctttctctctgaaagtggcaaattggaaaataaatgtccattgaaataacaccaaatatggaagagaaatgtaaatgtctaattaaggtaaattatcgctcaaagccacataagaatatgtataagaagaaaagatctatcaagacctggttttgattatacaggtatattggccaatggcccattttcccccttccctcccaaataaggaggaaaaaatattttattattaaatagttctctctggaaaattctgcctattttaacatatgatgtggtttttacagtagacattagcatattcattgccctgagaagtccttcattacctatttgattttgttgaacaagcatttctcaaacttcattggactacagaatcccttttttacatagcaccatttagcattcctagttctggggagctcactcattttcatgacattggccaaggcaatctcatttgatggtagggtaaatgacttttgtatagttttcctttcacatgaaaacattaactaattaattggttgcttccattttctctggaacaaaatctacaaaatgta

SEQ ID NO: 6512 - DNA, 1505 bp, mus musculus; identical to SEQ ID NO: 6511

SEQ ID NO: 6513 - DNA, 1505 bp, mus musculus; identical to SEQ ID NO: 6511

SEQ ID NO: 6514 - DNA, 4792 bp, mus musculus
cattctgtacttttcaacttgtgaacaaaaaacgtgatttttaattaaaaaatgtcatataactgaaacaaaaaataaaaagcacagcaatctggaattgtttaatgttggtggaaaaatgtctatgaatctcaatatctcatgagaacttcattatattaaaatgtaattcaaaatttaagttaatgataatgcttgaaaattaaagttttctatttttattattaaaatttttattagttttttattttatttttatttatatttttatttattaacttctattataggttcaggggtacacgtgcaggtttgttatacaggcaaattgcatatcatgggaatttgttgtatagattatttcatcacccaggtaataagcatagtgcccaatagctagttttttgatcctttccctccttccaccattcaccctcaagtaggtgctggtgtctgttgttcccttctttgtttccatgtgtattcaatttttgtcttccatttataagtgagaacatgcaatatttggttttgtgttcctgtgttagttcacttaggataatggcttctagctccatctatgttgatgcaaaggatatgatctcattgtttttcatggctgtgtagtgttccatggtgtgtgtgtaccacatttgctttatccagtccaccactgataggcatatataggtagattccatgtttttaatattattaacagtgttgtgataaagatatgcatgcagatgtatttatggtagaacaatttatattcctttgggcatatacccaataatgggattgctggatcaaagagtatgtctgttttaagttcttcaaaaaatctccaaactgaattacacaatggctgaactatttacatttccaccagaagtgtataaacattctcttttctccacaaccttaccagcatcagttattttttgacattttagtaatagccattctgactggtgtgagatagtatcttattgtagttttgatatgtatttctctactgatttttatcttgagtatttttttatatgcttgttggctgcttatgtctcttcttttgaaaagtatctgttcatatactcagcccaatttttaatgtgattgtttatttgcttcttcatttgtgtatgttccttatagattctggatataagacctttgtcagatgcatactttgcaaatattttctctcattctacaggttgtctgtttactctgtttatagtttcttttgttgtgcagaagctcttttgttaatgaggtctcatttgtcaacttttgtttttgttgaaattgcttttgatatcttcatcatgaaatttttgctaggttctatgtccagaatagtatttccagggttttaatagtttgaggttttctatttaagtttctgaccatcttgcattaattttacggtgtaagaagggggtctggtttcaatctgcatatgtctagccagttatcacatcatttattaaatggagaattctttcgccattgattgattttgttaactttgtcaaacattagatggttgtaggtatgtggcattatttctggactctctattctgttccattcgttcatgttctgtttcagtaccagtatcatgctgttttggttactgaaaacttacactttgaagttgggtgacatgatgcatttagctttgttatttttgcttaggattgccttagctatttgggctcatttttggttccatatgaattaatttttttttctaattctataaagaatgtcattggtaatttaataaaaatagcactgaatctgtaaattgctttgggcaatatggccattttaacaatattgattctatctatggacatggaacatttttctttatttgtttgtgtcatctctgatttctttgagcagaattttgtagttcttgttttaaagatgtttcacctctctggttagttgtattcctaggtattttattctttttatggctattgtgaatgggattgcattcttgatttgactctcagcttggaaattcttgttgtataggaatgctactgatttttgtgcattgattttgtatcctgaggctttggtgaagttgtttatcagatcaaggaacttttgggcagagactatggagatttctaggtgtagaatcatatcatctgcaaaaagatagtttgatatcctctcttcctagttaaatgccctttatttcttcctctggcccgatcgctctggctaggacttccagtatgttgaatgggagtggagagagaggaaatttttgtcttgctctggttttcaaggggaatgcttccagcttttgcccactcaggatgatgttggccatgggtatttcatagatggctcttattattttgtggtacattccctgaatgcctagtttgttatgaatttttaacacgaagggacctaattattaaaagccttttcttcttctattgagatgatcatgtgctctttgtttttagttctatttgatgaatcatgtttattgatttacatatgttgatccaaccttacatccaagggataaagtctgcttgatcaaggtgaacttattttttaatgtgctgttggatttggtttgctagtatattgttgaggatttttgtattgatgttcatcaaggatattggccctgaaattttctttttttgttgtgtttctgccagattttgatatcagaatgatttaggcctcatagaatgagttaaggaggagtcccttctccttgattttttgttatagtttcagtagtttccagttctttatgcattttgtaaaattcagctgtcattccatctggttcagtgctttttctggttggtaggctttttattgctgattcagtttcaaaactcattactggtctgctcagggattcaaattattcatgactcaatcttaggaggttgcatgtttccaggaatttatcaatttcttctaggttttatagcttgtgtgcatatacatgttcatagtagtctctgtttttttaaatatttctgtagcatcagtggtaacatccctttgttatttctaattgtgtttatttggatcttccctctttttttattagtctaactcacagtctatctatcttacttgttctttcaaagaacaaactcctagcttcattgatcttttgactctgaattttcttcagttcaaagattgaaggaatatcatcccacacagatgagaaagaaccagcaaaagaaccctggcaactgaaagagccagaatgccttcttacccccaaacaattaccctagttccccagcagtggttcctaactaggctacaatggctgaaatgatataggattaataacatggataggaagggagatcttcaagattcaggagaaagtataaacccaatccaaacattctaagaaataaaataatacaggaggtgaaagatgaaatggctattttaagaaagagccaaactgatctgataaagctggaaaactcactttatgaatttcagatacaattgttaagtattaacaggagaactaaccaagttgaggaaagaatcccagagctcaaagacaagttctctgaaataactcagtcagaaaacaaaaaagactaaacaagaacgaacaaaacctctgaaaaacacgggattatgtatagagaccaaatctacaacacattggcatccctgaaagagaaagagagaaagcaagccacttgcaaaacatgtttcaggatattgtacatgaaaatttccctagtctcaacagagaggctaacattcaaattcagggaatacagagaacctctctgagatactatacaagacaatcatccccaagacacatagccatcagattctccaagtttaaaatgaaagaaaaacgttaaaggcagctagagaggagggacaggttacctacaaagggaaccccatcagactgacagtacatctttcagcagaaaccctgcaaaccagaagagattgtaggcctatgctgggcattctcaaaaaaaaaaaataaatcccaaccaagaatttcatatccaaactaagcttcataattgaaggagaaataaggttcttttcagaaaagcaagtgctaagggaattctttaccactaggaaaggaaagactgttaccggctaccacaaaaaaaacaaaaacacacttaagtacatagacccttgacactatacagcaatcacacaaacaagtctgcataataaccagctaacaacatgatgacaaggtcaaatctgcatacatcaatattaaccttaaatgaaatgccccaattaaaaggcacagggtggcaagttgaaaaaagaagaacgacccaactgtttgctgtcttcaagagactcatctcacacgcaattacactcataagctcaaagtgaaaagatagagaaaaatctaccacgcaaataaaaaaatagaaaattcaggccaggcgcagtggctcatgcctgtaatcccagcactttgggaggctgaggcaggtggatcacctgaggttaggagttcgagaccagcctcaacgtggagaaacaccatctctactaaaaatacaaaattagctgggcgtggtggtgcatgcctgtaatcccagctactcaggaggctgaggcaggagaattgcttgaacctgggaggcggaggttgtggtgagccaagcttgtgccattgcactccagcctgggcagcaagagtgaaactgtctcaaacaaacaaacaaacaaacaaacaaacaaacaaacaaaa

SEQ ID NO: 6515 - DNA, 414 bp, mus musculus
tgtggtttcacctatttattctgtactatttctttttctctcctttcttttcttctactggattggtcaaatattttataaatatttcagtattttccaccccacttacttaaaggcattatctttatttatatgcccaattaatggttaccataaaaattataatataatttacttacttaccttgtcaaagtctaagttcaacaatgtctttattcttctccctgcaaatatggagaccttagattattttcctccatttaattcaatacaacttctatattattcattttgttatttttattacattgtttaagaaccacaaaaaattaatatgattattattgaccacattatttgttctccattcattctttttctcacatcttccaatggaatcattttatttcagct

SEQ ID NO: 6516 - DNA, 1376 bp, mus musculus
ttaaaccaagatcaacaagactaagaagatgtgtcagcaaaaggtggtagaagcctttgtaatagggctttacttgagacttgagtgatgcaggtggagtccttaagtcagaattccactcagcagaccttcacattagaggatccttgaaaccaagcatagggtgaggaggtcagggatcttcgaatcaccttagtgagactgaagattggagtcaaatgcttcactgtttgttacttaagcgcttgattttcctgaggttaacgcgataaggacatgagggttttatgtttatcctccacagtgcctagcacatacaagcacatagccagtgttagtgaatgtgttcttttgagcatgtagtatgatcagaaattgcagtgacagtggcagaactgacactcttactctcccactccaactgcagaaggaaagaaaacggagaaacaagaaacagtaaacacataaactgagagaaaggaagaattttccatcaggcaaagcaaagtttattcttaaaaagaaacatgcattatatctcaaagaacagagaaacaagatagggtatttaagggttaatttgtgtgagcaaagtgctctgaaaccatgggtatgaaaccacatcaatgcagtctcaccatggctgcctgccgcattgtgcagctgctatttttagccaacattcatactgctctgggtcagagtgggggacttctgtgcagagaagaatgaattgcttgcagcaagccaagttttgaggagtaattatttgtgctataatgtacagtcagggccagctccatgccacacactgaaaactaagtcttccaggaagtacaaataggcaggtcttcagtggctgcttatggcttctagcactaatgatacttggcagtgctgccaggatgatcaagaattaattgatttgttgtgaactctaccaaaggttagcaccgagtctgatgttatacaatgtagatacattttcaaagtacttcatgatcattaattattttttttgtctcaatgttccaaggaagtaaaaattagttttctttataattttaatgttatcttttcaactttatatttattaaccttagactttctagtaagagcaaatgctctttcacaaatttcttgttacaagagatacagtaagtaacaattcagtttttatttactaatagctgttttctaaagcaggtaccaaatctctttctttttactttcctattacccaagggtgcctgtgcctgaccaacactaactttctatacctatcagataaatcctaagaggccaagatatacttcaccccgaatatggatccagttttaaggaagtcagagtcacaacttccgtttttcaaagca

SEQ ID NO: 6517 - DNA, 728 bp, mus musculus
gcaacgaatcattggtcctattctgtaatacgaaaccaaacagaatcagtctaatgatccttctatatacaaatttataatcctttaaggaatctatatgatgctagctttttttggtttttagttaatttgctttgttttgaaacaaaaatttccaagcaaaatagtgagatttttctagagacagaaagaaacagaagtgccaattttcttctaatttttcatctaattaaatctttgattcgaattctccatttgacaaatgagaacgtctacttccaactctagtcttcacaaatatatgcaagacaggatggttacattttataaagtcaatttagctcattattctctaccaatagacttagttcacatgctagaaaattgaagtatttgatcagttaggaagaaaatatatgtgattttacaggactcttgagcaatttttaagaagagaggaaaggggcattcttccttaattatctaacttaaatttcacctcctctgtgaagtcctcctctttccccagctttctttacccttcagtcatcacctatttccctttaacgttttgtgcaatggtcatatcccaactttggattatatttcaatatgtacaaactgatctctagtctagccagtgggctactggaggacaagaaagttaaccacttgtatctcaggcacattgtgaggaatcaatagatattaattcactcgaattagaa

SEQ ID NO: 6518 - DNA, 950 bp, mus musculus
catactgggagttcttgaaatccttattctgaaaagtgtggtctacagactggcaacatcagcattacctgggagcttgtcagaaatacaggggttcaggtcccatcccagacctactgaatcagaatttgcattttttagctagattctctgagtagcacaaatttcaattcattctctctctctctctctctctctctcccgctctctctccctctttctcttccagttctggtgttctatcctgactctatcaatttgctctcttcctttcctcagcatattgacttgtccagcagagcttgttttgcagaattcatccaggaatatttatttggcacccaatatcctatgttctcttatcaaatgaagaagttattttccttaaatataacctttattggttttcacagttctctagttccagacttgaccaaatgctatctgttatgcccataatgtgacacacaggtctttaatggcataaggctaggctttgctgtttcttgagtcctgaaagatgtgcatggagatcatttctctaccacttatcttcagatattttgatacttttgcatacctttattgcctgctaactgaattactacaagtcctttctaactggtccactgccaacttctattagcagattttcctgtattgaaattgctgctgcctatcaggcagcaccatctattccaacgttcgttcaaaatcaccctcttctaaaggtattggctttcatttccgactagtattgattttggaccaatgggcgacaccctatactgcttagagttcctgtcttcccactttgctgttcgaagataggactccacgtcgtggaactccaagtcaaagaatcacatccagtggaatctgggaggccttctttcttcctacttgcttttaaagcaaactcaaaagacatggctgtttggtgactgttc

SEQ ID NO: 6519 - DNA, 1798 bp, mus musculus
caatacaattaaattccctaacatgtcagagattctctaacatgtcatctcttgaacatttcgtatgctacatataagaaacataaattatcattatgacttaaaatatatttcacataaactatcacagtattaatactttctatatattatgttactatctctatataacttctacaacttaatgggtttgcaaagtcattttgtagtaggacaagcctcagacaaaactcctcagacaccaagttaaagaaggaaggggtttattcagccaggagcattggcaagactcctgtctcaagagccaagctctccaagtgagcaattcctgtcccttttaagggctcacaacgctaagggggtccgtgtgagagggttgtgatcaattgagcaagcagtgggtatgtgactggtggctgcatgcaccagtaatcagaacgaaatagaacaggacagggatttttacaatgcttttccacacaatgtctggaatctacagataacataaccagttaggtcaggggtcgatctttaactaccaggcccagggcgtggcaccgggctgtctgcctatggatttcatttctgcgttttagtttttacttctttctttggtggcagaaattgggcataagacagtatgaggggtggtctcctcccttattcatctgactaaagagtgaatattactatttccagcagtgccggtttctccagataaagattcaaaatgaataccctgctacagatctaggtaaactgtctgatttggggaactggaatgtgggatcagaactgtgatccttttccaagccggtaacacttaccatatcaacagggaaactcaaaggcatgcttttagctgccatgcagctttacagtccttaaaatatattccttcggtaaatttccttgggtaaatttcacctttatgcaaattttattttcaactttttattgtctgatttagatacatggaattctgcacccaccacatggaatccagctaattaccttcaattacagttaattgaattatgtacccgtttcatggtgatagaacatttttatattttattcattatctatcttcttgaccactacttgctaatccttacaatagtctcctccttattcatagtttcactttccacagttcctttggtcaaccaccgtctgaaaatattacatataataagatattttgagagagaaagaaaaaaataagaccacatttgcagaactttttttacagtatattcttataatagttctattttattattagttattgttaatctcttactgtgcctaatttataaactaaacttcattataggcatgtatatataagaaaaaacacactatatatacagtttagtactatcctcagtttcaggggcccactgggagtcttggagtatatcccccatggataagagggaacaactgtatattagcaatgtaattgattacatgtagattatgcaaatatatgcaaaatgtttataaattcttttccaccagcacaggaaaacattgttttcatgttcatttatcacacctatatataggtcacggtttgaagacagctagttcatctggctatcaacctccaaggcctgccgtagctcactcaaattaatcatctaattaacaatcttttacacataaacataaagtattactcttaataagtataggatttttgtaaacccactgcagtgcacctaattaagctaatttttttattttttcagaaaatctaagctgtctaggttagatgcacaataaaaat

SEQ ID NO: 6520 - DNA, 1864 bp, mus musculus
tagctcctaattaatgtgaactccacgaagaaagaactcccaccattttatgtgctctgggatgcggctgagtctttccaattgcagtctgtttactctttggacagctgcatctcctccttatctgctgaactgaggactgtacaaatgtttcttgtgggtcagtgtaatattaaagaatagctatgtttagaaggccagttaccgttgctgtacccacacgtcaggggcaaaggctgagtgggcagatggggggctgccacccctcctcacgcccggcttgggaccagcctggagtctcaagccgaaacccctcacgcgggtgggcacacaatgcccggcgtgtcgcctgggcctcctcggaggtgctttaacaggctcttgcgcttttgaacggccctcctggactctgatctgtttaaactagaggcgttaataagtgataacctggatctgccctccttggaagctgcctgcctatattttattgtttaaaataaataaaaatggtgccccgggagagaagatggggttgtttcctttttcctctggctctgccccgagaaagagggcgggatcctcacggctcacagtggggagggtctttcgtcggccgccggctcgcctcggagggcctggaccactggaccgcccttccccggggccctgccgcgggaccgcgggcttctggctcctcctggggctgcgtccgtatgcgcggagcgtgtggccgggccgtcgccgcgccaccccacctgagtccgccggccagcgcggggacgcaccgggcagcgtgtgtttggcgaccctcccgcacctctggtctcagttgcgtgtgtgcacgaggggttccatagggcccagggatgcttggtacccacgggggagaatccctcgccgaaccctgcgggtctgcggggcgggccgcgagactggcgcgcaaaagcggctccaaggcggggctcccgcgctccccggggccggcttgccgagtccaagttgagcaaccggcgtcgagagagacaccgcccctgctgcgggcgggggcctctcctcgcttccgattggctgacggggggaacctatcgccgtcggccgcctccgccagagcggtttgctggttttcattcattggccccggagccgcccctggatttccatcttttgtggcgcgaaaataaccctttgctccctcgttggttttgttgaggttgaggggtgggactgtgttcccctctgctcgctctcgtttttcctgccctttaacagctcgcccccagccccaacccccaaggaagaaagagggaggtaacgctgaggaagggtggaaagcagttctgcgtccgtgggtggagcccgccccttggctgaccgcatggtgcccgcacggtcccttcccttcccccagcgtccagcgcccggaggttctggatttgcgccatgctcagcagctggagtcacatcttcgtttccctgcccatttccaacatcttagagttgatgcgtccttttttacttaaaacaactacaaccaaccatgttctcaggtaccagaacttttctgggcttctagagaaatcgactcgccctgcccgctcccttcctaaacccctttgtggtccacagggttgttttaagcaaaatcaaacaacccctccaaaaaaagcaaacgaaaaattccgggtaaaatcaactatgctgagaccacgttttcgttgaagctgccctaagaccaatgaagctgagaccgaccttcaaggattaacgatttctgtagctgaaatgttctaatttcactgacgtttggtggagacggtgagaaaaaataaatatgaatttgacttggaaaagcacaaaacaaacg

SEQ ID NO: 6521 - DNA, 357 bp, mus musculus
atgaacctggacctagcctcagactccttctgaacacagtgaatcaataaagtcaacacgtgagacaaaacttatttgccaaccctgaattaagccgttgtccatgaacagtgaagaagtaaggtttttcctcactgacagacaagtatctcctcgtacagtgaaaggctgtccccacccacagctaactcattaagaccagcgtgtggacttccgcatataagttaaatgctgctggacaacagcttctctaaaagcaaaacaacatgtttgaatcgttggttaatatatgtaggaagagctggtgctagggaaccactggggagagaagagccagaagaaagctgtctgttccct

SEQ ID NO: 6522 - DNA, 1226 bp, mus musculus
actgtgtgcagtcccagagaggatatcatcactgcccagacacccacagtcatgggggtgagcacgtggctcagacgaagatcattagaacaggcgttaatgacaaagatcatcagaacagacattaacgactggtccgggggtgaacacaagatcagagcagggtcactcagggctttctggattaatgtaaggatatcagaagaaagaaatggctgttttatctgaggttgaaaggatataaatttgaggatgttagcagttatctttcccattttctagaaagatgttgtctgtaaaatgaagctatgacaatgaagaaccgggaaccaagatatagcaaaagacagagagagccctgagagcattatgtgatcccctggacccacctacacctgaagctctagatccttccttggacttttcagttacatgagtcattcaatgcccttttgccttgagctagtttgagctaaaaaagtcctggctagtacagctgtgagtgttatgctgaagagtttggactgattgatataggactggaaagcctctgaaagtcccccattcttaagtggttagagaacagagacacagagtggacagaaagactatgaagagattaaaacctcttatcttcagcctcctaaattcacatgtcacaagatgaacccttaccaaataggagctactcagggctgggaaaaacttcaagtgggcacctggtcttccagcataagaggacatataagcccaacaacatgcctccgtggagctggaagggtctgcttgtggggtaacttcttaccatgccaacaggaccttccaatccatcatgtaagttaagccaataatactacagccacaatagaatgacatactttgctagccaaagcaagatccacacaaaacaatgacgagtttgagctagaaattattcccaatattgttagcaaaatctggatagtagatgtctcaccccagagggtgaaaatacctcaagaggagcaggtgatttctaaggtcaaggaacaaggcctgaaacagcattactgtagcaaatgtgaagggtctggttacctccctgtctgaaacccaagacgtttggaggaaaagaggtgctgaaatatctgcagttggtggtgacacctgagaacctgggtgatcctacctccctacatacaagggcagggatcatgccttttgcttcaaatagctttgaaccttct

SEQ ID NO: 6523 - DNA, 4302 bp, mus musculus
ctttggctttggggattcacgtggtggcggtggaaatttcggaccaggaccaggaagtaactttagaggaggatctggtgagtttcaagttctacgtgtttaaaggatgagtgtgcttttattttaaatatgattaggttttcattagtagaatcaagaaatccaacctaagtcaattttcctaagacttcaaatagattgtatcctggcaagctcttgtgatttggccagacaagaagttaatagagttgtattaataacagttgtatttatctggattaataatgtaacatgaagtgtcatccgaaaagctttgacccccatcaagtgtcattcttacgtataaataggatggaatctctaagattgagacttgttaagagtccaaaatttaggcggtagatttaattatatgctttcatgttttgtgggtaaactggtagcactggtgtgtccttttctgcggttcttaattattgtgctgaggtagtaagagaactgaaaatgaatattagcaataatgctgaacagtttatagtaaacgtaatctttttttggcccctaacagatggatatggcagtggacgtggatttggggatggctataatgggtatggaggaggacctggaggtcagttttcctctacgttttggtttgtttatgtgactaatacttaactatatcgtatatttacttcatttatattttgagtttttaaacattttatattagtgtctataaatggcttgggtgatagtggtccagttatttctaagtagttttgccatcttagctgttatagcctaaggaatagagtgccattttaaatgaaaatgtaaagataaccatcagagtatctcatcttttctcaagcaaaatgattggatctagatatatctttgtacgtgcttctctggaaaagtacagaatactggatttaacagagtaaaacctaagggggtggtatatgtaggaaaaaatatgaaatatgtctaaacccgtaactagatgggaagcatcccaggataactttcaaaaagcgtaacctacggaaatgttccaaaatgtttagtgtgctcctggctgcagataaggttgtgaactaccattaaacatgaagtgtgatatatcattggcgtacagaaaaggctgatacacactgacagattttgtaacaagggacatttaaaactgagctggtaatagacttgatttctggtgttgccactcaataggcatgactaaatagtgtatctcactgttctactttttataattaaaattttagaggaagctgagttcttgtatttaactacaagttagagactcagcccacaagctttttttttttttttaatatggtttcttttttttttttttttttgagacggagccttgctctgtcacccaggctggagtgtagtggcgcgtctctgctcactgcaatctctgccttcccggtccaagtgattctcctgcctcagcctcctgagtagctgggattaccggcgtgcaccaccacgcccagctaattttagtatttttagtagagacggggtttccccatgttggtcaggctggtcttgaactcctgacctcgtgaactgcccaccttggcctcccaaaaacgctggggttacaggcgtgagcaaccatgcccagccttttttttttttttatttttgttttgcagtatgtgaaagtgtaaatttttgtttatgtccgcacttctatttacagtaaagaacatactgtgtggagtgttgggtctgttttttttctttgaaatggggtctggctttgttgctcagactggagtgcagtggtgtgatcttggcttactgcaatcttagtctcaagccatcctcccacctcagcctcctgggtagctggaactacggggtgtgccaccatgaccggctaattttgtgtttttttgtagaggtgtgggggttttgctgtgttgccctggctggtcttgaattcctgggctcaagcaatccacccgcctcaacttcccgtactgctgggattacaggtgtgagctgctgcgcccagccaagaacattgtttcgttttttgagagggagtctctctctgtcgcccaggctggagtgcagtggtgtgatctcagctcactgcaacctctgcctcccgggttcacgccattctcctgcctcagcctccagagtagctagtactacaggttgctgccaccatgtccggctaatgttttgtatttttagtagagatggggtttcaccgtgttagccagggtggtctcaatctcttgacctcgtgatccgtccgcctcggccttcccaaagtgctgggattacaggcatgagccactgtgcccaaccgagaacattgttttaagatatgtaattcgtagagagacataatagaaactttatcttttgggccagtaggaggaagtgctcttttactttccctctagcccacactactagtctagcctcacagtccttacccacaatatacatgaagtatttcaagatacttaagatttttagttttgagggaaagctgtggaattacaggtatttaactgtgtgcacatggtgttatccatttggctgagtaaccccagccaccaaatgtttaccaaggatagttattcagtccttgaagctattttagaggaatttcattaaatatttcacatggaaacttggaaagctggaaatggatgtgaggagacagttcaaaatggtattgaaaatattaagtgattacttaaaggcttattttataataggtggcaattttggaggtagccccggttatggaggaggaagaggaggatatggtggtggaggacctggatatggcaaccagggtgggggctacggaggtggttatgacaactatggaggaggtaataaattcacctgcaacctttatgtgggaatttggaattaatgtctttgtaacacttgatcttttgtttccatgtttgtcactagatgcccataaaatttgtggataagtgtttgcttttatttgtttttatgggagctttgtcctaagtccttggtttaatgtttgtattgttctgagtattccaattttttaataggaaattatggaagtggaaattacaatgattttggaaattataaccagcaaccttctaactacggtccaatgaagagtggaaactttggtggtagcaggaacatggggggaccatatggtggaggtaatttataaaaattgaggttattcagatttttgtgattaaaggattagccttttgtgacttaaagggaagataacatactaagtagtttgtactgtgggcagtgctccatgtacggtcttagtgaaaataaagaaattttgcataaatctccacagaagtactcagcaagcagttatgacatcaaattgggattagggatgttggaggtgggggtgttcagtagtttaatttctggtggggactcataaacagctaaatacagttgcaacccacattgcaagtggtatacattggaatgagggtctttgaagttaaatccttaaaccatgattcaaaccattgcttagcttatttttgaggtttttagctaggagtaaactagctttgtcttgggcttgatgtacttttaaaaaaatcccttactcagtccaaatgaggatgagagggtgaaaggaccctttatttaaaagaatagggtcagccacgaaataaaaatgtctatgaacccgagtaatttatctcctgagtaattctgctaactggctgcaaaggattaggatctgcttgtttaaaagactggatggatataaaatagaatcaactgtagtgttaggctgatcatgggaaatcaaagtaagtttgttttctcttgctgttccaacaattataggaaactatggtccaggaggcagtggaggaagtgggggttatggtgggaggagccgatactgagcttcttcctatttgccatgggtaagtagcttttgagttttacaattattattatcttgggagacatagctgcaggagtaaaagctttttaggatcatgttatctttccttaaaatctggttagatggataatttcataacctattttttttttactctttacttctgttgaaacaggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatg

SEQ ID NO: 6524 - DNA, 1198 bp, mus musculus
ctcagactcaaaacagagaagtgacccccagccccacctttgtctcatcttccactccatccatgcattctttagatttcagctgttctcttccttcccagctcttctattctcttcgtcctcaccaggccaagaccacatatttcacacccctcccacaaaatgacagaactactcccacctctgccatcttccctcctatccacagggtctatgcctagccatctgtttgggtcctaaactgacgcttggagcatgtaacatccactaaggaaagtttgtcttaattgcctcccttgctgatcacaatgacattcaaaatccttcatcaaggttatcttcaaaccctcctttcaaactagcctctccctgtgctctaaacatgtctcccagaatccctgctctgagccaaccaattcaagtttcccatggaatgtaattgatacacaagagggagttggatgagaacatctttaaagccttctgagccctgtagatcatttgcagacattctacaaaactacaaatagtcaccgcacttactatgtgctaaacattacgttaattgcctttgttttatgcacattagctcccttaattctcataatagtttgatgaaggaggtagtattactatcctgttttacagacagaaaagctgagtcttggggaagataaattgtggctccaaggctacccagccaagatgagcaagactgaaacacagacccacatgacactgcagtcccgctctgggtgtcagaagagtgctgcttcccccagcttctgttagcctgtgttaaatgtttccaggttgatcctccagcctaccctcacccctatgctttctttctaaaacataagcagatgaaaaataaagcatgagtgcttcttccctaggatggcataccagaatcaccagatgacagacatcggggtgctgtcggacccgggaatcagaacctctgcagatagatattttggaaggcgctccctagattggcacctctggttagaaccctgcccagggactggacaagttgggcccatggctcatatctggccagtgttcattgctttgttgaatcacacttaatcctttggttttggtagattcctgcaagtagactgacagctgcatgtttgcaggaaagttaaatattttgacagcgcagaagactgctgcatctggagggttc

SEQ ID NO: 6525 - DNA, 996 bp, mus musculus
tatcaaagacatattgtagcatgtgcacagacacaacatcccactcctgctgttgttgtttgctttcatttggatcccaacccattctgggcccattaagctaatcacccaacaaattctgaactgtcatctcatcgtgaggctgttccatgcttgactgaaaaacctgttttcacccaacttccctggaagaagcctactgcagcccatttacaaatgtatgcatcagtaaatcaaaagtgacagcacagatctggcttttctgggagaggggatggcagagggagaaacccagtccttcccctctgtttcttaaatgatgccatatacacagctttatttgaaatgttctttaaaaataggtcatcttcaacttccttgatagctcattctctacatcggtgaaactttggctcctttcattttccaaagcctctacctgtgtttttctgtgagtcgagtcatcctccactgagccgagtgaaggaatctggctctcccagatgtttgcaggtatttcctcttcagttgtcactttgccaagtggagcacatgtgttctttaatttttcttcattaatcagtctccaaattcctttacacttgctcctcaggtgattccatcaaatcaacatatttctggagctaaaaatgcctggaagaatacagccttccagctgcagccatccaaacgtgtggattcgcgtatgttccctgcactccatggccatatgtttccacaggttcacttccaggagcgttctgtgtctccatttgcttccctgcaaatgcatacttagtctcatctgtgagttttctaactgagtcttaaggcatcaaaaattaagagcatattgataacagcccagtgttggtgagagagggtgtggggaaatgggcattcttgtacccgttgctgagaatttcaattgacctaacttattttgaaggccattttaaaataaaatgaccttttaaaataaaaaatacagagacc

SEQ ID NO: 6526 - DNA, 1355 bp, mus musculus
ggagacagccaagaggcaagtgtaaaaagagcagagatcagctcaagccaaggtcttgaggtgagcaccagcatggaaggctcaaggagtggaaagtctgggctggtcactaagggccttatgcatcgtgaggggatttgaatcctcaggattcaattcaaatggatgcagcaaagaatgacacaattaatgatacatcttttataaagattactctgtctgttgtgtgggggagggcaaggagacatgaaaaccacataagggaatccagaggtgatgaatgcctgcttaaggcatcatggcagcgatggagaagaggtgacagatttctgagaaatcaggaaaaacaacaggagtttgcaatggattggctgttaagaataaggaaaagggatgagtatgaggtgacctttacatccctaagcaaagatgtgacagctgcagatagtaaccaagttatgaaagtggatgagataaccttgatgggtatgcttgttttatgggtgtaaagaacaggaccagactcatagccccaaaaaaagaccccctcattttgctttacctccagggaagcaaaggggcacagggtgaatcagctctgtgctccaggtaacagtcacagttctgtacactgtactgtttaagatatcagaccttggccaacatggcgaaaccccatctccactaacaatacaaaaattagctgggcgtggtggtgtgcacctgtaatcccagctactccagaggctgaggcagaagaattgcttgaacccaggagagggaggtggcagtgagccaagatcatgccactgcactccagcctgggcaacagagtgacaccccatctccaaaaaaaaaaaaaaagaatcaggctttagaaaagaaggttagcaggtgcattctttttgagcatggattggaattggatatttgggtttctaaaaatgagacttggaactgttagatctcaatgtacctcattctagaacaacttgacttatgcacatatggggtgcagggaacactgtgtcagacctgacaggagaaagttagttttttaagcaaatatttcatgtctctcttttggattccaggttctctgtgttctcctacataaagatggcaacagtagaagggagacattgccattctggctgtccttgggattcagacttggtaatgaactgcaaacaccctggctgctgacgcctgtctgcccccaagttttaggagacaggggtaggctgagggctggggtgatcagcaggcttgtatgcctggaaacctgtgcactaattttcggttcaatggccacattggagaagctacttttaggagaccgcaaggctgaaatt

SEQ ID NO: 6527 - DNA, 1496 bp, mus musculus
atctgtgatggaggaagagtttctgcttgaggccatggaggggccaccagagctgtatatcccagacatggcctgtgccaagaccaccacgaggggagaatgcccaaggaaagacagccatctgtggcagcttctgccaatgccccatgctgagtatgaggtcaccagacccacagccacttccaaatatgatcatcctctggggtttatggtaacccacgtcacagaaatgcaggacagttttgtgaggcctgagggagctggcaaagtgcaaagccaccacaatgagtctcaaaggtcacctggaaatgatcatactcaagacaagttccttcatgttgactctgaggccccacgagaagaggaaagcagtggattctgtcctcacaccaaccacagcttactcgtaccagaaagctcatcacagtgtatccccaagcacagtgaaatcacaccttatgcaactgaccttgctcaaacatctgaaaagctcattccccacctccataaactgcctggagatcctgcccaggtgaagtcaaggtctggtactttgggtcagatactacctgggacagaagctgagatggaaaaccttcctctaaatactggcagctccaggtctgtaatgacccagatgtcctccagcctggtgtcggctgctcagagggctgtggccttggggactggtcccagaggaacatctttagaatgcactgtgtgtgatcctgttaccgcaacagaaacaagactggggacaaaagcaagacagttaaatgatgcttccattcagacttcagctctaagcaacaagaccttgacacatgggccccagcccctcaccaaatccgtctctctagactcaggcttctctagtatctgcccaatgggcacctgccatgctatacctgcccactgctgcatctgctgtcatcaccaccctcactgccacggggagaggcaaagccctggccctgaaccctcagtctgtaggcactgcctgtgttcactaactggtcaccaggaagcccagttcatgacgactttgaaagcccttcaggacactacagtgagggagctatgttccgtaagtgttcaccctggcaaagatggaaaggcagatgcacccgtgataaacacctcagggataatattcagacttccttgctgaatgcaagatctcagggcaaacttttctattttaaatcatgaataacatttgtagagtgctttattgtttatgatatagtatcacacatttcttctcgatacttccaatcaatcacctttagaaataagcaaagcaaattttatcattaatcatcattttacagaaaggaaaactaaggggtagagccatgcattcatatgtctaaggttataagcattaatgcatctgtaactcatctccagttctagctgagaagttctgtgtcttaaattcgtttagctatataatcttgcacaagccatttaatctttttgtaaaataggga

SEQ ID NO: 6528 - DNA, 1496 bp, mus musculus; identical to SEQ ID NO: 6527

SEQ ID NO: 6529 - DNA, 1496 bp, mus musculus; identical to SEQ ID NO: 6527

SEQ ID NO: 6530 - DNA, 1496 bp, mus musculus; identical to SEQ ID NO: 6527

SEQ ID NO: 6531 - DNA, 560 bp, mus musculus
atagagtctacacaaaacaatctgaagaatttgtaagaggggccaaggatatcacacaagaggatacttaaagaagagtcggatattatcaaggcagactcctttttcattcttcatgccgtgaatttcataagcttacagagatagtataataaagagtttaagaggtgagttttggaggctgacaggtttcggattttatctctaccacctatcagctgtttgaccttggaaaattactaattaacctctcttaactctaattttctcacctatagaatggatacaaatacgtatctcatagacttgtaaagcttaaatgagctaagtgtataaaatacttatgtagtgcttgatacaacatcaatgttctgcaaataattatgttttattattattgataattgataacatggccatgctaaaaaaagttattaataacagtaaaagcattatataaaattaaaagtaagcaattttatttaaaaatagatatctggttatgccttattttcttgataaaagcatgagctggtgtttttttattatcaagctttact

SEQ ID NO: 6532 - DNA, 560 bp, mus musculus; identical to SEQ ID NO: 6531

SEQ ID NO: 6533 - DNA, 560 bp, mus musculus; identical to SEQ ID NO: 6531

SEQ ID NO: 6534 - DNA, 560 bp, mus musculus; identical to SEQ ID NO: 6531

SEQ ID NO: 6535 - DNA, 560 bp, mus musculus; identical to SEQ ID NO: 6531

SEQ ID NO: 6536 - DNA, 800 bp, mus musculus
cgagaatggttaagttcccagctatgaggctgcaggccaaataatggtctcccctgacatgaattcatgagggtgggggaggcccaggtggaggtggggcagcttcccatagaaaggcctggaaggggcgagagtgaggacacacagacctgcatctgagctccatggataccagccctttaggcaaggacgaggtgagacgaggcggatctcttgtgtaaatcaagctaaaagcaatactgaacaattcaaacaaatcagtaagtccaacaaagttcatttcccatagatgacctatcaaatgcttttattacaataccaaattctttctctgcaaccattggttgccctaagaacatgcttgatcatctactgagcactgcccagagactccaagaacaaactacatgagactttgagtgtttctggagggcctgtgtgtggccagtgagtgaagcaaccagagagatttgggcccatcacaattattgaatatgataaaaacccacagggaaatggtctggggatatcttggactttatggcattttagacataatttgtgatggtctagagtttcctgaggcaatatttttctgcctcatgagccaaaggagtagacattcaagaccctgaactggaattacccctccactgtgaagctcccccatggcccctgcaagcccctcatcagtagtgagaccagtccttgctggggaaggcatttggcacagaagcagctgaaaactgcccctgccttgctctcaacactcacaacatcactgtgcacattctattcag

SEQ ID NO: 6537 - DNA, 1097 bp, mus musculus
catggtaggaactcagagttttttcttttctctaacagtaaccaaagaaggattttaagcagagacatgacagagggcaggggaaaatcagagtttgaggccaggcttcatgatgaccttccaaggtcaatcacagaggtaaagaggggatcctcatgtggaacaaggaggtccacagccagccagagaggcagccctgtcccctgagagagctggctctgggtttgcagtttatttctgggatcctgatgtcagttgttggtctagatccaaatgtggccatatccaaaaaatgtttaatccagtcagggcactttttcaccattatttcacccattcagttaacaactcatgaccactatttaaaaattatatgctagttttgaaagaaattcaaagttaaaaacaagtccacaaatgactaaaataattaaaacagagaataagacaacaaaggtaggactgaaaggcacctgtaaagctttttgagaaaggagctgagaatgtcccgggggcctgaagggcttgaaagaaaatgcagtctgtgtttacacctcaaagatgtgcaagactgtgtgagtgggggtaatattttgggaagagaaagcgcaatgaagatatataggtgaaatatctaagtagcatcaacaaataactgttgttaatgttgtttaaaaaacaattccctggcttcttgtatttggaatggattgtctccgtggaagcagaaactacctctctcttaccttctttcaggttttcctgggatcagctgcactccttagcaaaagtatattggagaatcaactgagaaagtaactgagacatttcaatcatttctaggtgtaaagaaagaccagatcccaggaaaatattacggtcagttcaatgcctaagtataacaccagcatcactggctgggaccctcagaacctactctcctattttcccttcatcttcttctcttctttctttttcttattccttttctttgtttccccccttctttctcttctctcttttcctccctcactttcttgatctctcgctctctttcatgaattcactgaatcattgcagaagtacttgacacatac

SEQ ID NO: 6538 - DNA, 148 bp, mus musculus
aaactttaaatactgatctgtattattattggatatactgacacaaacttaaaggccaaattaaccaaaaattcattaactttgggatctctgtagaagactttaatttttgaagaaagtgatggagctagttctaacagacgttgcc

SEQ ID NO: 6539 - DNA, 1110 bp, mus musculus
ctatctcaagagtcttaactttatcacatctgcaaagacccttttttgccacaacattcagaagttgcaaggattcagaagtggccatctctgtggggcgctattctgcctgccatggagagggagatggaaagatctcgaaagatcatttaagccttgctcaggtatttggaatgtatcctgagtgcagtgaggagtcaccaggggttttaagagtctgtggaggtgggctcgagggtcaggagcagaggcaggatgtctggttaggacaccactgcaacacaggggcccatgcctacaagtaggaggaagccttgtgctcccttttgggattgtggagaggctgcagcttgtggccagtcttaacgtcagaagttattccgagcactccctgagcctcctggtgctttgacttaactcacactagggcctctaaacctcaatgtcaaacattcagggggttgtgttctggcaagaggtgcaactgtttttgtgttctcttccttttgcttggaaaagaatgagagcgcataaaagctctcattattgataattattgattatcaatacaaaatctcacctttttcaggagtatttctgattgaatgagtaacatagtcttaggaaagcatcttggttgggatttcagatataaggaagcagttggagggagtttgggggaaatagattttcctgccctctgtgggcaaagtctaccctgttctttggagttttccaaatcccagctcacacccagacatctgaacctactcagtttgatgaggaaagatgaagaggccagcctaaagctctgatttatatttattctgcaagatatcaatggcctcattttactaaagtctattgcattctttgtatgtcttaaacacagttccacagaattttaatgctttccacttcaacccttaaaacttatctatagttccaaaagtatatatcttaatactgctaggaaggatgaaatatcatggtcttaaatttcttttctcagtctcaaaataaactatcaataataaccataatgaatatttgtattatttttaaaaaagatgtttacagatggaaatttaggaatgccacgaaagaaga

SEQ ID NO: 6540 - DNA, 116 bp, mus musculus
agacatgagaatccagctgtcttctattgatccagacagtaaagagatttgcaaaatgtaaaacaatgctacttttcttctatatttttctgttttgaaaaacagtagtttcccat

SEQ ID NO: 6541 - DNA, 2662 bp, mus musculus
ctgaggagtaatcattgtttcaaataatttatcttttaatgattttagcatttaatctggcaagtaaatatgacctgatttatgctttgctttcttttttttccctctaaatctcacatgaaaatgtatcttgaagtaggtaagtttgaactataccaaaactgaaaaaaaacatagccttaaagacataaggagcaaagtatacattttccattagcatatgtctccctaatcaaaaaatgaaactttattagcatctttaagtttagttggtaatgaagtatttagcacgtggtgtgtgcttggtaaataaatgaatgacaaataagatgtggtcccgtagtcaagatgcagcagtgtagctgtgcgctaactggtatatattgcaaatgtggtgcccagggacaaaacatacttccagcatgagcaccttatggttaacatgataaccatgttagtttcttcttctcctcgtttttataacaagatagtcatttcaaatctgtaatatagctatttagtgatttctgttttcttttgccaaatgttcaactgttttacctacttatgtaaaaagtgctgccacaaaaacgtcaacattgtttcacagtctgttctcacaaagccatttctctctacacatttatttgtgtttttactggcaattgtaggtgaagttagcataatttcttaccaaggcagtttagccaaacaaacaatttaattatctgaagccataaaattatgatatacccagattgttttctccaaatactttttcctatgtaagggaaccagccattcttggagaaatcaccaattccagatctgactcctgcatctagaaataaaaaagataagcctggattatcttgaggatacaggggacttgcagagacttctctagctaaatgtaagacaatttcagcatcaaaaataatgactgtaatgttttgaaacatattaagtaggtaaaaatatgtgatttcaagtgatgttaaccacattggtcatctttggaagtttctagggcaccatcacattctgaataagtagtaaagacatatataattaagtttttgaggggatgatatgtacacattaactttcaggtgatatttgtagaagaattccagctaaaaagtacagaagaaatgatagaattagataatcattttacaaccccaatgagaggctggatctaggcagctataaaaattgcctgctaacatcattaagtgaagattgatggggagctcaataatggctggaccacgctgaccacactagaatctacagacttaatcctaacatacagcattacccagaatggaatatctatcacgcattctgggcaaaataattaagccagcatctaatcaaatcttgtcatttgattatcagtttagaagaaatatgggaaattaaggaatatgtgaaatgacatcacaaggaagtaaccaaccaaatctagaacataggaggtgcaacaggacaaataatctggttattttaacaaacaaatggcataaaagaagacaggggaagggagactcttagaaatgaaaagaaaaccttagagacttatcaaccaaatgcaacatatggaacttatttggatcctgatttaagtaaactaaccatatgatgtttttaagacaaacatgagactgtaaatccaaactgagcattagatgacattgaggaattgttcattttgctaaatgagatggttgtactctggttattttaaaaattgtacttattggactggagaatgatacaaggtatttatggaggaaatgatacaaaatatgagattgctttaaaatactctagtcatcctccccagaacatctgtgggtgaaagataaaacaagattgtcaaaatgctgataattatttaaactggttgattaggatttatatgcctattctctctgcttttgagtataattcaaaatctctagaataaaatgcttataaaatttaaaaggcattaagtaagcaaaagtaaaaatcaattggactacatttatttgtttcatttcccttctggtaaggaaaatatcttaaatccctccctttttgttctctgagaacagctctggatttctgggcctctgctcttggatatcttgatttatcatcctatatatatatatataagacacctagtttaaaaccatactacaaacacccaaccagacaatctgcagtcacatctttataattggctcaagggtaaaagtagcatgaaaactagggactcattccaacaataatgaaagcatttctctgttcactgctgtggcttcaatgactgtgaaatttttccatttctggaaatcacatcagtaagagaagtagagccaagaggctgagagcaggggcacctgaaggggccaagcttctagctctggctttgccactgaaaaagaagttgttctgtaaagggtggaaattcatagtgcccaatgcagaggattattgctaaaaagaagcacatttagcttagagcctgatatagagtaagagagtaaggcatggtgcacatactaatgtaatataatctgtttttactaatttatggtgtttctgaattcatctttatactccttccaagctcattccttccttacaatcaaatttattattctgg

SEQ ID NO: 6542 - DNA, 523 bp, mus musculus
ttttttttttttttgcagtttttacatttatttaaacagaaaacgtgcacacgagctgtctactcattttcttcgctgcgcagcctggcattggggttggtgactctgatggccagttgggcagctgtttccacgatggctttgcggttcttggaggaaacattgtgagcgatctcggcacagtaagatttgttgcacatcagcagcacttccagctccttgatgttgtggaccaggaacttccggaagccactgggcagcatgtgctttgtttttttgttgctcccataaccaatgttgggcatcaagatctggcccttgaatcttctacgaaccctgttgtcagtgcctctgggtttccgccagttacgcttaattttgacatattggtctgactggtgctggatgaacttcttggttctctttttgacgatcttgggcttcacaaggggtctgagggcggccatgatgccgaggaggagatggctgccacctccgtaggcagcgccgaggaagagagcct

SEQ ID NO: 6543 - DNA, 1552 bp, mus musculus
ttttctggaccgctctacagtaactgtggttcccagccagagcggcatgaggaggactgaggcctgactctcttcctgcgtccacgtccccacgtccccacgcccccacacccctgcaacagtaaggccctgctcccacccccgctgcgtcccgcccggttccccgtggcatcgctgcgctgccctgccctggtccggctctgggctacgggcagttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcggtgagtgcgccctgagcgcgtcccggccagaaagagctgggtgcgtgcactctgcttgctagacacgctgtggacccaacgtcctctatgtgggctggaggggggtgtgaacgatggaggaccaagtgataaaactaacaagtcaaagaaagccacaaactgctcctgtgcctgagtgtgaaatcaagacttaaatatgagtggggggagtcttgtttttctttattttcaacaagagagaaccaaggctacctatcttggttcaatctggagcaacaggatcccttggaaattttctttgtcatagttcaaccctatacaattctcacaactgcgttcctgaatgttgacc

SEQ ID NO: 6544 - DNA, 446 bp, mus musculus
gattatagagtgacttttgtttattgtactctaaatattatcttccttcctataaaatggtttaatgcattattgttgatgtagaggaatattatttgtttttgtatgttgatcttgcattgggaaactcttctggattcatttatatttgctgtgaaataggtacaggggttagtgggggcgagaggaagggtacagtcatggtatgaggtactgtcaagccaaagcacaaaggatatacttatgctgagtctccaaagatgaggaggaatttatatcaataaaatcacaaaagaatgatgctgtgtgctgctgtggcgtggttagggcagagggtgtgaaaagaggtatagtgagatatatgcaaaagatcatggagagtagggccagtaaatcatgctgaggagtgaaaatttatggggtaagcatttattaaagaagttagg

SEQ ID NO: 6545 - DNA, 1113 bp, mus musculus
tcactataaaagatactccattatgcattttcaaattccattttatttttcacttgtatttgtaaatgggcacgtgttataaattctttctcttttcctttcggtggaagaaaatttgagaagataacagggcataggatgtctgacttctctcatacaagatgtagtaattaaactccattcctcttcctcagatgcaatttaggcacatttccaaagaaaagagaaatagatttgattggatggagtagttattaatgaaccaatcagtttacattcatgaaatgtgaagaagaggaaatatttcctattatgcttcttgattcagctgtaactgctgggcaacacttcctgcttggcttttctttgaccctaagtatgtgcattgaaacacccagtggtctccaagttggagattcttaagtttagccttacagcataatgagcacataagcactcccagtgtctctggatctgatgttcccatgacacacaatactgtttgtccagtagcagggctgctcatatttcaagtatgagctgtgatagcaccttccaaataaggaaaaggataggcaggctgtgcgttgtgaaggcaggtgttgagtttcaatccataaggaagaacttttgggatccctggtgtcaagtatgccttggcatccttcccttccggaaactccagatacacagggcccatgcagccgttgcatgttccattagcgaatgttttcctagcatggagagccccgcttctgagcgacatgtgtggaatgtatactgaactcttgtttacattttttgtgtttaaatcttgcttgctgtacgtatggaccatattgaattaaaagagtattacatgaacaaattgagctgcaatggcctgtaaattgtgaaaaggcaaatagaactgaagggtgtggaccttgtttactggcagaagcaatggagtttgaggtcagaatggtttgacacacagcttgtaattttcaggaatggaaactaaggcacttgcttaaaacttctgatgtgatttttcttaactataaagtagggataaacaataatgaataccttatataattgttatgaagcagcaaagttttatagact

SEQ ID NO: 6546 - DNA, 292 bp, mus musculus
atatgaagttgcagaaacatctagaatttattatttataaaatgaaagcaaaactcctaagtctggtaagacactgcttatgccaaatgatgcaagcttgaagggtacatgacaagaataaaaatagcactgaaactgatcaagacatttgatttgatccttttctactccaaattcagcttaaacaaatcagcttgacctaatctttgcacaaaatatgactgcactttattattattactatgaaaatgcccctgataccctaaaaatcactatataagtgttgccattt

SEQ ID NO: 6547 - DNA, 321 bp, mus musculus
ccttgccttcgtcttgtcttggccaaccttcaggcccagggtgcactcaatagtcctgcaatccgtttttagggggtcaggccatgctggtaccagaagttggatagggccaatttgtaaggaattgtgagtcctgcataccaaaatgatttctagaagggaaattggaggcttggtgggccaggtccttggagccaaggcatatagcttgaagcaccagacctagagcagggaaccctcttgccacatttctaaagacagtactgatcctaatgaccaaaacacaaacaaaaacacaagtttataaggataatggaataa

SEQ ID NO: 6548 - DNA, 322 bp, mus musculus
cgatttcatcctctttctatcatgtcataaaaattctgctccacacacataaaatattttccatctgtttgctaaaaactccaaaattccatacttttcacaacttgttacctttgccttgaattttccccatatgcctagcacaatagtactcaacaatccaaaattcacataaatacagcaatatttggaagcttattctcagtcatgtattttgttttagggcctccatgcctaccttcctcatgcacataagcaatatatgttgggcacatttaaactgtaggacttactgttatattttgtgatgtaattttttgct

SEQ ID NO: 6549 - DNA, 793 bp, mus musculus
agagacaggagagagggtggtgaggtggggaaggagagggagaaaggaggagatgaggaaaaggaaaatagcgggaggaggggagaggggaagggggtccgggcgagggagacctagttgagcgagaggcggcgcccctgcgagccagcaagagaatctggggccaggagcgcggggcgggacggcaggcgggatggtggccggaacaaaggcgcgaaaattcgtcccggagcacttcaccttcactcacgccggccgccccacccctggcgcccgcccgcctcacccctggcgcccccccgcctgcccgcccgcccacccacctccgggcgcgcgtccgcacgggtcaacccgcgaaaaagacccggcggctcccggccccgcctccagagcgcagcatccgcgcggcagggacagcgccgggacagcgccgggacagccccgggacagccccggggaaagcgcggggacggcgtggggtatgccagggacagcgtggggtatgccagggacagcgtgggggcggtgcggtctgggcctggacaggggtggccacgcccctggtcgctcccctgtccccaggtcaccctgacggccctgcccggagccgcgaaggctatgctcgcgtgggagcgggtggtcgggcgggcctggcgcgggactgagcgttcgctccttgcccgcaggtggagctcttgcccgacagagacccggacagcgacgggaccaagatcagcgtgagtgcggggcgcgccaagggccgcgggcccaggctcgggacgcacagcccttc

SEQ ID NO: 6550 - DNA, 1301 bp, mus musculus
ttgaacatccttaattttagtaagattctcaaagtgttctctcattgaatactaagaaacaaagttagagattctgttttattttaaatcttgtggaggataagaattttgtattttcaacattttctcctttccctttagtaattcaaggttatcaaggactctgatttttcaaaaaaaaatctttcagaaaaaatattttgaattagttacacttcaagtcccccctttcctttaatctgttgtcaaaaatacagatttatacctgtccagttagggcttacatgtagtagaaatataaacatgtcctgagaagaaaatatgaatagatcctgttcagattttcatagtgctcatgtggtttcttcttggtctgagtgagagaactacagacaagtaaatgaaggcaggttaacatttctattcagatgtctgaaggggctttgggggcatttttctagagattttctctccatggcagcttgagtgtggtacagataaagattccacactggtgtgcttcatgacactatttatactggaggtcctggagtctgaatcctgccagccacacacaggagagagccagagagtcagcctccaacgccctcagtgccctgtaagggccttccagggactgccttaggcttattcttttctcgtagcaggggctagctccccagctcgctgacttcagtttgactccattgacggtaaatgtagcagaaattatttcactttcttaaataagatacctattcctaatttccaacattgatgaagattttcggcatgtgaaggaatctcgccagtcatttgaatgagtgagtaggaggggacaggacccagtcacactttccgtcttgaaactggcttgcccctttgttatcccgtcatggatcccgtaccatgcaaactgcatttattcactaaggattccactaacatgggaagaaaagtatgcattccctgtcactgtggaggactattagacagttctttttttaagttcatatttcttcaattgaatttgacctctaagcaggaagactctcataaaactggtttttctcaccgctgcttgaagtagtagctgtctgagttaggatttgttcaagtaatggaatcttgactgtcttttatgttatctttagtacacaggctgaaggctttatctttatcagtgtcatgattctaacaacaaaatagctctcgctaacatatagtgacaggtaaatcatttaaaaacaattgtacaaaaagtttcttccagttgtgattatctttcttaatagtaattc

SEQ ID NO: 6551 - DNA, 1104 bp, mus musculus
cttctttctacctaaaatgcagtggtgataactggtgactgatttgtaagcaatctcaatgtaatgataaataaccttttcctttctctactagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaagtgagtagaagatacgttttttattttgactctatatttagctaataatgatctatacatatgt

SEQ ID NO: 6552 - DNA, 1038 bp, mus musculus
gtctacttcttagggctgacttgctgagtcaggacctcagcctcctcatctgtaaagtggtggggttggacccagtgaccctgagggtccatttgagctcaaatgtcctatgagtctatgattttttgacttcagagtccagaaatctcttggatcatgtcccctaaggagatgccagggttcctttccagcttgcaaacctgtttttcagccacagatgggcctccagggcagcagggaagccgggagccaagaggctgccttgtgcgagtgagcgatctgtgcaaggatgatttgtgagggcagagcggagggcagcagggctggggtttcccggggctgctggcgcactccgacatctgctatttttcactccagtgagactgatttgctccagatgggcccctgcagactgtttttggctgtgctgggaagtgtggcggctggctgtgtttcatctctgagccctctaagagacagcagagcacgtgttaactgcttcagctaaaaggccagcagattctacaagagggccccagttccaaatgatcccttctgagcagatggatttttatttccctgaggcattactctcacttcaaagaaaggtctgctctggatctcatggaggaatacctggtttggtgggccttagttaggaaaaatctttcaactggagggaagactgttttattgggttaagtcagatctttgggtcagtgtctgtggttcttctccagctaacagaactttgactttactgaaggggaccctaccacctttcgtagactcaagctttactagcaagaccactttaggaagcttcctctataagccttagctgactgagcccttcccttgggggccaaatctggtgactttctgagtctttatttcacaaagctgcttgacagaggataaagacttccttggccaggagtcaggaaacttggtttggaagcatgaacctgttgcttcctggctgagtgatcttggatgggttatttgactctccagcacctccatttcatttgtaac

SEQ ID NO: 6553 - DNA, 715 bp, mus musculus
ctcatatcctggggctgtaacatcccttcctccttttttccttgaggacccagcctccctggcaacttgctttcaattcctagaatttccacgtgggaagcagaactaacctctagactcctgctgcgggagatagagaggtcacatgcggagcgggggagttctttgcaagtatctccaaggagacatttaaaggccatcccctaattgcagcgtgaagcttgcagcaggtggaattcctgactttcgccagaggatggcactgtgggtgtttccaagaaggagctgagcttttttttttttttttttttttttgaaaaagccatttccaaatggcagtaacagctgcacttcaaaccctgcagggaacattagaaaatgttaacccccggttgggtggggaagaaggactggaggcggacatggggatcgtgaccgcggaggccagccccggaggaagggcaggagctagagaagtgccaaaaaggagagagaaaaggaaactgcagggcaacctagctgtggctggggactagcgtccttctctggtggaggttgagcaaggacaagagccctagctggtggggatttgttttccagagtcgaattcaacctgggaaaagtagcagggtgcagcggggtgcagcgtatacatgtgtcatttgccaactttctccgtctgtacccactttggaccggtcatttaagagctgac

SEQ ID NO: 6554 - DNA, 1170 bp, mus musculus
ctgttaccttggaggttgctgcaggcccgtggctttccacaaaattctgcacccagcctgggcctaggagcgaggacttattcccagggcgactgctcgtattcgcgcacggcgctgtatgatctgctcggcgtcccctccacagccacgcaggcccaaatcaaggcggcttactaccgtcagtgctttctctaccacccggaccgcaactccgggagcgcggaggccgccgagcgcttcacgcgcatctcccaggcctacgtggtgctgggcagtgccaccctccgtcgcaagtatgatcgcggcctactcagcgacgaggacctgcgcggacctggcgtccggccctccaggacgcccgcacccgaccccggctcgccgcgtaccccgccgcccacctctcggacccacgacggttctcgggcctcccccggcgccaaccgcacgatgttcaactttgacgccttctaccaggcccactacggggaacaactggagcgggaacggcgcctgagggcccggcgggaggcccttcgcaaacggcaggagtatcggtccatgaaaggcctccgctgggaggatacccgagacacggctgccattttcctcatcttttcaatcttcatcatcatcggcttttatatttaatcggagagagaagggaaggggagtgtccccagccaaccccccagaaacggccttttttcctgcctctgaacccttggccattgatagtctacctttgctgggatccgaaggaactgtactccccctgccctccccgacccgcccagcttagccgatgacctgcacatcgctccactgtggtccagaaaaggaggcctttcgatgtctgagaaagaggccccacgctgtagagtcccgaaagcccaggagtgaagggggttcctggagtctctagggtgcttcttccagagtctgtcttcttgcttccagatgtggtcaacttctggaacactcgctgtagctttattgtttagccccaagcaagatttatctcctcctgccccgcatgtgtatggtgggcctctgtaaccttgaaatgtgcaatgtgaccaattgttgactaccaaaagaaaaggtctggggttgtacgaaacttgtctttctgtgacttccccaagccgcaggtgagacctggtccagggt

SEQ ID NO: 6555 - DNA, 337 bp, mus musculus
catggtgttttggactctctcactatttttttttttattctttatcactgaagaaagaatgaggcctatagtagtatatagaacaccttattaaaatgaatcatttacacacatcttttatctaaaaacaacattcaataagtgtgaattgaatcaaacctgttgggctgggataaaagatgtaaaatccaaccacgtgattctctcagataaatgccacaatacacattcctgaatatgttggatttagtaatatggtgcatttagtaaaagtgttttgttttttcctaataaggcctttttgcttgaggaaacaaaatgcagaaatttttgttgt

SEQ ID NO: 6556 - DNA, 1443 bp, mus musculus
ttttttaatcttgaggaagggctataaaacagcaggcaagggttctcataggattaacatttctattttaactttgccacctactgcttacatccaggctgtttgttcaaagcagactgtgtaacacagtcaagagatttttgccagttttccttttgcttctggagttatgaaaatatttaagtgtctaggtcaggttcagagacattctgtaaaatttatatttttagcattatacatgaatcagaatgacgtggtttttgatgaaagagtgagagtattcttatgaatgggtgttagaggtttaagatgatttaatgctattatgattttttagtgtagggtcaatacatgtgttctgctaacattcttatatagtgtatactgtttcatgcttcttattagcttccgtttaactggaggagtactaagttggaacattggttccaggaagtcctctgaaagtgtggagttttgaagtgtgtgtcacatatgtgaataaagctttaaaatgcttgccttgtagcattagaggataactgccttcatagtaactaaccagttctggcagttgcatctcttggaatggcacacttaatgaactgcagagccaggaattttgatttttaaagaactccttaaaataccccatgtaaaatttgatagctggagcagtgcatgtgagttcagaaacgatgactgtcagctagaagttgtgtgtgaatgtcactctgaggatgtctagacgtctcctttgctttggcgtaaggaaaaaaccctttgtaagttactgatttttaataacatcgtgggtcactgctttccaaagcagaatgtggaaacttctgagagtttaccatagattctacagggattttcacagcaggaaatactaatggaacagagtggaacgatggctgaattgatgggagatagatgataagtcacggtgtcatgactacttgatcatgtagaagagtagcaaagagaggtatgtgaagagacagggaaagaaaagaacatagccctgagtgaatgctaatctagaggcaaatgttgtcatttacattttactctaaaaagagaacttattaaaaataaaaatacagctcattgctgaaaaaatttgtttcaaaaagcagcattatttttctttaagctactcttcagagacctgttattttaaggacaacgtaaaatctcatgtaatgattgtataaagatatagacatataatgtgtcatatatatgttaatatatatgataattggttctagtctgctcaaattacccatttactatttagtattctggcttaggcaaataaatatatatttacagatttctaaaatattttattactattataatgatgctaattaaatttatctgcagtgcttatctttttccagtaatgctaaataaattatttcatccaaccct

SEQ ID NO: 6557 - DNA, 769 bp, mus musculus
aggaccatttttaatgtgacttattagtaacttcattatgtgtttgcgaatgtctacttgtgtgatataattttgcctctcccctatgttgtagatgattggttcacaaattgaggcgtcaaaaataagaacacattcaaaaggttagcataaatcccctcgctagtgatagcatgagaaagtgtgggtatgttacatgtgaggtagtggtgggacactactagaagacagacaacttaaatcttattcccctcttatatgaatttattgtgtgattttctgtgtgacaaagtttcaggacctctatcttttcatttcctcattcacaatagaagatagtatctattttatttaacatgtaagatgttgaggggatgaaattggattgtaatatatatgagatagtgtgtggaaaaaaatattgtgtaactataagcaaccatgagtaacagtaatgagtagtaatgtttatgtcatttaactgtactttattctttatatttagtttttaattgacatctttagattttaggtaagctactaattgcacacatataacttgtgctaatgtgttttatggtttgatgcctttgtatctgattctttttaatatataacaaagcaactaacatagtgaccaacacatagtgaagtactgaatatatatttgaatacactttgtaagttacttataggttatagcatattgaaattaagctctttcaagactctctgtcctatctttgcaaatgcttatacttaatgtgtg

SEQ ID NO: 6558 - DNA, 1045 bp, mus musculus
ctcctaatgggaaaatgctatcacttctcttaaattaaaaatttttattaactgttaaaatgtgcctcaacacataatctaaagttttacagacacggagtttcagagcttctatttcttttaaatatgtatattttacactgccttttttttaacctgctagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacaatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggctttttttcctaataccaccacctaacagagaacacaggtgaatgcagatgttcactttagcagacttaatgtttcctatgagatttcactgtacaggtttgtctttcttctttgcctgagaaataaaaatgtcatttgccatattgccatctaaaggagaaaaactgcatcagcaaagccattgtattgaactaaaagtttaaaatgaactgcatggatttactaagctgatgaatattccaaaacgt

SEQ ID NO: 6559 - DNA, 1480 bp, mus musculus
tcaggggcaactcggaggacaagccgcactgccaatgcatcctctaatgagcacttgaactcctagcatgccctaggaaacaggtggccatcaaaacaaacctccattttgcataaaattaactttttatttcactgtgtaaatgttttgtgagactatgtattcaacaatttttgacaaagtaagttttatgattatttgacaattttttttattttgaataaaacagttactggaattcacaaataccaatgtttttatctgtagattctgacctatttttcagaggaaagaaagcataaatttaatatctgcttatattttaggacactttattttttattttttattttttgagatggagtttcactcttgttgcccaggctggagtgcaatggcgcaatctcggctcaccacaacctccgcctcctaggttcaagcaattctcctgcctcagcctcccgagtagctgagattacaggcatgcaccaccacacccagctgatttttttgtatttttagtagagacggggtttctccatgttggtcaggctagtctcgaactcccaacctcaggtgatccacccacctcagcctcccaaagtgctgggattacaggcgtgagccaccgcacccagccaggacactttaatacaaaaaacaataagttattattacgtatttgcttttgtttttccattgcttagtggttttgtttgtttggtttttgaccatgtttattgtcaatcagtttatctttgactcatgtatagaattttttggccagaaaattatatgaaacctttaagaagcattttagagcatagacaaagatgaaaaagattttcaagtcatccaacttacatgaggttgtaatatcaccaataaaaatactggacagggccaggtacggtggctcacacctgtaatcccagcaatttgggaggctgaggcaggtggatcacaaggtcaggagatcgagactatcctggccaatatggtgaaaccctgtctctactagaatacaaaaaactagcgaggcgtggtggcacacacctgtagtcccagctactcaggaggctcaggcatgggaatcgcttgcatctgtgaggcggaggttgtagtgagctgagatggcaccactgcactccagcctggcgacagagcaagactccgtctcaaaaaaaaaaaaaaaaaaaaaaaacttgaccaaaagtaacactagaagcaaatatatttatgaatatccaaatattccaaataaaattatacaatctatcctattaaagaattttcttagctcagttcattaacttaatatttaaaatgaaatatgtgcttttccaagtacagtgttaaaaattagataaaatcattgtttttctgatcaatttaaatatgttagctaggagaagaagaaaatgttcttaacatagtgaagaaagggttgaatcccaattaaagttcttaatggataaaa

SEQ ID NO: 6560 - DNA, 985 bp, mus musculus
ttattccttaaatttttttcctggatactggacaatcaattatttaagatttacgtgctttggatgtgttggttccagaattgctgacaatgctagattggagaggcaataaatgctaagtcgcatacaaaagatttgaatgaagctgttatggttatcaacatcatgtctgaaaatgacctttttgatttgtttttaaatttagatagttgtatgatacaaggaaatgagatgactaatttatatttaattttatatttaaaggaaatttgagcatttacattctcttttaaagtaaatgctatgtgtatctgtctctgagcaggtctttgcttcaaacttttggctgacactagttggtaaaaacagcaaagggactacctactaaaggaatgttcaatctagttctcctgacagtcaaaggattcgattatcattttctaagtatcacattctttttgttcaatcactatgattcaggaacaatcttcaaagttgactttgaaatactgaaacaaagacaaaataggaaacacagccctaaatctgtcctagttaacagtattaccatcatcagaatctcctccccgaattttgggatgagatcagacaaggctagggagatggccaaatgtagaatggtaaaatgctttgtctcctagaactcatcaaaatgaaaagaaaacttgaccttcagtttcagtgtccctttctgtaaagagtattagcactttaaatagcatactgaattccagttaggaattgtgtcttatgaactgaatgatttttcttttcaaaggtattgataacaagggtcatgaaggaggagaatgtgcttattttttcaactcactgtcaaatctcttccccattttctagattatgttcctttttttgattgatggacctattatatttctgggaataaaagccaaacacacacatcatacagaggtttgctttaggcacacaaattcaagttctg

SEQ ID NO: 6561 - DNA, 762 bp, mus musculus
gtgcactgaacccatgcccctgttatcctaactacaccccacctataaatgcctattgacttactgatttatccaatttggattcacaatagacaattcttgacaatggatgacttaacgattactttaaatgtgctgagagattacttaaaaacgtttggaatatggcttctgccataaattcactcagattattttgaaacattgattttaaccttactaatttgttaactaagcagaagaaaaatactatccccaatggcatagcatgaggtaggtttagaagtagaaacaggacacatcccatgtacatgacatagtttcctgtagatcgtctcatatagcttaaaatcatgaagaaagtgagataattacactatctacaaatcttgaaataatttctaactctctcagtgacaaatttctctctttcccttaaattccagatgctactcaatatgggtaattattggaatactttcttttgcccttaattaagttttctacttttagatacccatttaaaatttagtgagtttaaataatttgaaattatgacaacactaaatttgtatgtaaagataaattagagattgagtacacctgttatgaccaacaccacatctgtgggtgatgttctgagtatttgtaattacaaggcctaagtcatgatttcatacttaaaaatagaagatgtttaaaaaatgaaaatggcagatcagtaaagccatgtttttaatcgatattttttatttaacattt

SEQ ID NO: 6562 - DNA, 129 bp, mus musculus
agattaatgttgggaaccttcccaaaatctaagttctcttatgccagccaaaggccaatcttgtaagcaggcctttcaaaggagaccagtcagatctgggtgttaactcttttctatacaccctatatt

SEQ ID NO: 6563 - DNA, 5619 bp, mus musculus
gctgaggcacaggcaggtcatggctctggactttagagctgataggtcttggagctgggattcaagctcagacagttgtgctccaaagttgtttctctttctgttataaaacaaagagttcctctgatggcagaatgcagtctgatatcacatgatctgtatcatagtggaaatgagaggtcagagcagggctgactgccataactaacatttaggacagggatatatgtgtgatgaacattctgagattcccaggagttagggcagggactcacacagatcagagtggctctggttgtcagtaggcccagctacctcaccaagtgaatgatgaagaaggccccagatgttggtcattgccactaatgctttgtcctttacctctctgctatctcttcagactctttatcccatttttggggggttccctctggaaaatcttttgggccagctgtagtacctccccagccagtgtctgtaggggacaaacctcatgcgaggcatcctatcaggctcccggaggcctatttctggaggtacatcaggatggtgctgacccacagggttctattgtggtctggctcaagtaacgttggcccctgccagggaatacattctgtgccaatgacttcctttaatattgtactttgggggtctcccccatggtgttgactcttcccctgagaagatggaaaaatctaggacaaaatataaaaaaaggagaaagcattctagttaacagtgtcattatttaatgaggtatttgaaatgtcccagaagggagtcttagattgcttttaggaagaagatgatacaatctgatcctaagctaattcatgcaaaccacaggttagcacctttgaagtgacacatgagatttaagactcttggagttctgtcagaggggccaaaggaaggggagcagatggaaatgaattatgtgtggatatggcagattttctgagcaaaggtcagggatgtgatacattttctaattcaggggtggctcatgagagggacagaagtaggtagggaaagtagtggatctgcaccaaccagtccacataatattgaaaatcaacttccacctgaacacacttctcaagctgctatttagtacttcttatataacaagtatcattctaacagctctaaatacttgatctaatttaatgctgtcaataaccctgttgaattatccctgttggatagataatgaaacccaagattcagagagatcaagtaacttgctcacagtcacacagcaacagcctcctaaccaatctccctgcttcaacttcttccattcttatccaactatagtctacattcttacagaagtcattctgacctctcataaataaaaatctaataatgccaacccttacttaaaactcccaaatggcttctgatcatacttggaacaaaatctaatcttttatcatggattaccaaactctgtatgatctaactcctgatgacctttatggccttatctggcatcacagtctcttatgcctgtgtgccctggcccagtgggcattcttgcaattcctggaatgttttaagctgattgcctctgctcttctcttggctgactttacgttattcatatcccaaaattattacctcttcagagaggccattcctgacacctgaattaattcatgatacttcgcagcccttgatgtttctttcctatttctttgtttattggttaatggtgtaccatttgtttattgattaatggtgtatgtgacattagagcccacacttattctgactgcatgatgtcaaaacctgctcataacctctaccctgcctgtgatctgtgctctgcagtttttcagcacattattgtggactagtgagcatttttataaaatacaggtgacccttgaacagcacgggtttgaactgagtgggtccacttatatgtaggtttttttcaataaatgtattggaaaattttttgaagacttgcaacaatttgaaaaaactcacaagccatgtagcctagaaatatcaaaaaattaagaaaaagttaagtatgttataaatgcataaaatatatgtagttactcgtcttattatttactaccataagatatacacaaacctataattaaaaaaagttaaaagtgatcaaattttatgcacacaaacacttacagaccatataagtcaccattcacagtcaagacacatgtcaacaactgtaaagatacagtgttacatgttttggctctgtgtcctcatccaaatctcaccttgaatggtaataatcttcacatgttatgggagggtcccagtgggaggtaaatgaatcctgggagtgggtttttcccatgctattctcatgatagtgaataagtctcatgagatctgatgattttataaaggggagttcccctgcatatgctgtcttgcctgctgccatgtgagatgtccctctgctcttccttcatcttccgccatgattgtgaggcctccccagctatgtggaactgtgagtccattaaacctctttcctttataaattacccaatcttgggcatgtctttattagcagcatgagaacagactaatacatagtgttaaatcataaaataaaaccatagtatgtactgtactaccccagtaattttgtagccacttcctgttgctactgcagtgagttcaagtgttgtacctgcttaaaatgcagtgacactaacaatctcagcaggagcagttcatctctccagtaaattgcatattgcaataaaaagtgatctctcatgattcttgcgtattttaaaaatcatgtttagtgcaataccataaacattaaataacaccagggaacccatatcaagtgacactagtgttgctggaagtgctcccaacaagcagagaaaagtcatgacattacaggaaaaagttgaactgcttgatacatactatagatgtgaggtctgcagctgcagttagttgcctgccatttcaagataaatgaatctagcataagaaccattgtaaaagaaaacaaaacaaaacaaaaacaaaattcgtaaaagccatcactgcagctacaacagcaggtgcaaaaaccttgcactttttgtacaatacatttatctcatattgaaaatgcagctttcacatgggtgcaggattgctgtgagaaaggcatacctatagactctaatatgattagaggaaaagcaaagtcaattcaaattaaaagtaagattaaggatcagagctgggtcatttaatgccagcaaaggatggtttgataattttagaaagatatttggctttaaaaaaatgtcaagatagcaggagaaggagcttctgccaatcaagaggcagcagaaatgttcctagatgctattaaaaaaaatcattgagaagaaaggatatctgcctgaaaaggtttttaatgcagtcgaaagtgccctattttagaaaaaaaaaatgccacaaaggacttttattaataaggaagagaagcaagtccaaggatttatgtcagaaaggagtaggctaactctactgttttgtataaatgcaatccggtttaggatgagtccatatctatagatatgctcttatgtgtaaagctgttcatccctgatccttgaagggaaaagataagcctcagctgccagtattttggttgtacaacaagaaggcatggacaatgagagcactttttccggattggttacattgatgctttctttgttcttgaagtcagaaagtacttagacagtaacggactgccttttaaagttcttttgatattagacaatgctcctggccacccagaacccatgagtttaacatcaaaggtattgaagtggtctgcttgcctcctaaacatgtctctaattcagcctttagatgagggggttataagaatctttttttttttaataaattttttgtagacatgaggtctcactgtgttgcctgggctggtctcgaactcctgagctcaagcgatcctcctgccttagtctcccaaagtgctaggattacaggtgggagccactgtgcctcgccactcataaggatttttaaggctcatcacaaagcacatggtactctacagaaaggattgttaatgctatggtagagagccaccagagagaagaacatcatgcaagtctgtaatcctaaaacgataaatttctgctggagaaaactgtgtccagatgtacatgatttcacaggatttatgacagagccaatcaaggaaaccacaaaaagaaataggagatatgaaaaaaaaaaaaaggtggtgggtgaaggctttcaaggtatagattttggagaacctcaagagcaaataaacatcacaccagaggaattaacagaagatgacttgataaagatgagtgtttccaaaccactgccaaacaatgcggaagaagatataggagaagcagtgccagaaaactaactttacgcaatctggcaaaagagtttcggttattcaggactgcttttaacttcttttatgacatggacccttctgtgatacaggcactgaaactgaagcaaacagtggaggaaggattggtaccatattgaaacatttttagagaaataaaaaaggaaaaagtcagacagagaccacaatgcatgtcagtcacaccaggtgtgcctgcctttcccgcctccccttccacttcctctgcctcttcccctctgccacccctgagacagcaagaccaatccctcttcttcctccttttccttagcctattcaatataaagatgatgaagataaagacctttaaatgatccacttccgcttaatgaatagtaaatatattttctcttccttgtgattttcttaataacattttcttccctctagcttactttattataaaaatacaaatatgtattacatataacatacaaaatacatgttaattgactgtttatgttattggtaagacttctggttgacagcaggctattagtagttaagtttctggggagtcagaagttatatgtgaattttcaactgcacgaggggtcagtctccctaacccccatgttgtccaaggctccattgtagatgcttttttacttttcagaaataaaagccataaacttgtttatttgagggtaggaagagtaatgtcaggaggctattttttctttctagaaacatacatttttatttcttcaaaattatttagtacacaacagtttccgagggaaactcgatgctatttgttcttggattagaaattctctctcctgatggtgattactgagtctccatttaaaactcttggaataaacaaagctgtgaggatgcggggtgctaattaagccttttcctaattgcttcattgtgcgtcaagatgaagacagtcctgaagttattatactgttttactcaccacttttaggtctgtgactcaaactcccacttttattcggctatatacacactaaaaagcaatgacatttacaaaccaatctcagaccagacactcctgccttagaacatggtgcacagaaaatatttcttaaaaccattacactgaaatatacagtaaaatctgtttttcagcagacattgttatagtctgttgaattttcttacta

SEQ ID NO: 6564 - DNA, 120 bp, mus musculus
tgaagtttgaaatgaaattggaaattaatatttttacctttactcacatgcacattcagtcttcatttctctccattgacttagcatttctcttcatttaggaaaaaaaatagatttgtg

SEQ ID NO: 6565 - DNA, 120 bp, mus musculus; identical to SEQ ID NO: 6564

SEQ ID NO: 6566 - DNA, 134 bp, mus musculus
aaatctgagatggcattgtcacttttacaactctatgatgcttaggaatttcctttgtactctggtaatttcttcatggctcttatctcccctacaatatattgtgagctagtgaaagggagagcttctacctt

SEQ ID NO: 6567 - DNA, 788 bp, mus musculus
gcacaggtcccacctgatacgtagcaaggtgcccaattaatgtttattgaaatgaatgattgcataatctgcccaaattccacagattactggctgccactttcatacttttccttaaataattacttgagaggaattgaatatgggagaggaaaatgaaaagaggagccaaagggtttgggagaattaaggcacccttgatagaatcagtgacactgggaaaaaaaaaaacaaaacaaacaaacaaaaaaaaacttggttcaggaggaagaggaagataaagaacatcagagctctgaaagttccctcccttgaggaacaaagctccctgtgataattaatagcagctacagaattttccatcagaacagcttgtatcttttggcccacaccattcaatggctgcccataaacctgtcctatctgttcaaaaatcagagtcaaacctcagctgtgctgtgctgtgctgtggttctgtttgcctgagctgtgaatcttaagatgttggtctgaactttacacacacctgttctctcatagcttctctgaaccctaagttttaacttgtgtgtactctacttttactagtgccctcctgccacccttggccgtgagctctctctctgaccctgctccagtgtatgcctcagagccttgtaatatccagcctagtccatctacttggacttcagatcacacctgtatcactagttctcctggataccttagcatctgaggtaggcagcctctaagatggccccaatgaactgcctcctaggatctatacc

SEQ ID NO: 6568 - DNA, 4882 bp, mus musculus
aagcctgaggggaaaaaaataagttgaaatatactgtttgccataaacaagaaaattctgtagcccaaaacaacagtatggaagagctcagtggatcaataaatatttgtgtgtaaggcattatgcttggtactgaaagaaattcaaagatgattcctaccctcaaggagtagacagtctggtcagggacatagacacttacataattaactactataatacaatgtaggaagggtttaataccagaagggaggatgacaataacagccagcattactacactttctatgtgcttgatactgttcgaattgccttacctgagtgaatttatttaataaataagcttgcgaggtggatactaatactagctcctttttacagatgacaaaatggaaagagagagtggttaggtcacacaactcgtacatgacagtgagccactgagcaaattacttttgactgctgcaggatgcaagagggcctcctgggaaagttggcatttgtgctggatctagaagaataggtagctcttgaatttgtagaaggttgagggagagcattccaagtagaggaaaaaaacacaaagtctgggagatggggacttgtgaagcacatggcaaatgtattacccaaaatcctttcactgattttaattcagagagtggagtgtattttaaagaaaacccttcacaaaagaaagcaggaaagatcaaaaattgacatcctaacatcacaattaaaagaactagagaagcaagaactagaaaagaactagaaaagcaagagcaaacacattcaaaagctagcagaaagcaagaaataactaagatcagagcaaaactgaaggaaatagagacataaaaaatccttcaaaaaatcaatgaatccaggagctggttttttgaaaagatcaacaaaattgatagacgtctagcaagacgaataaagaagaaaagagagaagaatcaaatagaagcaataaaaaatgataaaggggatatcaccaccgatcccacagaaatacaaactaccatcagagaatactataaacacctctatgcaaataaactagaaaatctggaagaaatggataaattcctcgacccatacactctcccaagaataagccaggaagaagttgaatctctgaatagaccaataacaggctctgaaattgaggcaataattaatagcttaccaaccaaaaaaagtccagcaccagacggattcacagccgaattctaccagaggtacaaggagaagctggtaccatttcttctgaaaatattccaatcaatagaaaaagagggaatcctccctaactcattttatgaggccagcatcatcctgataccaaagcctggcagagacacaacaaaaaaacagaattttagaacaatatccctgatgaacatcgacgcaaaaatcctgaataaaatactggcaaaccgaacccagcagaacatcaaaaagcttatccaccatgatcaagtgggcttcatccctgggatgcaaggctggttcaatatacacaaatcaataaatgtaacccagcatataaacaaaaccaacgacaacaaccacatgattgtctcaatacatacagaaaaggcctttgacaaaatttaacagcccttcatgctaaaaactctcaataaattaggtattaatgggacatatctcaaaataataagagatatttatgacaaacccacagccaatatcataccaaatgggcaaaaactggaagcattccctttgaaaactggcacaagacagggatgccctctctcaccactcctattcaagatagtgttggaagttctggccagggcaatcaggcaggagaaagaaataaagggtattcaattaggaaaagaggaactcaaattgtccctgtttgcagatgacatgattgtatatctagaaaaccccatcgtctcagcccaaaatctcctcaagctgataagcaacttcagcaaagtctcaggatacaaaatcaatgtgcaaaaatcacaagcattcttatacagtaataacagacaaacagagagccaaatcatgagtgaactcccattcacaattgcttcaaagagaataaaatacctaggaatccaacttacaagggatgtgaaggacctcttcaaggagaactacaaaccactgctcaatgaagttaaagaggatacaaacaaatggaagaacattccatgctcatggataggaagaatcaatattgtgaaaatggccatactgcccaaggtaatttatagattcaatgccatccccatcaagctaccaatgactttcttcacagcattggaaaaaactactttaaacttcatctggaacaaaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatcgaacagaacagagccctcagaaataatgccacatatctacaactatctgatctttgacaaacctgacaaaaacaagcaatggggaaaggattccctatttaataaatggtgctgggaaaactggctagccatatgtagaaagctgaaactggatccctttcttataccttatactaaaattaattcaagatggattaaagacttaaatgtcagacctaaaaccataaaaaccctagaagaaaacctaggcattaccattcaggacataggcatggacaaggacttcatgtctaaaacaccaaaagcaatggcaacaaaagccaaaagggatctaattaaactaaacagcttctgcacagcaaaagaaactaccatcagagtgaacaggcatccttcagaatgggagaaaatttttgcaatctactcatctgacaaagggctaatatccagaatctacaatgaactcaaatttacaagagaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaagccacaatgagataccatctcacaccagttagaatggcgatcattaaaaagtcaggaaacaacaggtgctggagaggatgtggagaagtaggaacacttttacactgttggtgggactgtaaactagttcaaccattgtggaagtcagtgtggctattcttcagggatctagaactagaaatactgtttgacccagccatcccattactgggtatataccaaaaggattataaatcatgctgctataaagacacatgcacaagtatgtttattgcggcactattcacaatagcaaagacttggaacgaacccaaatgtccaacaatgatagactggattaagaaaatgtggcatatatacaccatggaatactatgcagccataaaaaaggatgagttcatgtcctttgtagggacatggataaagctggaaaccatcattctcagcaaactgtcacaaggacaaaaaaccaaacaccgcatgttctcactcataggtgggaattgaacaatgagaacacatggacgcaggaaggggaacatcacacactggggcctgttgtggagtggggggagggggggagggatagcattaggagctatacctaatgttaaatgacgagttaatgggtgcagcacaccaacatggcaaatgtagacatatgtaacaaatctgcacgttgtgcacatgtaccctaaaacttaaagtgtcataaagaaagaaagaaagcccttcaaaccttaacttgtcttttatcctttacattggtgattgccatattcatctgcctagctcctaagggagaattcagaatataatccaacaccccatcttcattcctaacccacaccatcaccactccccacatacccagatcatcgtcctcctctccattctcacaaccactgcctcagtttaaccactgcccttgtgacgtcccacctataccatgtggtagcctccagccttgagtctctaaacaatcgaatctagtctccacatcaatgctgagtatctttctaaaatgccatctggtcaaagtgctcccccacctacaggattaattcaaatttgttattgaggcataaaaatccacttgtgatctatcccctgcctacctttccaatcgcatcttctgacattttcccaaaggtatcctttattccagccacagtaaaatacttgttctctgacaataacatgttctctatagacagctttctaccctgaaaacctgtccccaccttatcccctaccctttcagcccttaattctactctgaaaattcctgttcaggtgatttagcctgcattatttttgtggaagtctttgatgacaacccaatgcaagttaggggatttttttccccctgggctcccatagcatattatttgagtccctattttacgatttcccacattacactgtattgtttcttcatgtctcattactctccagattgtaaactctttacagggaggtgccttgagactctctttacctgtatttcccactgctcactccatgtttgataaatgcattagtcattggattctgaatgctgggactatggacatagccagctctagcctatcttacctactctctcctttaaaggaaaccttattactttctctgctggacctgtttctaaatcaaattaagatagcaagataattatatattattgtcaatactacacataactttgtattatcatttttaaagctgcaagacagagaagctagcttaaagtgttcaaaatctggtt

SEQ ID NO: 6569 - DNA, 782 bp, mus musculus
aactagacattgtttctttatttttgaaatgttattgaaggaataccatttggagaagatacaaatgtaagaattgtgaaaaggataattgtgacacaaatcaaaattatagataaaaatatacctgtaaaatgtattaaggcaataacattctttctgcttgttgaccataaatatttatattccctggatgggtacattgttattgtcaagggtgtttaaataatgatcttgcatgcataatttattctctctggtataacagaatcagcaatttagttttctgggacccgagaaaaacatgcaaaagacatactttgaaatgtaaaactgatttttccttgcaactgtaggtccttctagatcctatggtaaaagaagaaaacagtgaggaaattgactttattcttccttttttaaagctgagctctttggggtaagaagttatggccaaactagcatgttagacatgtttttaacactatatctggcagagttttcaatgtaaatattaaagtagatgttaatgtcaataagtgatcttaataatgcatcagtagatattttttcaaggattgtctctatcttcacgcctagcttataatttgccttgtcgtctttttttttttctctttatttttatgtttttatccatccctggtggtaggggataaccttgtcttcttcgataacaagaagtctgaagcttattagaaattttactttgagaattgatcgatgagaagaaagcaactagatatcacgtggatcatatatgcttg

SEQ ID NO: 6570 - DNA, 4056 bp, mus musculus
ccccgcttcaccctgtcaaaaccccaactctgggcgaccctgggtttggaaactccgccgactcccgacgacacgtcccactctctcccactaatgccgcttattttagtcgcaggatccccctactacagtttcagcgaaagccggaaattttcatttaactctcccccccacccccacccccaccgcgcccttctagcccccgactcgtagaagggagctagggagcccggagctcggagcactgccgggactcggccgcctcatttctctccggaaggctttaatttgcacactttcttgccactgcgccacgagcccccagccccgccggggggtgggtctccggcagagttggcttcgcgggtccctgcccccaccccgcacggtcgccccagctgcctccccggctggggcccccagcgccggccggagcccagcggcccccgtccgcccccagcgagcggcgcgggcggcgccctccgccgtccctccgccctccgccgctgtgcccaccccctcgccggagagagtgctggtaactccttccccagagtctgattacctgctccgcgaggccgcggacacgtgcggagagccgactgacactcgcagccccctcgggaggcccgacgcgactgggcccctcaggtgaggagctgtgcgctcgggtgggtgggctgcggggtggggggtcccgggggagatctgggggattggccggggtccgaggcagaactgtgggtggggtaagtggagggtggcggggggtgggggggacctgtgtttccttggaatcggctttggttaaccccttacgaactgagacgggattggttatgggggccagttttggggagctagaggattctccttatctgatgagagggggagatcccagcctagggacacccgcgacaccgagatcctgcttccacgtatccgtacgcacacacacccacacggaacacgcctcatacagtttctccaaacggaactggaactctactcggacactcacataataattcacatttagggtttaaaatgcactgcctctagggactccatgctggagaatgtgcttgcatttccccctcgaaaactccctctccagctcgctgaggtgtgggtgtgggctccaccttcccctccacgagataaatgttaacgcaggcttcctgcgggcgtgttatacacagaaaagtgcacgcagccggccagtgcccaggcttggagccccgcgaagacgcacgtttgctgtagtttccaagtttacttttataatttaaaatattggagttaaacacacgccccgcagtgagcagccctggtccccgcagcgcgcccgtccgtgtgcatatgggcgcatctgcgtgtgcgcacacgcgggagtcgcggtccccggtgtggcctcttgtcgctgtgctggtggcgacccttgtggtgcttggcaggcttcgggagaggcgcatgaaggatttcattgagtgtgaagacagagagcagagacagaaagcagaaggaggcggctgcagcctttgtagtcgcggaggaatgcggaaatgttgaagcactatgtcaaactttttttgaaatggggtcaagtcacattcagccagcgtgggaaagcaacaacaacaacaaaaaaaagtggaggagagggggggaaaaggcattgctgctcccgtttctctccgccgaagccgaccgtctggggggcgagtggggggagagccagggcagtgcggggcccggcgggggcagcaggcgcagttccctgcgggggtgggacgtccccgacgcttccttcgctgcggagcccggggctagactcgagcgggagggggttggggggatgcaggacaggcgggttgggcggccggcggcggctccccggctacctgtgtggccctcgacctggctcagacccccgggcagtccctgggggctctttcctcggcttttaaggaaagttctgaatgtagtgagtgccagaagctctgctctcgccgcggtccgctccacccgctcatcgtgggggtcgcgccgtttgtttaattcctggcaaaaggcgagcgggccagcggttgcgaggcaggtaattccgaggtgccccgggaattccggacatgcggccgtcgtggtgaaagtcctgccgaggccgcggcggccctggaggagggaggccccctaggtcccagatagctgctgaatggggagggaaagttagggtaccctactctggcgctttgttgtgcagagggctccgggggcgtccggctgcagactggaccgggcctttagccggagggggaatggggcagccacctctgctacctacagcggggaggtcctgggaatgggaaaaggttcgcgagtccgggccccgaggacagagaccttctctctcacccctggaggcgcaggatttaaccccccaccccccaccctttgaaagggaggttgagttttgctcaggtcgaaatcagtttaaaacttaaggacgaggcgcgattatgctatccccttcctgaagttattctttaaggagacgacaagcgaaattgtggcgaacacccctttctcccacccttgggatcccgtgggggacggtgtctcccctcccccaggaccgctcgctcgcccacccccgataagccccaaccctccccgaccagatggctggtcttcccaaggtttccaccagggaggtcctcccagccggagagagaattccgtttccaaccgagactcctttaccccaaaaagaccatttgtgtatgcgagtcgtttttaaatgtctcctcgtagaaaaactgaaagtagaaagaaaggaagcaatttctgagcagatgtctgaccaccccttctcgcacactcccagcatcgggttacagggtcctgggagcccccacccacattctgcggccccacacggatggacccacagtccttccgctccagcttgtgcgcgacccctgaacgccctccggcacccctggaccccgtctccctgcacgtccgggcctcaggaggcggggagggtagcggcgcaacacaatgatatagggataaatattaagccgtgacattgacgtgcccggcgcctcccctcccccgcgctcccggcacactctgggctgctcggcacgccccctcccgttccactgcgtcccgcgccgctcgctcatccccgaggggcccctgcaacctctccgcgcgaagacggcttcagccctgcagggaaagaaaagtaacttcgcttttctcggaggaaccaggaaggattaagcggcttgggagagggcaggagcgcgcggagggtagcgatggaggcttcgtaaaggaggaggaggggagtctggaggaaccccgaggaaggcttctgggctgtctgattgcactttcttcttatcctcccgtctcctcctttaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggtgagccagggagctgcg

SEQ ID NO: 6571 - DNA, 4056 bp, mus musculus; identical to SEQ ID NO: 6570

SEQ ID NO: 6572 - DNA, 4054 bp, mus musculus
tccgtccacgtcacacagtgaggatgccccccgcttcaccctgtcaaaaccccaactctgggcgaccctgggtttggaaactccgccgactcccgacgacacgtcccactctctcccactaatgccgcttattttagtcgcaggatccccctactacagtttcagcgaaagccggaaattttcatttaactctcccccccacccccacccccaccgcgcccttctagcccccgactcgtagaagggagctagggagcccggagctcggagcactgccgggactcggccgcctcatttctctccggaaggctttaatttgcacactttcttgccactgcgccacgagcccccagccccgccggggggtgggtctccggcagagttggcttcgcgggtccctgcccccaccccgcacggtcgccccagctgcctccccggctggggcccccagcgccggccggagcccagcggcccccgtccgcccccagcgagcggcgcgggcggcgccctccgccgtccctccgccctccgccgctgtgcccaccccctcgccggagagagtgctggtaactccttccccagagtctgattacctgctccgcgaggccgcggacacgtgcggagagccgactgacactcgcagccccctcgggaggcccgacgcgactgggcccctcaggtgaggagctgtgcgctcgggtgggtgggctgcggggtggggggtcccgggggagatctgggggattggccggggtccgaggcagaactgtgggtggggtaagtggagggtggcggggggtgggggggacctgtgtttccttggaatcggctttggttaaccccttacgaactgagacgggattggttatgggggccagttttggggagctagaggattctccttatctgatgagagggggagatcccagcctagggacacccgcgacaccgagatcctgcttccacgtatccgtacgcacacacacccacacggaacacgcctcatacagtttctccaaacggaactggaactctactcggacactcacataataattcacatttagggtttaaaatgcactgcctctagggactccatgctggagaatgtgcttgcatttccccctcgaaaactccctctccagctcgctgaggtgtgggtgtgggctccaccttcccctccacgagataaatgttaacgcaggcttcctgcgggcgtgttatacacagaaaagtgcacgcagccggccagtgcccaggcttggagccccgcgaagacgcacgtttgctgtagtttccaagtttacttttataatttaaaatattggagttaaacacacgccccgcagtgagcagccctggtccccgcagcgcgcccgtccgtgtgcatatgggcgcatctgcgtgtgcgcacacgcgggagtcgcggtccccggtgtggcctcttgtcgctgtgctggtggcgacccttgtggtgcttggcaggcttcgggagaggcgcatgaaggatttcattgagtgtgaagacagagagcagagacagaaagcagaaggaggcggctgcagcctttgtagtcgcggaggaatgcggaaatgttgaagcactatgtcaaactttttttgaaatggggtcaagtcacattcagccagcgtgggaaagcaacaacaacaacaaaaaaaagtggaggagagggggggaaaaggcattgctgctcccgtttctctccgccgaagccgaccgtctggggggcgagtggggggagagccagggcagtgcggggcccggcgggggcagcaggcgcagttccctgcgggggtgggacgtccccgacgcttccttcgctgcggagcccggggctagactcgagcgggagggggttggggggatgcaggacaggcgggttgggcggccggcggcggctccccggctacctgtgtggccctcgacctggctcagacccccgggcagtccctgggggctctttcctcggcttttaaggaaagttctgaatgtagtgagtgccagaagctctgctctcgccgcggtccgctccacccgctcatcgtgggggtcgcgccgtttgtttaattcctggcaaaaggcgagcgggccagcggttgcgaggcaggtaattccgaggtgccccgggaattccggacatgcggccgtcgtggtgaaagtcctgccgaggccgcggcggccctggaggagggaggccccctaggtcccagatagctgctgaatggggagggaaagttagggtaccctactctggcgctttgttgtgcagagggctccgggggcgtccggctgcagactggaccgggcctttagccggagggggaatggggcagccacctctgctacctacagcggggaggtcctgggaatgggaaaaggttcgcgagtccgggccccgaggacagagaccttctctctcacccctggaggcgcaggatttaaccccccaccccccaccctttgaaagggaggttgagttttgctcaggtcgaaatcagtttaaaacttaaggacgaggcgcgattatgctatccccttcctgaagttattctttaaggagacgacaagcgaaattgtggcgaacacccctttctcccacccttgggatcccgtgggggacggtgtctcccctcccccaggaccgctcgctcgcccacccccgataagccccaaccctccccgaccagatggctggtcttcccaaggtttccaccagggaggtcctcccagccggagagagaattccgtttccaaccgagactcctttaccccaaaaagaccatttgtgtatgcgagtcgtttttaaatgtctcctcgtagaaaaactgaaagtagaaagaaaggaagcaatttctgagcagatgtctgaccaccccttctcgcacactcccagcatcgggttacagggtcctgggagcccccacccacattctgcggccccacacggatggacccacagtccttccgctccagcttgtgcgcgacccctgaacgccctccggcacccctggaccccgtctccctgcacgtccgggcctcaggaggcggggagggtagcggcgcaacacaatgatatagggataaatattaagccgtgacattgacgtgcccggcgcctcccctcccccgcgctcccggcacactctgggctgctcggcacgccccctcccgttccactgcgtcccgcgccgctcgctcatccccgaggggcccctgcaacctctccgcgcgaagacggcttcagccctgcagggaaagaaaagtaacttcgcttttctcggaggaaccaggaaggattaagcggcttgggagagggcaggagcgcgcggagggtagcgatggaggcttcgtaaaggaggaggaggggagtctggaggaaccccgaggaaggcttctgggctgtctgattgcactttcttcttatcctcccgtctcctcctttaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccc

SEQ ID NO: 6573 - DNA, 4054 bp, mus musculus; identical to SEQ ID NO: 6572

SEQ ID NO: 6574 - DNA, 2378 bp, mus musculus
aagcaagtaaagggtcttcttaggcctagagaatggcaatattgacaacatatgtacctaaaagtatgaaaggaaaatatcagagtttgatatttttggtggtttgcttcaaaaataccaataaataaattgcaatgcagtgagagattattttttaatctgatgacagtgcatgacttcaattgggtcagagaaaactagatgttcagattggaggctgaggcttggatgagaggggataaagtcctgctccagggtggcaaaggtaacaaaagaaaggcatagatttcagagacatcatgaaagaagatgcaggctcaacaaagtatcctgagtatctaccatgggataggtgtcatgctaggagcctgtgtggttttctcattgatttgaaggtgacaaactgaggctctgagagactaagtgattttcttagcgtcacagaactaataacagatttaacgtggggttctaattccaaggccagctttgatttttaaatatacctcaactacctctcttggagtcaatgacaaattggacgtggaagaaagatgaggggggaagcaagataattgagagcataataataccatgagaagtcaagaagtgaacatgcactagcatgcatatatatacatgcacacacacacacatacacacacatacactgtcccatcctccctattatggtctgaatgttggcatctccctcaaattcatacgttggaacctagcacccagtatgatagtattaagaagtgagagtcttttgggaataaagttacgagggctctgtcttcatgaatgggattagtgcttcttataaaggaggttgaagggagccgccttgcccatactgccatgtgaagacgaagcaacaaggtgtcatctgtaaagcagagattcctcaccagacactgaatctgctggtgccttgatcttggacttcccaacctctgggactgtgagaaataaatgtgtatttttgtaagtctgtaagtcagccttcaatatgagcatccagttttctctgaccctattgaaattatgcactgtcatcacattaaaaaacaatctctcactgcattgcaatttatttactggtatttttgagcacccagtgtaaggtattttgttatagcagtctgaatggactaagacactcccaaatatataacaacatacagagattctctagttaatatccgtaatcacacagaatccataaatctcttatccgacagcaatgttttgaaataaacttgtgtagtatgcctcccaaaaagaaccaaatacaaatagatatagtaaaggtatatggccaatttttatggaacagttaccaaatcatagccctgtggttacatgcattatgtcatttaatcacaataaccctgtgagggtcttatgaggtaggtattctcattgaacccattttacaaaaaaatgggagatgttgcttctagctagtgttctctgttcctatctcctaggtacagtatacattttttagttgttcacctctttttctctgttatttattttacctttcttcctgcagatttacccttttagaatatgcccatcaatttttactaccagtcccaaaatagagcttctctttttagctccccccccagtcctgagcatcttctcactccacttgggaagctgaaaacctcacaggccatgttttatggatgcctggacacccccagtgtgggcaataaagctctttatacagaggatggaattatggctcaatatctatttgggctggctgttcctggaaccagagatagtttatttatgactaacgaaaacttactaatctgtcttcaagtgacaagtgacagaaacccagccgaaacttaagcaaaggaaaaagtcatttggttgactggaactaagaagaatcaaagaggagctggaatcagacactatcccaaatctctctctgtctttctctctcttcccatatctctctctcacttagaggattgtcaacaataagaaaaatacaacctatcttccactggcttaagaaataagtccttcatttccttcaagtgtttgttcaaatctcacttcttcagtgaagccaaattctcactttattcaacatcaaaacctgtccctttgatcctagcattcttgattctttttgccatgctcctcttatcaatttttttctgcttactatttcctaacatactatagaattttcttacttaacgtttttagtttattataatctctcttggctagaatgtgagttccacaagggtagggatcttgtgttttgttcactgagctacttcagacacctagaatagggtctgggacatggtagatgctcaacaaatatgattgca

SEQ ID NO: 6575 - DNA, 1519 bp, mus musculus
agttttatctagaaagtgtgctgtgggggattttggaatcctcctctggggcgagggcttggggagtagctttggcactcccaaggctctggggtcggggagcattccatgtaccgtggtgttcatgactcaggcaaaagggaaaccccagaattaccacaaagctatcccaatcctggcttggcatcaccaatcagctaaaagcaatgttttcatttagcatttaggagtgcacgtttgtgtctgtgtatgcgtatgcatatttttaagaatgaattctcccgattttcatctttgcaaatagattgggggttgggggtagacggccggtaatgcctattagaacttcaagggattggttttcacatgagagagcttcagagatgagaaatcgctgaaattatctggtagcagcttctgagggacatttaccgtggattcacttttacatttcagttcatttgaaagccagtatggttaaattaaccaaaatctaaattaaaaaaaaaattccacgattcttccaggcctacttcacatcatcaaaccaggccctgctggaggccccattaaaatggcagctcccactgagagagagacaaaagccccctctctgaatggggatgctgaaacagtgatggactctcagaactgcttttttttttttttaatccattaaaaaaaagttacctctgcattgactgtgagagagtatttatttcgctctccacactgtgggaaacagaggcgttctcccttataaggacacccagaccttcttgggagaggagagaaatatgaatccataacatggctgaacaaattcctcctcgcaactgaattcatggaatgtttcagacgtgaacagcttaattttggtgtggtctgggacaaattaatatgactcaaatcccacctcacagaggaagcatctcctgatgaagtgggtggggtgagtacactcacttccttcaaaattctgtctaacaatcatctctattaaatttcaatatgtctcaccctctcccccagcaagaaaaaaaaaacaaatagggaaatcaagaacaaactaaaaatatatctaaaaagcctaactgcaaagtgttcagcaaatgattatgtgaaattttaggctgtatgaatgataatgagtttgtatacaacagaataaaagcttctagagggtagtccagaaactgtattttgggagtgaatacattaaacaagatcactcttctaggttctcatgaaatcccagttatcgttattccaacccggaaggcttagggatgaacaaggacatatcattcttttcttccagaggatgaactggacttttcaccttagcatttaatcggacaccactcttttcccatagaggtgctcagtctctagcagggaaggccatttatacatgaaaatgaactgtaatgttatcctctccaggactaaatttatttacttttgtaaaatgggaataatttcttcacgctttcaaagtggaaaaatgattgctagc

SEQ ID NO: 6576 - DNA, 911 bp, mus musculus
atggtgtaagtgattagtgtaatgtcaagtatatacgtgtcttagctgctaatttaatttgtaaatgctatatagagacaggcactgagctaaacattttcagaaagtgataattatcttgctattgtggcttcactaggtatggttcagacctgtgctgtttaacataatatgttggtatttatgatctcatataatctgtaaattttttcttgatgttttagcatcaatatataatcagctaaggatattttaagtatgtgagttggagacaagcttttaatttagtcctctaataaaactgtcatttcctatgcattacttttgcaatatagtaaaaatacttagtttagtaaacatttgagagagtttttctctcaaggatgataagatattaactaataaaagtaaacatttctgtttactgtgttaatcagaatgggttctcaaagttgattatgatcatgacaataatcctataattatttgtattgtacattatttcctcaattcttgtgtgcggtgtacttttcttctcactttttggagtgttcattttctttttttaagaacacggctcgatgaactgagaatgttcttagagaatgagacttgggaactttgtcctgttaagtcaaatttcagcatcttgcaacttcatgtaagtgtttcttaagaacaaagaaatctgtcttttagtaatgtattttacccttttttttgaaaaaaaaaatccagaaatatatgaaaacatttataaaataaattaaggagcagtttcttatcttccttccttgaaagtcattagtagccagcctctttttaaaggaatgatccttttatggttgcgaaaaatcagtcttacaaaattcagtttacatactttaggaaatctcttttgcctaaaaaga

SEQ ID NO: 6577 - DNA, 197 bp, mus musculus
taaattatctctctattaaagggatgctctcaacatctttaagctcacaatattcctctcctgaggagagcatatagaagttgcaatgcatgagtgcagtgaagaagggactacatcctgagaaatgcttgctgcacagagactagccaccgattctgctgtgcagagatttcaggagtttacagctggttctatgt

SEQ ID NO: 6578 - DNA, 1384 bp, mus musculus
ggctttattgagaatcacaaaacattaaccaacgttagtagcggggatgattgtcataagcacattaagaaaaattttttttggctaggcttggtggctcatgcctgtaatcccagcactttgggaggccgagatgggcagatcatttgaggtcaggagttcgagaccagcctgaccaaaatggtgaaacccccgtctctattaaaatacaaaaattaaacgggtgtggtggcgggcgcctgcaatctctgctactcggcaggctcaggcaggacaaccatttgaacccaggagggggaggctgcagtgagcgaagatcacgccactgcactagagcttgggcgacagggtgagactccctctcaaaaaaaacgaatttttttggcacatcgacctagccaaacttgcgtaaatacaagtgagagtcagactcttttctcatcaacacctacactaagttaggctccttctgtaccttccattcggaactttggtgtactttcgcccaccagaactgggcaaactgaggacattaaaaaaacggtttaagagaaactggccagagcggtgagttaagtgttaagactggtttcactcctgggttggatgccagcaatccatcggccagcaccatcaactggatccatcaatccaatctggccagcacccaggggcagccagactgaccagccaggccacggatagccagacaataaacgaccttagggtgtccttcgcatcccgctgggcgggttctggcagtagaaggctgagaaaggggagtgttggggaaggaaggaatgggacgatgtgtacttttctcccggaactgtagttctattgccccaacctgggctcaggtagcggccagtaaactaggagacagccctaaggctcgcgtccgggccaggcgggtacccctagtactctctccccacacccccatggctctgccgcagccgccgccgcccgccggggcgcgtgacccggtgaccccggagcactgggcatccggacccccctcgcaggcgcagccgctattaaggcaggaggctaaagaggaggaggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcg

SEQ ID NO: 6579 - DNA, 1248 bp, mus musculus
tctttttgctcatctctttttttaaaaaaacatactagtaatcttttaatatgtgcaattttatatcttgcttttttcttcaccacttattcaccattatataatcaacttaagtatcttcttaatggcaacatattattgagtggatataatgtaattttatataattttccactttttaaagctttttatagttttctaatttaattttgcagttaaaaaatacattttaaattacttctttgtgtgaaaactttgctttttaaattatttccttagggtggaatctctaaaattcaaatattaggttaaagaacataaacatttaaaaattattaattatgctgcaaaattatttcaatttatactaattagcaatatattttggggcctaattttctgcaaactttctggcattgggtgatcatgctgtaaattaaaacagcagtgcaataagtttctgttattgattttgttaggaaatttctcgtttaaaaatataactttgaaaactaacaaggattaatttctttgtatatattaattaattagttcattattttttggtgaattatctcatcatatcttctgtttatacctttttaagtgatcccagattgtaatcattgtcttcaaataccatgtgattgggagaggggaatagcaaaggggggaaagtcgaacacaagaaagtttagaattgtgaggggagtagctcatgaatttatgaaaatctgcctatgttaaagagttgaaaacttaagagccttcacagctaagtagttattaacatagtgatgatgataccaggtcctaaatctttagcaactattccatgtgagaatgagaataatggaaacaaatgatacagtcaacttttcattttatttgctatctgtattttccatttgcatttatacatatgaaattgtagagaagactcagaactatttaacatgaaattattacaatttaaagtgaaaaattttaataaacttttatttttaataattaaaaaaatttttttaatagagacgaggtctcactatttcgcccaagctggtcttaaacttctgagctcaagcaattcttccatcttggcctcccaaagtgctggaattacaggcatgagccactgtgcccagcctttagtaaacttttaaaaagtagagagatttctgattactatgaaggttttaatatttcttggcttaaagttgcatgactttctaaaaattcgaataatgg

SEQ ID NO: 6580 - DNA, 217 bp, mus musculus
ttttttgtataataaattgtaaaatattgttaagctgttgctgtgacaataatgagatgtgactaaaatgcaataaaataaatacctaaccaatgcattgaaatgagtcttgtccccttccaagaatatgccttttcaaataatgccaaaaaaaaaaaatcctttggaacttctcttttgttataaatcagcctctgattcagtcattgcgctactt

SEQ ID NO: 6581 - DNA, 1085 bp, mus musculus
caactgaggtctaagtcctaccgacgttagagggatagacgaattgacctttccaggtcctctgctcgccaccagcctacggagcggcgccaccccctcctggcgagaccgggcgcggaagacgcggagcggaggccctccctcaggaggggcgcgggcgtggagggcgtgggcagggggcggggcgagccccgcagactgagtgctccggggagctgtcagtgtcaggctctgggagagaggaagtgatcgctcccggaggagcgcgagccgagcggccggcgcagcgtgagacagcacatcctgcccgcgccggccccgccaccttcgggagccgcctgcaccaacgctgccgccgcccaggagccgccgccggctcggggagcccagttccgccgctgccgagcgcgtccaggtaaactggagcgggatgtcgccgctccccggacggccgcctccgcacctctccccaaccctccccaccccggtgtcgtctgcgctgggaaccaggctggagccgaggcccctgcagccgcagccggacccttgtcctggccccctgcccaggctcctgcgtgctccgctgagcccgaaggcggccaaagccccccagtgacacccccctctcggcagagccgagagactagggcagagaaggaagggtcgtggtgtcaccacctggtcgcccaccttgtgggctgggaagggcgtcccagtgcgccccgcctcggtcttccccgggggagcagtgggcgagcggcgctgaaatctgcacccctctgggccaccggctgactgcccctggaggagggggaaagctgcagagggaggggaaaggatgctgtttgattacatttcgagctgtctgcaaagctcttagatgctgtcactaccctgcaagtcggagggagcgaattcacttccagcagggcattaattaaacacttcaaagcgagaagatgccagtttctctctgctgcgaaaaagtgtggctgggggatgttgttttggtaaacaccttcacggccgcctggctctccttcccccgctcccattcggaatcgctctggccttataaatccgtg

SEQ ID NO: 6582 - DNA, 141 bp, mus musculus
ggcaaggccattccctcattgtctaattccccaaaaggcaggcttttgtttttgttgtttttcccagatgtagagatttccaatgtaaaattaaacttccaatatagtagtcttgcctgcaattttcagaaggaaattagg

SEQ ID NO: 6583 - DNA, 1337 bp, mus musculus
gagcctctgtgactggctcattttctgccggcttttcacttcccttggcacctgtcccccaggaggcgggcctagacaataacctctgatctccaaattgcccaccctctgggcctctgagcatcttcgtttgtacaacagggagaattgtggggaccaaatagaatctgtgtgaaaaagcaccttgtcacctgcaaaatgctctttgaacatgaggcttttttttttttttttttgagatagagtctcgctgttgtcgcgaggctggagtgcaatggcgcgatctcagttcactgcaacctccgcctccccagttcaaatgattctcctgcctcagcctcctgagtagctgggattacaggcgcctgccaccacagtcagctaatttttgtatttttagtagagacggggtttcaccatgttggccaggctgatcgcaaactcctgacctcaagcgatccaccagccttagcctcccaaagtgctgggattacaggcgtgagccaccgcacccggccacgaagcattattaaggtgaccacaccactgccccctgccttcaggatgggaggccttgttctctgagtgtcagtctctggctaccttgccacgtccttgacaatgtctgctttcaaatatcactttctccttccttccttctttctttccaccgcctgaatgaatcttttgttctgcggcaagccaagagaaaatggtaggattgattcccaagtgtgaaagcgggggcggaagtggtgtcttccaagaggagtctgggtgccctgccgaagaggggaagatgcagcgagggagagacctagaaccgcgatcaaagctgcagcagctgctggggctggcggcacaaagggaggagggaggagcctgggcgctgagaaagttcttggggaaagttgagctgagccaagagtcgggcggtggctgggatgggcgggagggcccggcccgatttcccttgctgctccccttgtggcctggtgagtgggaagtgaaaccaaggataggaccagtggagggaccctctaatttatgggaggagacatgaggggttcatggaaccccagcgggggcaactgggcagtcaccaaagctggaggggacagagggctgggatctccaatcatgggaagggagagatggatggaaggaaatgaagaactctggataggggagacgcggctagaccccaggggctgtgatcagggagggaattggggagtgatgccagagagggcaggtctccgggagtaaaagtgtggcttctctctgcttggggttacccctggctcatcggagcagggagctgtcggggcttgttg

SEQ ID NO: 6584 - DNA, 481 bp, mus musculus
ctttccatcagcctgactgcaaggcttccttgcccgggagccccccagtagccgagcggggagccggcaggaagctggatggagctgtgtctccctgcacgtatgtgctccgggcctgagcccagcagaggtggtggcaggcagcctttcccatctggtttgttttggcagttccctcctgcagcctatttgtttgttgtttctactccatgttttctcactgcttgccagtggggcttccctcagtggcagttctgcagaaacagacctccacattgccactgaaggaagagtggggcctggggctcactcttttgtgtgtgggggggcgtgaaccaggctcctgcatctactagagtccatgcagggcaggtggggcagggaaccctgcctgcaggcccgaccgtagggaggctagctccagcctctgttctcctccctctactggctctccaaagtgacttccatcaaagcttgggag

SEQ ID NO: 6585 - DNA, 229 bp, mus musculus
atggcaatctttgccatagctttcagtctttcaacacttcctacacagatacaggattatggggactgtatatggtttgtgaatcatccactgttgcagacatgctacatgttgttcaaaaagaatggtgagaaaaatagctttaagtaatttaaattttgcctttaattcgttttaaactagttttttatttatactttatggtgatttatggtaattttacctttta

SEQ ID NO: 6586 - DNA, 747 bp, mus musculus
tataatagcatggttttgaaaaaatatgtatatttagaaataatgattattttgtagcacttagaagtttcaaaatgcatttcctcatatattatttgtgccactaacaacacctctagcaggtagatattattggttccattctacaacctgagaaaccgaggcgtagaggggttaaatggcttctacaaaaacatggagccattaaatagagaaaatatttcaacacgctttctaatcccaatcctgaaactccttgagggatttcagtccttatcatcttgattgtttttggtttccaatttttgttcttttccgatcttaatttattcacttcatgtaggtgctgaatttaattgagttagattctaggagaaagctcaagcaatgcctaaccaaggaagccgtggattcccattcagagccagaaatgcagatagaaagcaagcaaggaccggggacactatctcaatctgaatgcattcaggcataaatttgtagtttggagagcatctaggaagcaggctaattccaagacaccaagcccgctgtgcccaatcctaaaacagaattaacatgaaattctaacttgtcttgtaattgatttaggcgttctcagaatgagaaccctaatatggccccctacgctggctaaggctccaaaatacagggcctatgattatcaactccttagaaagaaatggagactcagtacacccgttgctctcaaatagctcaggaattcac

SEQ ID NO: 6587 - DNA, 906 bp, mus musculus
tagcatttgtgcttggtaatcgacaagacagcttgatggcagaggaactgaaggcagaaaacaaaggtaagattgctttaaggaactcttacctggatgcctcaagcacaaaaaaatggtgctctccattctttcccctcaaatactagtgcttcccctgaggttctaatttgctgcctcttttaataccgtgtagcttgcagactttaccccagactcaactcaagaagcttacacaataaaaatataatattatacttacttatctttctgaaactcccttagtccattattattattttgatgcttttttttttccggtttcttcttccctcttcctctgatttcaggtttgccatcagaacttaatggctaagatgtaactgtgggtggtgtctatttggttgaatggaaagtactttctctccatgtattcagctatgtttcaggttgaaataaatgcctggagaatctctaacatcatctatatatatctttattaaactatttgtgataattgaattcagacccaacttctcagagagaggtagtaacactggccccaaatagttagttagagatttcagtagttacctaattagctgaattttaaatgtgttgtctgcgtatcaaaagtcctcagatttcttttccaaaagaaattgccttctgaaacacaaagaaaaccaggatggaaaatagaacattgactattgaatgatacgtaaatatatcatagtgggcaaataagaggtagcaagttgttattgaagatgaatcttttaattttcttttcagatttctaaaccaattttttgggatagaattttggtgtctctgtttttttagtagacttagattcatttaacagttttatctttatgttatctttaactttaaaactgt

SEQ ID NO: 6588 - DNA, 790 bp, mus musculus
tcatgatctatgggcttctattcctcttgcctcagaatcaatatccatcagttttgctagtaattttcttctaaaatataccaacggaattttctggaaaaacaacagtttcaattttgtgagcataaggaatcttgtttgctcctttctgcattcctgactttcgttcttgctgtttcagatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggaggtatggaatggacgtgtctctaagatctcaggaacatatggcatggcctgagaggttttgcctgacagaagggctactgatcaaagtatattctggaagccaaatgtgattgaaatttctatagatgaatacagcacacacaaagctaccaaaatgtcagatcatatgtgggcctaagtgtacatagaaggcttcagaacccaaaatgctgctctgaaatgccctctcccgtgacttaaaatttttctccacacacactgtctgaaaccttgttactttgacatttatttggatcattaactttctgacctgaaagaggttccataacttctctgaatgtcagtagcctcatctgaaaagcatgagaaccaaattagataacctaacaaaaacacctggaaagg

SEQ ID NO: 6589 - DNA, 790 bp, mus musculus; identical to SEQ ID NO: 6588

SEQ ID NO: 6590 - DNA, 1155 bp, mus musculus
tgtattttccttcttttcccacaagaaccatttccagaatcttccctttgagtagtagcccttgccgctacctttctagagaacgaggaataatgcttgaatgcagccacctcctttctatttggtggagggaggtttcactcctattgtttttaagtaatcagggcctcaagggttaggtttgcctggtacgtggtgtctgattacaccagccatagctaaagctaaaaaaaaaaaaaaaaaaaaaaaaaaaagtacagtgccaaatattacacaaacaggagttaaaagtcagtgagcatttctttggttaatatggacataacagcatatgaaagcaggttgacaatttgtttcaaaaatggttttgtgcactgctattgggacttaattaacttgaaatacagatttgtagacgttattgaaagtggaagctgttggcctcatcccattcttctaaacctaatcctgctcctccttaccacccagcccccgactggacagggaggcttccatgtggccttcatccattctgtgatgcagagcctgttgaagaaaagcaggtgtctttacagagaacttcaatagaatcctgtcaagtcatttgtggttttggagcatagtttacttgctgatttgactacacccaaatttggcctgtttgaacccttttaaacagggttcaaatgcttatctgatgtgaagacaagcattattattgacagggaggaatcgggaaggaaaggctttaaaggaaaaaagtttgttagggaatgaagtaactcaaataagaaaccacagttagagaagaagggtgtgtttaataattgaaagctgtgaaactctacccatgtggcacccccaggatcatgccactaacctctgctctggactattgtaagagccttttatgtggtcttcctgtctcaatctcactccccttcagcctattctcaatacagcctattccacccttcaaaatggaagtcaggtcatgtcactcccctgctcaggactcctccagggcttcccatttcactcagtggaagccagaggtcttgccctagatcatgtggtgcccctttccatcccttacttcatctcccactgttctcctgcttgctgctcctctcagccacctggccgccttgctgt

SEQ ID NO: 6591 - DNA, 1046 bp, mus musculus
tgcacagcatgcaaataaatttagaatgatagcattgtgaaaggggactcattgaaggatttgtgacagggaaataacatcagatttgtatgaggctcatgctggtgaagaagaaaatgagcctaggtacagggaactgataagtctattgcagcagccctgggtacagatgaaaaacctgtcatccaatatgggagctactagtcacatgcgctatataaatgcaaattgaagctgaatgaaattgaaaatctagtctctcaatcatattaatcatatttcacctattgtataatgcaaatgtggaacatttctatcatcccaagcattctacctaactttggacaatagtcaccccttctggggaagaaagtgagattatccttagggaggaaagaagggtattttagggcaaaataactttagaatttaccctctgtatgtcactatgttttttattcttttacgacaaaaatgttttcaagtgccatttgaaaaaactgaaaaaaaaaatcaaagcctacagttggcatttatcatggggatgaaaaggagggaatatggtcaaagaagtagatcaaacctctcttcaagtgttgttgcccatgtttaatgctctctatttgaccttgactataaaatccagaatttaaagtataaactctgaatttgtgaaatacttactagcacttactgtagaaaagttatatttaatatgaaaaccatttatgtcatatgatattaaaccttctttattattactggtatttgaggaagaagtaaacactcagtggaatggaattacactgaccataaattatacatggagatttggacagaagacaaatgtatttacctaatcactatctagagagcaagcagataagcagacagagatgtggcatggccctcagccaatatggacacataccagcacaatcacctgtcagtgatgccatgtttcttgggcaggggtgccactcctgctgagtatttgggggattcccagtgagctcaaccagagtaggcaacagggagttcttgct

SEQ ID NO: 6592 - DNA, 150 bp, mus musculus
ctggtggttgctgagggtgaggaagaacaggtaggaggggcagaaggaagagggtgtggttataaaaggtgtttatgtaatcatcataatagaaatattaaattgatataatcaaaattaaaatatacctaactcaaaaggatggaggaa

SEQ ID NO: 6593 - DNA, 1048 bp, mus musculus
ggcttgtggaacctgatgggtgggatgcgtcaggagaaataagagttacatgtaaccaggcagagattactagattctataatatatgtgggaaatggacattttaagcaatttagtatctagtcatacctgttttgattttttcccctatataatgcttctttggttaaaaaaaaaacaaaagaaaaagaaaaaacaaaaaaaaacagtagattcttggagttgcaggaaggatgaaagaatgggactttttatattaagagcacttgacagctgggcatggtggctcatggctgtaatcccagcactttgggaagccgaggcgggtggatcacctgaggtcaggagttcgagaccagcctgaccaacatggtgaaatcctgtctctactaaaaacacaaaaatcagctgggtgtggtggcacatgcctgtaatctcagctactcgggaggctgaggcaggagaatcacttgaacctgggaggtggaggttgcagtgagctgagattgcaccattgcaccggagcctgggaaacaacagagaaactctgtcaagaaagaaagagagagagagagggagagagagagagagagagggagagaggaaggagggaaggaaggaaggaaggaaggaaggaaggaaggaaggaaggaaggaaggaaggcacttgacaaagagaggaattgggactgagttttgggaaatgtttaaagtagtcagagattttaaggacagagattcaggtcatagataataatgagtgcactgaacctgtgagccttctgaattcttttgccactatcactaagcattaaaacataacctgatgcctagaaggggcaggtaagagggtcaatagatgctaccagtactagggtctaatccccactctcaaggaaggatggaagggagggagacaatcagtccttcacaacacattgtagcaaatactctagatgggggtatgagagagcctcttcgagaagtagagcatttgtgtatgaaaacccatgaaatctcccaggaggatttggtagaacagagtgtt

SEQ ID NO: 6594 - DNA, 1048 bp, mus musculus; identical to SEQ ID NO: 6593

SEQ ID NO: 6595 - DNA, 1052 bp, mus musculus
ttatatcacatgatgttatacacaaatacctgcttaccaacctaccttcgtacatacatattgataatcctgttttatatagataagcaatatactcatgtaatgtcagtgaaaagtgtggctttttatgccagactgcttgaagaaactaaggctccagagactgtcacctgcccaaggtcacatattgttagtgacatattgtagtaaatggatttcgacctaagtgtggcagacaccaactttcactcttgcaagtatttttaaccacttttctctaccttacgttcctattgttctattggtgcataacggagtgaaatatttctcttaattttgtattttttgtgttttatatatacatatattttatgcaaaataaaaatagttttcccttcggacaaatctaaaagtatatttgataatagaggaagaagctctgtaatatacatttagcatgttggtaatgctagatttattttttaactaaagcctgaaggactagtagaatcagagaaaaccttgtttttgcttaggtgtcattgtttaccttgagaatgaaaaatagagcaagtagttagaaagcttagaggagttaaaaataataaccgtcatgctgccctagaaataaaaggaaatgataaagcatatacctactagctcagtgatcagtgattttagctattggtgagacatttaatttagtgtaaaaaatggtatgagatgatgctgtaaaatgtatatctgcagacaatttttgtttcattatttatttttatatactgtcaactggccatgttaatttccactgataatacaactgaaattatcatatcaacctgtatttcagggactttctccaaatacactcagagttgtcttataaacaaaaccttattatagtcacacagagtttgaaatgttaaggctaatttatgagagcagtttgtctgaataagcatttagtctaggaaaggaatctttcctcttaaagatatagtaagtcttctctttctactcctaagccctctatttcccatgcctggggtggg

SEQ ID NO: 6596 - DNA, 1052 bp, mus musculus; identical to SEQ ID NO: 6595

SEQ ID NO: 6597 - DNA, 964 bp, mus musculus
acagtatgagcctgagaacatcaacatttaaagaacaggtagagaatgagtttcattcaaagtgagtggaaacagagccccttgggagttaagaagaaagtaaaaaaaagtagtactacagaagccaagtgaagatatcattttcaggagtaggagagagtggacaaacctgtcaaggattaagcaacagaacaaaaatgcacacatgggatttaacaaggaaggggttattgatgactttaatgaaagtggtgaaggtagaaacagacccagtgagttgaggcatgaatgggagttgaagaaatacctgtggggatgtctacagctcttctaaaatatgtggttgtagttattttaagagtataattggattttttttttaacacaaagaggataaatgcttgaggggatgaatactgcatttaccctgatgtgattattaccccttgtatgcctgtatcaaaatatcttacataccttataaatatatacacctactatatacccacaacaatttaaaaatattttttaatgtgtctgtagaggagaggagtaaagcagagtcagttgggaagaaatgaaaatgagaaaattaagggtgagtttttacattttaagataggagaaacaaatatgaattctgatgagaaggtgcaagagaacaggagttgaagatgagggaaagaggagataattcatagaagtgggtcctgagataataggaacagaggaggaaaagggagtttagtcaggaaggacttctattctattgttggagtagggaaggctgagctgatggctggggaggaaaatttatagatctgtagtgggaaagtgaagacatttacatctgatggtgtggtgatctttgatgctatttactagctccttctggttttttcttcagggcattttgggattgcacttcccttccttcatggagtggctatgagacttactttgg

SEQ ID NO: 6598 - DNA, 505 bp, mus musculus
acaagaagagcattggttcagatagagtatgaagtaaagcagaaaacccctgatgaaacaaaaacttatttatcagtagtaagtccaaagaacataggcaaagcttagctacatggaaaatcatgcccttcgaaagacagaatattgaatctaagccatcataaagaatagaaaatacagaaagataaataaaaaattattacagcaaagataacaacatgaaaacacaaaattctagatgaaattccaaagtgtgttctgctgctgaaatgatgtgggaaataggggctgggaaacaggtctcagatgaaataagcatagactaaacaaaaccatagttgtgcctttcttgagactttctcaaagtctttaatatcctacactgctttggggcccatcaagggaagtacacggaatggattttttttcctaaatttatttgaccaggaaataatttttgcacaagacacgtagggattgatctgggaataattagtcttggtcc

SEQ ID NO: 6599 - DNA, 679 bp, mus musculus
tttagtcgacatgaactgtcacacaatttaaaagaaaagcagggtcctgttgtatgtaagacctcaggtatatttgcccattttcacctctctactcaaagttaatttagtttttaattctcgggtgaatgtgttggtgatttggaaaaacactttccatgtcctggaattcttttctaattctagcactggtttttgaatgaccttgaatgcagtgaagcatatcaaagtaaagcaggaccatcctttctttttttttttcttttttttcccctggcattcagagagaaatatctttcaacggctggcctttaggtattcagaaaacacgacatgacaggtgactgcccatctctttgccgtttttttggttaaattgctttagctacatggccgatcacttaacaagtctttcattaagatcaacccagtagtgttgggattgacaatgtgctgggaacgagttctcctaataattgctaaatgttgttctcatcccaaacagggtaccacataaaatgcaggagatgaaccagcgtgctagctagctagccaggcagaaacaatagcatgtcttcaacttaagcaaggaattccattttctttttcccaagtgattgttgatttcctggtgatcatgactcaagacaaagcttaatgcaaaaacttcacatttcca

SEQ ID NO: 6600 - DNA, 892 bp, mus musculus
agtttccaacattctttgttagctgagggtttttatcctgaatagtgttttattttgtcaaatcctttttctgtgtcaactgatgtgatcatatgaatttttctctttcatctattgatatgatgcattacatgattgattttctaatgctgaactagccttgaatacctggaataaaccccacttggtgtataagtattttgattggtaccttgttatcccaaggggattgattccaggactacttttggctaccaaaagccatgcatatccaagtccacagtcagacctgtggaactgctgatataaaaagttggcccttcgtatttgtgagttttgaatgcctcaaatactctattttccatccacctttgattgtggttgtggaacccatgaatacgtagggacaactgtatttactgcaaaaatcctcatgtaagtgaatccatgcagttcaaacccatgttgttcggtggtcaacaatactctttttgaagagtcattcttgaggtaattcaaaaaggtagaaatttattgttaagcacaggaaggaggcctattttagtgagtctctgctaatcttggaggggtgacatttatgaagcattggtgacagccatagctcttatggagctgacatggttccaccagatgatgtaaggtctctgctgctttctttagaaatctgaacttcaaatcactgtcaaattatacaatatgaaattatacaagtttcagagaaatttataatcctttacctcttagttacatatgacaatgtattccaaaaattattctcagggtaaaggagataatgttcaagaaaaacaaaatctcccagattttgggagttttacctgtaagaacatagtaaaacctagagagaagacat

SEQ ID NO: 6601 - DNA, 1174 bp, mus musculus
tctaacatccacaaggcatacactgttgcagttacaaagaattgtcagacagaatttagaattcttccatgagaaactaactttgtagttttggcggtaacaaaaaatgattattaatttctccccacagacggccaccaggtttacttaagtgatgatatcttagacaacagttctaatataaatatatttcttaacactgtagaaggattatttattatcacctttttccaaagtcttatctaagactaaacgctcctgattataacatgtctttaatgagttcttttattttattctaattttgaaagactgcgctccctgacttaacctagggctaaaattgagtatcaaaatcccactgtggtttctggttcatcagaaaacacacagagctcccccaaaaggcttatttctctactttataacagagaagtgagtcaatctgggataactaatgctttctggtctcttttaattattagaatgcagggctcgggtttgacaatgacattgcgaggctgatgcaattccagaggtctaagggtgacgatttgctgaacagggaagaagacaacatttgcaatgctcttcacacttttgattcactgctcttcttcctgcctcacttttcaagctcagacttttcttgttaatactccaccctttcctgacacagaggtgcactatttgtcttacggtagtctttttctctgttggatgcagagtagctctggtcatgtggcttagaagtcatgtgtcatggtctccatgtcctgaagctttcatctggtattttctgacaaaagatgccacaaagtagtcactgggtaactcagctaacttattatctccttcactggattcagcccattgtgttgcaaaaataatcttatacaatatatttctccaaatccagaagtatatgtttcttgcatatggggagctccttttgacatctgtaggagccttatatccataaaaagaataatgcttggaaccaccttggcactatttttttccctttatgggttattttaattatagaattattacctccaattgtaatcaggatgtgtattaatctttacaggagaactatataattgcttgttaaatgtttctaatagttattaatataataataattattaataaaactagggttcagaat

SEQ ID NO: 6602 - DNA, 3089 bp, mus musculus
tgtcggtatctggctccaccaatgtatttgcccatgaacttgcttcaggcaatttgtagaacagaattcttccctctagcatcattatctgctaaaaaaacagttactgcatgtacatgacaggaaactttggaaatacagataaacagtaggaaaaattgcctataatctcgccatgcagaaataaacactgctgatggagtagtcccctcttatccttagggcatatgttccaaaacctccagtggatgcctgaaaccatggagaatactgaaccctgtatacacaatattttttcatatacatatgtatttatgataaagtttaatttataaattaggcacagtaggccgggtgcagtggctcgcgcctgtaatcccagctctttgggaggccaaagtgggtggatcacgaggttggagttcaagaccagcctgaccaacatggtgaaaccctgtctctactaaaaatacaaaaattagctgggcatggtggcgcatgcctgtaatcccagctacttaggaggctgaggcaggagaatcgcttgaacccaagaggcggaggttgcagttagctgagatcgtgccattgcactctagcctgggcgacagagcgagactctgtctcaaaaaataaataaaataaaaataataaataaataaattaggcacagtaagagattaacaataactaatagaacagttataacaatatgtcataaagttatgtgaatgtggccactccttcttgtcattctacttactacacactgtggccataacttttgcagttttgaggtgcaacagtgaaactaacaaattgcttttccttcttcacaatatcacatgattcattcttgctgtagatcttagcagcctcggtgtatgatttttttctttttttattaagttgagaagtttcaccttttcatttaatggaagcaccttacatcttctctttggcatatccaaattgccagcatcactactcttgcactttgtggccattatgcaataaaataagggttacttgaacacaagcacagtgataactatgacagcaccgtgataactatgataacgcatatggccacaaagtaactgatgggcgggtagaatctacagtgcggatatgctggacgaagggatgattcacatcccgggttggatggagcagggcagtaacaagatctcatcacactactcagaatggcatgctgtttaaaacttataaattattcatttctggaattttccttttaatatcttcagactgcagttgactgtggacaactgaaaccacagaaagtgaaactactgataaggggagtctacaatatttggtgcatattattccaatctttgtgcatagaaatgcttttaaaaatgaatattaaagcatactttttataaacttattgatatgtgcacaatacatttcccccagatcattcagtacctttccaccgcataatttaatgactgcatggaattgtaccctgtgaatgaacttacagcatgttagccagtctatgattggacattgggccatttccaattttccattagaaacaatgttgtgatgaacaatctttgtgcacattgatgattatttcctaggataaagtcttagaagtggaattgctgggtagtcaaaatgtaaaagctttccatttatattgcctaagtgctctgcagaaaaatatgcatcattttcaaaaatgaaaattgtaaaccaaaacctatttgaacaacaagatgctctatgtgaagggaaatttaggatccgtttctttagagtgattcatccctccttagaggcaaattgctattaccaagtagatgtaatgtttttacagataaaagaataacattgaaaatatctaaataaaccagccatgcaagaatattttgctattttctatttctgttaatcagtgagaacaaaataacttactagcataaaaagataagtagaatgacatgccactaatggggaatggggtattttcatagagctacatttccctctttgatattgattaaaatatattttggttattttttttaagcatttttcttgtgcacatatactacttaataaaggagaaggagcaaacattttaaaaatggagaaaaggtactgtagtcgtcataatgttgctgaatgctgttgcatttttctagctgtgaatgtcctgtctatgctagtgggaacggaggtcaggattctagattaaagattacctttgattaggcatctctagtcatttgctggaacacctcgaatgtatctttttctgtatttctatctgggtgaaagtgtccatttgattgattagataaccatcaaacacaacttgatctttcttgttgggcagctaagtcattaaaaagaggctccttcttgtgctgccaccttcaaatagttatgatcattgttttcggaaacaaggcttgggtaattttaaaataaaaagtctgaacttttaagtaggccatgtgtcatctagttttttttattagcttcaaataacaatcaatgagtataccctagaaaacaacatatttcgttcctgtattgattccccacactggaaagctgttaaatgtttagatgctggaaaagcaacaagactaatccatgagtgtctggcatttttttcttcttaattgtaagtgcaccattttatatagtatgtatgtggtggtgacattttgcttgaatatagtttaagagattacgggtacaaagacctgttttcctttcaattctgtgctgatattttctatgattgtgttttatcaatgtcattgaaatttccctcaaagagaaattccttaggaatctccttggaattggcattaaatactctttattgaaagagagattggttttctttatgaaattgttttcttctgcctctgtctattggctaattatgggacttctatttttcatttctactttactgtaatcctttctaagttgaaaacagccttgcaaagaaactcgcagggcattccaggggcaaagagttcctctaacctagaatgaattttgcagcatctgggaatggcatattttta

SEQ ID NO: 6603 - DNA, 3089 bp, mus musculus; identical to SEQ ID NO: 6602

SEQ ID NO: 6604 - DNA, 3089 bp, mus musculus; identical to SEQ ID NO: 6602

SEQ ID NO: 6605 - DNA, 602 bp, mus musculus
ttcgaagcacatctttttatggtattatttttttctgctcttttgtcttagctgccagaagagtggaaaatcttctgacagggtctctccttgcagcgagtttgcgtcagtatatacacttcgttaatataacaaatctagtttccttggttattggatcaagatttgatttcccaggagaccctccttgtctctgcccctgatgatgagatttgctccctggtaattctgcagctagtgtgtcacctcacagtgtcatcagtctcacctcagactaaacatgaggctgaccccagggtcattatcagactgttctgtgtgtgagtatgtgaattgtggtctgtcctggatagttctgaagactcactcatgcattcattcattcattcacccattcccttgacacacatttattgaatactttgtgacaggagctaggaagtggggatagaggaaatgatttggggagggggacacacctgctcacaaggcactgccacttcagacagacatgcagtaactgttatgcggtaaggtaagcactgtatcttcataggtgctcagactctatcaggaagaggtggtaggagtgaggtggtgca

SEQ ID NO: 6606 - DNA, 667 bp, mus musculus
tctctttcttacctgttttttaaaaatttgcgtcttctttttttaagatttatttctatcattagttttaagttgtcttaatctaatgttcttgggatttttgtcatgtttcttgtgtttggtgtttattgaagtttttggttctgtgggtttagagtttttatcaaattttgaaaattattttttcagtctatcattgatgggcatttgggttgattccatgtcttggctattgtgaacagtgttgcaataaacatacatgttcatgtgcctttataagagaatgatttgtattcctttgggtatatacccaataatggaattgctgagttgaatggtatttcggtctttagacctaaagaccctttaggtctttgaggaatcaccacactatcttccacgatggctggaaacacagaagggaacaacacactctggggactttggagggtaaagagtgggaggagggggaggatcaggaaaactagtgggtactaggcttaatacctgagtgatgaactaatctgtacaaccacccccctccatgacacgtttacctatataacaaatctgcacttgtactcctgaacttaaaagtttaaaaataaagaaaagttaaaaaaaagaaaattatttgccatcatttgttattgtagatttccactgc

SEQ ID NO: 6607 - DNA, 561 bp, mus musculus
aagtgtaggggaagctgagattcaaatgcagtcagtctgaccccagaatccctgctgttaaacacccctctatctacagtcttaccatcttgggttgggacattccaaaattcagtcactattaattatttcccaaggaataattcacaaacaattggactggagtcccacaacaaaggtacatgggaatatttgaggtaaacactgaatactcaagtataatctacaaaaatgtgaacactttctaatgtatagtattacatatttaaatatgtttttcacatattgaaaagtttggcatatctctttctactgctgggaaacttatatatagtcattcagtctccttttggcagggtcaggatttcagttatgtgtgatatgtaaaaattttaagtgttgtatttcgggttgacatttcttccaactttggaaagctatgttttacatatcatgcttttccaactggagtgtttgaggttatacttctaattgtgacttttgtcctacaaaatttcacaaagtttctaagtactggatctcattaagtttaattcctag

SEQ ID NO: 6608 - DNA, 580 bp, mus musculus
agaaagtatatcaaggacaatggacttgatgttgataagccaagtatggtaagaattgaaaagatggccatttgatttggcaatccagagttcattggtgatcttgacaaggatgcttttgttgtaattatcagaggaaacacctgattggaaaggattacaaattgtaagaggatggaactagtgttactagcaatggtcaacactctctagctattttgttgtaaaagggagaagacaactggaattaaaactaatgggcaaaatgtggtttaaagcaggattatgtttcagattggagaagaataacatttttgttttgctggtggtgattactatgactacataaggaaaaaatagtgacgcaaagaaaaagaagtaattccaatgtgtagttttaaataggtgaaatgaattgtatttgtgcataagggaaggttttactgaggagagaatatttttatctcaagaaacttgatagagaacagagtatatgagtttggttgtgggtacatatatgaggctgtgagactttctgaagcttctccctggttacttcaattttatcagtggaaaaaga

SEQ ID NO: 6609 - DNA, 6953 bp, mus musculus
tcctgtctatcatatttagagttgccatataaccaaataagggtggaaagagctgtacacagtagaaaattttgaccctgggacctagactattaatcagtggttaaccacaaactgagctctaaactacaatccacagggattcctcactacaacctcctgatttcactggatttcttaagagttacctgatctgagggccagatcaagcaaagccaaaccttccatagctacaggaaaacatttctttggggttagcagagtataactggttttaaaacatattattgtttcattttttcttcaaatgtgaatagtttcaaaatttttatcattacataataatgcacattcattgtattatattaaagaaaaaaatcaagcccaaagttacaagaatacattaaaaatgtcctataattcctctaccaaaaggtcactattgttaatattttggtatagatctttacagatttcctattcaaataacttttcagaaatggttcaagctcatttgcaatgtaactaaaactacttctcttccaaatagatatcatgtgattttttaaaaaatactcaattttgtttatatggaactgttttcattgcactaccttatatgagatgaaaaaatatgtacctaaattgttatatagaactcaaaacaatttttaaaaaattatgtaagctagaattactttcattagtcattgataatagtttatatgtccaaatagtgacagaaaaagtattttataattgcattaaaatgatgaaattcataatttgttattcttttattattttatttatttttattatactttaagttctgggatacatatgcagaacatgcaggtttgttacataggtatacatgtgtcatggtggtttgctgcatccatcaacccatcatctacagtaggtatttctcctaatgctattcctctcctttcccccgaactcctgacaggccccagtgtgtgttgttcccctccctgtgcccatatgttctcatcgttcaactcccacttacgagtgagaccatgcggtgtttggttttctgttcctgtgttagtttgctgagaatgatggttgccagcttcatccatgtcactgcaaagcacatgaaactcatccttttttatggctgcatagtactccatggtatatacgtgccacattttcctcatccagtctaacattgatgggcattttggttggtcccaagtctttgctattgtgaatagtggtgcaataaacatatgtgtgcatgtgtctttttagtagaatgatttataatctttggatatatacccagtaatgggattgctaggtcaaatggtatttctagttctagatccttgaggaatcaccacactgtcttccacaatggttgaaataatttacactcccaccaacagtgtaaaagcgttcctatttctccacatcctctccagcatctgttgtttcctgactttttaatgatcgccattctaactggcatgagatggtatctcattgtggttttgatttgcatttctctaatgaccagtgatgatgagctttttttcatatgtttattggccacataaatgtcttcttttgagaagtgtctgttcatatccttcacccactttttgatggggttgttttgttcttgtaaacttgtttaagttccttgtagattctggatttagccctttgttagatggacagattgcaaaaatttactcccattctgtaggttgtctgttcactctgatggtagtttcttttgctgttcagaagctctttagtttaattagatcccatttgtcaattttggcttttggtgccattgcttttggtgttttattcatgaagtctttgcccatgcctatgtcctgaatggtattgcctaggttttcttctagggtttttatggttttaggtcttatgtttaaatatttaaactatcttgagttaattcttgtataaggtgtaaggaaggggtccagtttcagttttctgcatatggctagccagttttcccaacactatttatgaaatagggaatcctttccccattgcttgtttttgtcaggtttgtcaaagatcagatggttgtagatgtgtggtgtcatttctgaggcctctcctctgttccattggtctatgtatctgttttggtaccagtaccatgctgttttggttacagtagccttgtagtatggtttggagtcaggtagtgtgatgcctccagctttgttctttttgcttaggattgtcttggttatacgggcttcttttggtttcatatgaaatttaaagtagttttctaattctgtgaagaaagtcaatggttccttgatgggaatagcattgaatctataaattactttgggcaatatggccattttcacaatattgattcttcctatccataagcatggaatgtttttccatttgtttgtgtcctctcttatttccttgggcagtggtttgtagttctccttgaagaggttcttcatatcccttgtaagttggattcctaagtattttattctctttgtagcaattgtgaataggagttcactcatgatttagcactctgtttgtctataattggtgtataggaatgcttgtgatttttgcacattgatcttgtatcctgagattttgctgaagttgcttatcagctcgaggagtttttgggctgagatgatggggttttctaaagatacactcatgtcatcagcaaacagagacaatttgacttcctctcttcctatttgaatacgctttatttctttctcttgcctgattgccctggccagaacttccaatactatgttgaataagagcagtgagagagggcatctttgtcttgtgctggttttcaaagtgaatgcttctagcttttgcccattcagtatgatactggctgtgggtttgtcataaatagctcttattattttcagatacattccatcaatgcctagttggggttgctcttcttgaagagtttctctgtggtgttctctgtctttcttgaatttgaatgttggcctgccttgctaggttggggaagttctcctggataatatcctggagagtgttttccaagttggttccattctccccatcactttcaggtacaccaatcaaatgtaggcttggtcttttcacatagtcccatatttcttggaggctttgttcattccttttcttttcattcttttttctctaatcttgtcttcatgctttatttcattaagttgatcttcaatctctgatatgctttcttctgcttgattgattcggttattgatacctgtgtatgcttcatgaagttctcgtgctgtgtttttcagctccatcgggtcatttatgttctactctaaactcattattttagttagcagttcctgtaaccttttatcaaggttcttaacttctttgcattcggttagaacatgctcctttagcttggaggagtttgtctttacccaccttctgaagcctacttctgtcaatttgtcaaactgattctccatccagttttgttcccttgctggcgaggagttgcgatcgtttggaggagaagaggcattctggtttttggaattttcagcctttttgtgctggcttttcctcatcttcgtggatttacctacctttggtctttgatgttggtgaccttcggatggggtttttaggtgggtgtcctttttgttgatgttgatgctattgctttctgtttgttagttttccttctaacagtcaggccgctcttctgcaagtctgctggagtttgctagaggtccaccccaggccctgtttacctgagtatcaccaccagaggctgcagaacagcaaagattgctgcctgctcattcctctggaagcttcatcccagaggggcacctgccagatgccagccagagctctcctgtatgaggtgtctgtcgacccctgctggaaaatgtctcccagtcacgaggcacgggggtcaggaacccacttgaggaggcagtctgtcccttagcagagctctagtgctgtgttgggagatcctctgctctcttcggagccagcaagcaggaacgtttaagtctgctgaagctgcaaccacagctgccccttcccccaggtgctctgtcccagggagatgagagttttatctataagcccctgactagggctgctgcctttctttcagagatgccccgcccagagaggaggaatctagagaagcagactggcactgtggtgggttctgcatccagttcgaaattcccagcggttttgtttacactgtgaggggaaaactgcctactcaagcctcagtaatggtagacacccctacccccaccaagctcgagtgtcccaggtcgacttcagactgcagtgttggcagtgagaatttcaagccagtggatcttagcttgttggactccatggggtgggatccattgagcaagaccactcagctctctggcttcagccccgtttccaagggagtgaacagttctgtcttgctggtgttccaggcactactggggtatgaaaaaaaagcctcctgcagctagctcagtgtgtgcccaaatggctgccccattttgtgcttgaaacccagggccctggtggcgtcggcacccaagggaatctcctggtctgcgggttgcgaagactggggtaaaagcatagtatctgggctggatagcaccatccctcatggcacagtctctcatgccttcccttggctaggggagggagttccctaaccccttgtgcttccttggtgaggcaacgcctcaccctgcttctgcttgccctccatgggctgcacccactgtctaaccagtcccagtgagatggaccgggtacctcagttggaaatgcagaaatcacctgccttctgccttgttctcgctgtgagctgcagactggagctgttcctatttggcgatcttgccagccccccattcgttattcatttataaagacacccaaaacatccttaccagtactttttctccttcccttcctctctttttctacttcccaacctttcccccaatctctctcggtcctccttttgttctctagagctaacaacctgagtttgattaactcagtaattaaagctgataattatatgatttcactaggacaacgtttgtaaaatgtacaagtagactacaaatgtagcctctttgtttggatgtgtctgtatatatatattcataaagtaaccatgaatgaaatcacaagaaatgaaccatatatttggggaggaaatttagtagcttggggtgaggaacagaaataggaaataaactttttgttatatacccttttataacttatgcatgatgcttcttaaaaccgctgttctctgtggtgggaagatctatgcacacctacccccaaaagttcaggaagctgagaagctgaaggaagaggccaacaaatccgttttcttagaaagaaacatttaaaagggacttacaaacagatgccatgtctgtgtctcaggtggcagcaaaacaaaatggtggatccctgcaccattataaccccagacccagggcttatatgccattggaaaagggtgattcagagggatgtgtaggaagactgaagtatgataacatcaaggttgttttgacctaagggcaggatttatcataagtgtgctcttacacaaggaacaatagataaactggaaatcttacagaccttcctgggactggggttaatcagaagtcaacatggcagattagcatccaagatggagttactttagccttctaagcaaaaaaaaaaaaaaaagtctaaaactaaatctacatatatatctccaaatatacgaagttattagtttaatagtgcataggcagctccccagattccataacttactaagtgcccagagcaacaaaaccactaaaagtaacagttagcttataagtctgcaatggaaaaaaattttttcttttctctgaaaatagttttagttgccattttatagaagagtgccatgacatgtttagggtaccatgtttgaatcagtggcctggcaaaggcacaccagtgcctttcctattgtagtactatgtcaaactgtatgtcagtgtgcctggcctgaaaacacacacacacacacacacacacacacacacacaaagactagaagataaatcatctgagactgttccttagttgcattggagacagctgcaatgaggtaagaaaagtgacaaagttgaattttaaccttggtctttttcgaaacataagttatagccattcctggttatgtaagtcatagtcatgcccttttagcaacatctgtgtggcagagatgcatgttcaagtttgagagttagttatgcagggattggatattcttgattttgcctcacagttttcttgctcttcatttacaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattgtga

SEQ ID NO: 6610 - DNA, 103 bp, mus musculus
gaaagagcagacttgatagcttatctcaaaaaagctactaatgaataataattggccactgccttatttattacaaaacagaaatgtcttatgacttttttat

SEQ ID NO: 6611 - DNA, 514 bp, mus musculus
gtccttaattaattttcagtctatttaacaagatccccactgataacagaatctcagtgaatttgttgtaagaattcagggagtcaccttggacttcctgataagtggtaaatctaaacttaccacctcttggccaaaaatttattggttttgtgacatatacttgtggctgctgtatatgaggcagtttggttttaggttaaacaaataatttggaattcatacaaagcttttactttttagcacaaatgtttcataggaaagactgatgacaaattgtgaaggtattatgggtcttcaccagtgaaagtatttctgtggaatttttgagtctgctgcattcattccttctcccattctcttctccatgtttctgatatttatatagtcagaaaccaactatatgaatatctagtactaatcatgctttaatatcaaatctttatcagaattgctgggggtcatcaaatttggtagggaacatcaaagccttggtgctcttttcttatgcagc

SEQ ID NO: 6612 - DNA, 785 bp, mus musculus
aacactatcattaagaaccttccgctacactttccctctgacaaaacaagcactgtcaaaccattccctgtgtctgttaaagcttttcaggaagcagaaactgggacagaattacaagtgtcagaaatgtactgggacaaatccttgggaagaggaatcaggagcaggcagggagagtcttcagatgcaatgcatgcctgccacttgtgaaaagagaggaaagcaagatttggtaagaagctcagacttcttttagctcttagaaagtctcagccaggccaagggggattcctagagcaatagttccattagaggtgtcctgtcttagacagaaatggccactatgcttagtcaacggctggagacatcctggggagagcagggtctcagcacccaaactgcagcagatcctgatggtgcagctggtggatgccgttagctaactgcactcctcacagcgggttctctcttccagagaaatatgaacagcgcacctccctggcagtagtaatcccgtgctatctcacgggcttgccctgctccttctctgcatcattttactggggtattttaggtggtttctactccaaatacctcatatgtaaaattcactcaaaaaatcctcccttctctgtgtatccttacccctaagtgcccattgcattatacaccgcagccatttgcaactgcaaaatcatttttattagcatacaaggaactctggatttaacctatattcttactaggaaatgaagaattgcgtatgtgctattactcaattacca

SEQ ID NO: 6613 - DNA, 375 bp, mus musculus
ttaaccagaatcaggaaaggagtgtatagtttgaaaacattctcaatattataattttttatttgtaaaatgaaacaattatttctatgcttttcatgatttcagctgaaggtaacgtaaaacaaatatttttttgattagtgcagatatgcagaagatatttttaactagaagcggtcttctcctgaagggaagatgaagagtaaaatttaattttaacaaaagaggatatgatttgaatattttaacactaaaatagatgtcttctaatatttcttccaacattaagattctgtgagctttcaaacatttaaaatatcttgttttaaaatatgttattgtaattattttccttcctcctacatgatggttgtg

SEQ ID NO: 6614 - DNA, 1196 bp, mus musculus
atatattcaactattttaggatatatacaaccttaagttatctgtgaaagccagatgagttctggagacattggtatgcaagatcatgcccctgagactatttgttttccaaagctccttcatagcatccagtcctcaaacaacaaacattcttttgctattgaaactggttcagaacagaacagaaagaacaaggcttgctggttgaagcattggaggtaagccgaccatttgcttcacaaagcaaagcttcaccctacctcttcaaggcgctttcatctgaaaactggatttggaaccaagtagaaacaagctctctccagtgggattcatcacttcctgatttcagatgggcacaaacaatagactcttgtattttcctgctattcacgtttttagtcaggtctgaaactgaaggtgtgcttaaataatgatggcttatacacatttctttttctccaacctgggattcagagtcatactttcccagataaaggtgatactgtttttcaggtcagttcactcaaagatggtgcaaaataatatgaggaaaaagtccttcataatgagacagataattggaagcatacagtctctgctgatcctttcaatgccctgtaatttttttttcttgatttttaaaagatgtggatttcttttctgagggcagggtatagggaggagagctctttggttgtccaaatgctattaaaatcagataatttcatctatgtgactttcaggaagccatttgtttcccatattctcatttgtgtttaattaacaaagactgcaattgtttacacctatacacactagaagtttgaaagtagtgctgctaatcatcaatgtgacactttcatctccattgctttttaaggatggtcagtctcttttgaaatggaaataaaaaaatacgaactaaaactaaagctacacacaagtgctgtttttgcctccaaatcttcataaatgtaaaaccccattattgatctgacttatcatttcaacaaatcctgggatgctgcaaccacaaatgtacattgctcttgctcacaagagagtctgttcaactctcccttccttagccacctactcatatgtgaaagatatctgtggacaaaacactaaaagcatcgaactgataatgttttgggccagctcatgccagaacactcttaaagaccaattttatt

SEQ ID NO: 6615 - DNA, 1353 bp, mus musculus
gggaagggagacttcatatcataatacaggtctgacacctgtgaaaggagaggggaactgggcccaagagcctcaggctgcatgcagcatagttctcagaaagtttcaaccagccggctcaggtgtttccaagccaaacttgctcatcagaggagtcctacatcttccatgaacgtgccaccaccaacaccccgtgctgtgcccgctcactgactgggagtagtgccagagaagcatggcttcagtgcaaacccagcagtgtatgccttgggaaggcagggggacctgtcagtcacttccgctccgtggagcaggagatctgagaggccatggtcaccacagacaagactgtagagaggatgcggattctaatgatgacatggtctagaactgtggtagcaaggactgattctgaaggggagaaataattactggagatgaagttacaggaaggaggggactggatgttggagttcaagttcaaccacagttgtgcataacacaactccaagttgtgtcaagcaccccacagtcactgaggatttggacagttattaaaacaatcttctggcagatggcaatatttggggttgtggcgggggggtggggaggtgggcggggggaaactagtttgtcgatgccaggatttgaggtgaaggttcaagtaggagctagtctttgaagaactaatcatgacaaaactcactaggaataggaaatctataaattacaggctgaaaggaaaaggatggtattgtccagtgacaagattctcaaagaagccgggattttggcaggcagaggacgtgctgctctgcgaacaaccacgactcgcacggaggccgcccccagcctgtccctaaggcacgtggtcctctagagggcttcgcgggagagttctggctcaaaccagggacggcgagggcaaggggtgaaaggggtttgaggcgaggcagaggactcaggggtctgcggacggctggtcggcccgtggagacggccgcggcgaggcgcctgaggtacggcggtgcggagcgagggcgaggtcccgccggcggccaggcggcggcgctcacggagccgcgggcttccccaggccccgggcagcgtgctggagctctcgggcggcgccgccgcggagcttggcgcggcagctggcagcggcctgacgcgtggtgacggcgcccgcgggcaggcagcggctcccgggggcggccgggcgcagggcggcggcgctgcgggacgacggcttcgcgaggcttcggcccgcacgggtggcagcggtccccagggaggaaagacaaagatatgcgggttagaaaccaaggaaagagcgccgacgcctctcagccc

SEQ ID NO: 6616 - DNA, 965 bp, mus musculus
tttttcagggaatcctaaaaaagttctaagatacctgggaccttcacatagtctgaaagtcctgcaagtcttccctgagtgattctgctttcaagatcatgtgattgtgaagccttaacaaatagtgattctctcttcaacaatcaccctgttttttaggaattaattgtacagggccccgctaaaagcctcaaaagcctgcaaagggtaacctatggcctctaactggatgcctctggggctctacagttgatttctggaactgaggcaaagctgtaggtcagagtgccaagaggcttattaagcctgagaaatgtgaaacttgacaaagtattctctgatacatgtggcctattgagagactggttccctttgtctgcttaagcagttttacttcttgaggaatgaaatgcaaaggaagggctctccttgtctttccaggttagcagagaagcatgttcacttcacagcgattagctgagcttgcccgagacttttgtgcccgtcgtggcctgccagttccctccctgccttccctgtggcgttttagctgatctgtgctgtttgtagccatatggtcccctgagcacgtggcttggcttccctgttcctgctgctggatccttgggcattgcagatttcacagacctgaataacattgttgtggggggtgggggagggatggagtggaatcatgtcctcaagaggtgtctccttaccaccctacctggttagaggcttcttgcttggtcctctgtacctatatatagattaagcagagccctgaactaggtgctttgaaaagatgtaaaataactagaagtggttcctgccttcaaggagcttacctgctagggctttgtctgggagcagtaagtggttaactggcattggtggccaagtccagttttggagatcaggatataaactgtccatgggtacagtagattttaaaatgtatttgg

SEQ ID NO: 6617 - DNA, 2245 bp, mus musculus
ggataataacatgctttggatacctcagctgaaaaagaatttattattagattattcagggaattaaggcaccttctcagcatttgaacggtgaaactggatggagaattgtttaggatactggaacaattctagtagccaggtgctactgtagcttttccttgtacctctgtctgcttctttctccatctgcttgtcctgtcctactgactactgctgactttctcccaaccttgtggcctagatagatagatagattgattagatagatgcatagatagataggtagatagatagatagaggcatagaaagatagatggatggatggatggatggatggccggccggccagacggacggacggacagacagaatctgccatctcatggcttctgtttactgccttctctatttctgtctgctctttacatgtccttatgtgtctcacattcagattatcaaagagaaagaatcttcttagaaagcatttcctggggagagtgtccctattaggaagaattctgccaaactactttataaactgctaatcaaagcgtgggtgccaaaaccttggtctaatctaatctgttgtggacaagatggtaaagtaacatggtctttacctaaaggactctcatctgaaggctgtaagcctggctgtcactcttagggtactgcctggtacaagagagctgtaatattttgctagtctttgtccctgcgtgaagtacagaaaccctgtcaccaaggatgccatcaacctgaacaccatcgtgaaaggctcttcatcatctttcctactcaaagaaaattcatcttttccttgtctgtatattttgaaaagtataccaacgtattagaaataaacctgtatgtaattatggtataacagagacgttatctttttcaaatagatatatagatatagatacttatagatttttgttgttgtttaggagaactcatccagattcattctctgcacctcagttttgcttttttttttttgagacaggatctcgttctgtcatccaggctggagtgcagtggtacaatcatggctcactacacccttgacctcccaggctcaagcagtcctcccaccttagactctcgagtagctgggactgtaggcatgtgccaccgcacctggctaatttttgtagagatggggttttgccatgttggccaagctggtttcaaactcctggactcaagcagtccacccaccttgacttcccaaagtgttgggattacaggcatgagccacagcaccctgtttttttgttttttttgtgtgataaacgatgataaaatagatcatcatcattgcattattgtgagaatagatgaagtgatacatgtaaaatacttgatacaatgtctagcatattacaaatgcttgataagtggttgctgcagttgtttttactgactgagacatggacataatctcattaaaagtaatcagtgttaatgatattcatttaaaaataccctgcttatttcagtttccaaggtatctgttaagcatctccattagaaaatacacaaatctaagcaagtgtttttatttttatgtctacttgttttggatgaaacacattgggattttctgaagttctgttttataaaatacgtagtatattcactttgtttggtagttggtttagtgctaccttgtagttttaagagaagataggaaatgctcctacccagtctctagcaccacagctgcctgtgaccacctggcattaccattacatttccaagaactccacaactacactatctacctggcagtattgttaattctggattcctaaactgacattttctaaatatccagaacaactcctcatactcagtataacagtgtattttattccaggtctgaaagacatttctgatattttctcataactccagataattatccttgtgtacattttctaggtttgaagaaaaggcccaagtggatccccttagtgctctgaaatatttacaaaatgatctttatataactgtggatcattcagacccagaagagacaaaagaggtaaagaaaggtggtaataaatttcagaaattaagtatttttaaatgtcttcctaacttatatttaatgattttgctcttgagtgtgtaaaggaaaacgaagaaaatatgatgacatcagtaatctttaaaatgtcacagagcaggtgaaataaaaattgaataggcatgttttcgtgtgataag

SEQ ID NO: 6618 - DNA, 2245 bp, mus musculus; identical to SEQ ID NO: 6617

SEQ ID NO: 6619 - DNA, 977 bp, mus musculus
cccaaggagacatgaccatgctctacccagtctttttggataggggcatggaggtaggtggactctcattctcataatttccgggcatgactcagccagggttgttgagtatggccgcccaggctgtgcactgcacagctctaaggggaattgtgcatcatggtggaagacctgccctggagcccagaatcagtcaccaactgtcattgcctagttggccaggccatgtggtttattcattcagatgctcctgagatgtgctacaattctttatcagcaagcagtgcccttgcagttgctaagctagagggctgtctctccactggcaccttctccttctagtcctagcaagccccatggtcacttcagtggaggagactcccttgggcccagccagaggacttagtgtccagagctgagttcattgcatccctctccctaccctaaatatgaggaaagcagaatgctggctccttttttttgttgtgccccaaagctgttcctccacccctatgtagcctctgacttaaccaggtgccactcaccatgcaagtgggggaggctcactgccgtatactccccaacccagactggtgtccaccagcatccaactgcacagcacatcagctgtctggccagcttggagagattcctcttcctttgctccaaccactcaaaagtgcatgcatgcatacctccataaaataaaaaacaaaacaaaaaaactgaagaaaaaaacaacacaataacaagcaaaaacgctagtgaccagatacctcagtgaggcattttcccctttgcctattagtctaaccaccccagaccataatcaccatgagcaatcccagctgtgacatccacaggactaagggatggatggtccccagagacttcttgctccagtgaacaagcatgtagtccctatgctttcattcctttgaccacctgacatgatgctaagctgtaaatcaggcagc

SEQ ID NO: 6620 - DNA, 203 bp, mus musculus
ttcatttttgactggttatttacccttctgggtgggaagttatagattatatttttgttcttttagattttaaccttaatttttagcacctactttgctacagagctattttaaagttatcaaatgtctatttttctttaatatttcaagtgcagtacacattccaaggtatgattattattcttgcctatagcaattatcag

SEQ ID NO: 6621 - DNA, 203 bp, mus musculus; identical to SEQ ID NO: 6620

SEQ ID NO: 6622 - DNA, 644 bp, mus musculus
ttttgctggtcaaacagcaatacttttgcctttttttttttttttttaacttggtcgcagttgaagatgatgaaaaatccatttactcgtgaaagggtaaatgcaacttcctgatgtgaaataggggcatttaaagcactcacattaaggaaagtttgcattttaaatataaagtagtcttaaaatttttctctacccacatataaacaccattccaatatgtgtgaagagctgttgttcatcttgtaggatcactaatcacaggattaaagcgatgaggaagtatatacagtgaagaatgatgcccttttctttaaaacaaaaatctggaggcagccagaagagcttgggaaaattcttgtattttatatctattatgctcttgattttatatctactgtatctccctgatctgtggccagctgggatgcaaatacggcacaagaagttcacagtatcaaaggagcaagtgaataggaccccagaatgtgattgttatgaaagtactgagattattacatttaggccctatgtgattctggaggaagtgagttttactgctcagtagaaaattatatatatatacactgtatatataaaacacacacacacactgtatttagaaagaaaaagaccatctgttc

SEQ ID NO: 6623 - DNA, 644 bp, mus musculus; identical to SEQ ID NO: 6622

SEQ ID NO: 6624 - DNA, 190 bp, mus musculus
ctggagttttagtttctgaaaatggtaaaatagagattccttggactgagggacataagtcatagctgagtgtgagggctgttattctgaaatcaggcaaagtttacattaatgactgctgacacttctgttctttttcctattggctggcatccaggaatataacttcagacaaaagactagaaagtct

SEQ ID NO: 6625 - DNA, 2227 bp, mus musculus
cctatagagattttctcatgtccagtttgggactgtaatgtagcctgaacccttccacccacctccccctgcccatccccaccccttttcaaactcctaagtctgtcctgtctagtcccagttgggcaaattgcagaacctcacgtttggtggaatggtctctgatatggtttggatgtttgtcctctgcaaatctcatgtcgaaatgtaactcccagtgttggcggtggggcctggtgggagctgtttgggtcatggagtcagatccctcatgaatagcttggtggtgtccttgtgataatgagcaggttctcactctgagttcatgtgtgatcttgttgattaaaagagtgtagcacctacccttctcttgctgccgctttcactatatgcatgcctgatctgccttcaccttccaccatgagtacaagctccctgaggcctcaccagaagccaagcagatgccagcgccatgcttcttgtacagcctgcagaactatgagccaattaaacctttttttgttttgttttgttttgttttgagacagagtctcactttgtcacccaggctagagtgcagtggcacaatctcagcttactgcaacctctgccttctgagttcaagcaattctcgtgcttcagcctcctcggtagctggacttacaggcatatgccaccatgcccagctaatgttttatatttttagttcagatgaagtttcaatatgttggccaggctggtctctaactcctgacctcaagtgatccacctgcctcagcctaccaaagtgctgggattataggcgtgagccactgtgcctggccagaaacctcttttctttataaattacccagcctcatgtatttctttatagcaatgcaagaatagactaacacagtcttcattatagccactgccccattttcatccatcaggtggtagtatctctgctctgttaaaggtgatttgtgatctacttggaggttatcacttcaaggccacccaattccatgggttcggatggaaagatgcagctagtgtgcaatgtcctttgccttttatctgcctcattgggctgcgatgccatgattcatctgcagtagcgtattccatactaccacatcatcagaaagatctccacttacttattggcattccatgggagccttagtgacaatgctgagctgatggaagggtcgtatgcatcatgaatatgaatatcattattcaaattaccctggtacatgttgaagataaaaggcaatgttttattttgtgttcattaagcactagagggtattttcccgtggctgccgactcattatgcctgttatggttaatgggagttaaattccagcatcacgttaaggggaagaaacgatccctcaagtatttggaaactctttcctccaaattgcagatcaaagctaggttaggaacttgtatgctgtcttgctaatggattagacaaactgcattatttgaatttttctctcaaaatgctaactttccctaagtagaaatgattacagacattttgtaagcatgagtgattgtgtgatctactacagccagccactattatggcttttccctccaggggagaaaaattaacattgtctaggctggttgcggtggctctcacacctgtaatctcagcactttgggaggccgaggtgggcagatcgtgaggtctggagatcaagaccatcctggccaacgtggtgaaacccgtctctattaaaaatacaaaaattagccgggcgtggtggtgcatgcctgtaatcccagctactcaggaggctgaggcaggagaattgcttgaacgaaggagttggaggttacagtgagccaagattgcaccactgcactccagcctgggcaacagagtgagacagcaagactccgtctcaaaaaaaaaaaaaagaaaaaaaaaataacattatctaaatgcgtgttatgtatcaggggctctgcttatgccttctcactcacagtgaacaaaaaccccaatgagacatcatatatatgaggaaactgaggcccagaatggttaaattacccaccccaaatcacccagtcgatgggagcgccagacaacaagcccagggctttctggcttaaaaacatgagaatctactgtttggggccatctcccaagtgtctgtcagatgcctgctctaggagaatgttatgttcgaggatggagtaggcatacgagaagagc

SEQ ID NO: 6626 - DNA, 1021 bp, mus musculus
aaattctgatatatcagggcctttatgtctcccatggtgcttaaaatagaggagatgcttggtcaatgctgagaaagtaggaaggttttttcttccccaaaaggaagaataaaacaagcagtgacctgcacagagccctacacatgtgcttccgttgagatccatggctgctgtacacctcagcacacagtgtgcctcaggcctatactcctgagtacccacactcgcacccctactcacacacagagatacgcacgctctttctttctttgcagggcagtgtgatggtctaaagtagaacactgcctgtgatcaggtaggccattggaaggcttgtccccaaatggcctccgctgcatctggaaatctgacctgaccagctcaaagggagtaatctaatcctggtcacattttcagtgagttctcaagtatcagccgctttcctgatgcaaacccagggctgaatttccccatgaactagcccaggccggccaactatttccaaacgagaacacagctcctgccagtgcagacttaacaagaacttaagtttctggggcaactcagccctgctggagattcattatcccactgttagttaaggggcaagcaagccttggctggcaagcctgctaggaggccaagaagtggactctgtggcattttataatgatgggtaaacagcagaaagaagactccagcttctccccgcccactggaactccagagctttgggtcatgtctggtggtaggtcaaagaccaccgtgggtggtggggcccaggaatctaagttcttaacaagatctctagatgattctggcatactaaagttggaggaatcctgactgtattaaagctatccatgctgttggcccttcttatatggcccaagttcagaatttctcccctcccttggtgaaggaccctgtgatggctcagggccacccagctaggcctgggcatagagccgtggcccattaacctccttccaccgccgaaccatttcttgtttgctgttgc

SEQ ID NO: 6627 - DNA, 658 bp, mus musculus
tttagggaacctctgttgtctatgaagccatactctctgaattcacaaaactcgtgcttgtgtaaaataatagctactacattaccatgtcttgctttcagttcttttctgcaatttagtaatttgctgcatgtatagttggcaaaatttaatttgtttatgatgattccttttactttctttgcagttgagttttgccatttttccatcttggaaactgatatgaaacataaaaatgtttagagttgtctgacaactccctaggaaacttttaacaaccattaatttagaaacaattttgcttctgtaattcatttctcaattggttgtgatggaagtaattgtcatatccagagggagaatcttgacttcaggcaatacataaatatctacactcttcagaaacagcattgttttagtggtaaatgccctcagttataaagaaaaatggaattaaatcagggaagcataataccatggcagaaccctttctcaataacaatcaaaattaccagccctgtgcatcatacacttcagtaagagagaaagactgattttattcttgaaatctttatttctcaaatgtttgattaggtgagtccatacctatgtataatccacacattcattatacatgcaacaaaagtatttttattac

SEQ ID NO: 6628 - DNA, 1147 bp, mus musculus
ccaatttcctttgatatgcctcccaagatacagggtgatggtttattttgggcaaggctgacagctgctttccactgctcttttgcaaggaactgcatgaggatagccactgagtttatttttacatctcaccacaggacaaaatccacattttcaatcaagtgttggacactccaatttaacaaattgtgaaaaatctgttggcccagataaacgtatgctaagagtattcctttctctaaattaagattttgttcccggaagcccaagaattcattaaggccataattagccatgatcactgatgatttaaaatacaataataaagaggaagtttatactgagcttcataggcaccattggatctgtcctgcggttgactttttatagctgtagtttaaaaataacttttccatttcatctgctggctgtcttttctccacccagcccttcatgcaagtagggtgggggctgtcatccaagctcccattgctgcaggcagtgacatctgtctcagtgacatcagagaaagtgccacatcatctcaaaccaacatatcagttacgaggtcacaggctttcccataaaaaggactggcctcatctgtcatcagtgaaaagagacagcaagcactcttcaaagatgtatttgcttcagcaaacgcagagttaccctgggagggggcattttctcattattccatgagctgatgtggtcaagggaattcatctgagtagctgcctaaactcagaacttaacttgattaaaggcacatagcagtcatcctctgattgaaactcaggtgtctttgcctttagagccaatcctcctgatatatatatgcatcagcttagcaattctaaagccatctcatcagcttttttggtgtttcacagagagacaggttttatattttccatttttctaaataaagcccaggcttgacttcctgaaccttaactaggcaagaagtacccttgattcttttatctattatctgcattttatctttgatgtatccagagaaaataccacacaatatttatttgccctgatggtttttgtgtcattgttactgaaattttgttagtatgcatctccttgccgtcagaatgggttttattgtggctcttccgtctatggctta

SEQ ID NO: 6629 - DNA, 811 bp, mus musculus
cagcatagtgatggcagtatacacaggctactacaggaacaaagaaaaaggatacccaagtcagctctgaggagcgagagacagatcctaaaatcagatgttcaggggttagccaggctgaattggggaaagtgacagaatagacagctttgaaggcagaggattgagcctgaggcagggcacaaaggggagaagcaggatatggggtatttgtgaaatggtagtcagttttgttgcctaagcatagtgtaatgcaggatagggaagagcccaggctgaagagcaggcagaccagactgtgggaagccttgtgagtcttgtgagggcctagtgtgatgaggtggaagggttttaaacagcggaagttcagaagtatgactctgtccatgcagaacacctaagggcttacttcccataaagaaagctctccccgtagtcttccaggtgctctcttaagtgtacttttcatcattacttacactcccttttggtgttttataggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtag

SEQ ID NO: 6630 - DNA, 347 bp, mus musculus
aaagacaatgaaaggaacccaagtgatttaaatacattgataaattttccagaaatgtggtttgtcacaatatatcccacagtgggttttctgatgtagttgtaattatcttttgtaataaatatacaaacaattttcaccagcccatatgtctactcaaatgtaggactgtcattccttggaaaagtatccaatctagtaattttgaaatcataacttactgtttcaggttgcaatattctgattgtaagtaaggttgcgaagttattctcatgtttagtggtaacttatgttcactcttgtgtgaattgcctactcagcctcagtattgctatttttattgagct

SEQ ID NO: 6631 - DNA, 48 bp, mus musculus
caatgcccactgttttcagagtgaggccttcttgttactcaaaccact

SEQ ID NO: 6632 - DNA, 893 bp, mus musculus
agataaccagacttgggtgagtgaatttattctcctcggcctgtccagtgactgggacactcgggtctccctgtttgtcctgttcttggtcatgtatgtggtgaccgtgctggggaactgtctcattgtccttctgatcagactggacagccgactccacactcccatgtatttctttctcaccaacctctcccttgtcgatgtctcctatgccacaagtgtagtccctcagctgctggcacattttcttgcagaacataaagccatcccattccagagctgtgcagcccagttatttttctccctggccttgggtgggattgagtttgttctcctggcggtgatggcctatgaccgctatgtggctgtgtgtgatgccctgcgatactcggccatcatgcatggagggctgtgtgctaggttggccatcacatcctgggtcagtggcttcatcagctctcctgtgcagactgctatcacctttcagctgcccatgtgcagaaacaagtttattgatcacatatcctgtgaactcctagctgtggtcaggctggcttgtgtggacacctcctccaatgaggtcaccatcatggtgtctagcattgttcttctgatgacacccttctgcctggttcttttgtcctacatccagatcatctccaccatcctaaagatccagtccagagaaggaagaaagaaagctttccacacgtgtgcctctcacctcacagtggttgccctgtgctatggtgtggccattttcacttacatccagccccactccagtccctctgtccttcaggagaagttgttctctgtcttttatgccattttaacaccaatgctgaaccccatgatttacagcctaaggaataaagaggtgaagggggcct

SEQ ID NO: 6633 - DNA, 687 bp, mus musculus
ttactatttaaggcattgataccaaacctgagataaacttatgaaacagaaaatcacaatctaatcctactcatgaacatagatgcaaacctcttaaagaaaatattaatgaaacaagtccatcagaatgaagtaaggatgtattataatgaaactatgtatacccttaaaatgcagcaataatttaacattaaaacaaacaacaaaaataacttccccacattaacaaattaaagaatacatttcatatgaacatctcagtagatccaagaaagtgtttgacaagatttaagatcaattctttataagctaatatcgcagtaagactttctaaacagaatctaccaaaaacaaaacaaaaataaaaacaaagcagacgtcatggttaatggtgaaatgttagcatctgtccttttcgggtaaagaatcagacacaaaaaaaatcacttgtttttcttgatttcactttttactagagatcctaaccaatacagttagacaaaaagaacaaatacacccatgcatgcgcacacacgcacacacgcacacacacacacactcacacgtgcacacacatttgagaaagaagaaacaaactgtaattacatacaaatgacattactgtatatgtaggaaattcaaaagaattataagaaattttaaagtagcttgatacaaaatcaatat

SEQ ID NO: 6634 - DNA, 1048 bp, mus musculus
ggttgtaaatattcaatactaaaatgttaatatcagcatagatttttaaagtagaaattcaatgcctcttttaaaaattaattacaaaattgcatccaattgggtcaagatcctaaggagacaacctgtagctcttgaatcatagctttcttattactgatgtatatgattgaggcagatgtgatcatagggggaaaacataaagtgttatgcttactctaggtttttcctagatgtcctttattaagtgataaaatttccctctcttcctagttcggtgaagttttcattgagaatggattttggcaaattctttttttattggttgaaatgatcatgtgatcatttggtgtacctgatcatatgatcatatgattttccttttagtttcttactggggttaattacaatgattaacagtgtaactgagaatttttaaattatacaatttgggctgggcgtggtggctcacgcctgtaatcccagcactttgggaggccaaggcaggcagaccacgaggtcaagagattaagaccatcctggccaacatggtgaaaccctgtctactgaaaatacaaaaattagctgggtgtggtggtgcatgcctgtagtcccagattcttgggaggttaaggcaggagaatcgcttgaacctgggaggcataggttgcagtgagccgagatcacgccactgcactccagcctggagaaagagtgagacagtctcaaaaaaaaaaaaaattatacagttcatccattgaaaatgtacagttgaaatgttttaaagtatacaattcaatagttcttggtacacttcaaccattactataatcaattatggatcatttttatcactccaaaaccctatacccattggcagtcactccctatttctccccacttccctcttccttgagtctctaggcaactactaatctactttctgtctgtatggctttgcccattctagacatttcatataaatggaatcttacaatatgtggtcctctgtgactgagttcttttacttaacataatactttcaatt

SEQ ID NO: 6635 - DNA, 499 bp, mus musculus
aaataaaataaaattataagatgagctacaaagtaagataaaatacattcaaaatgagcaagcgagccatagactgagagaaaaatattcaatgtgcatatatctgacaggggcttatgtccagaataaaaatataactcctacagtgaatgctaagaggacaaacaaaacaaatacaaataggcaaagacttgaacacacttcacaaaataatacaaatgatcaacaagcatatggaaaagggcttagtaagttgtcaaaaaacatccataagaaggactaaagttactgaaaacacctagtgttgctgaggctgtggcatcgttttggtggaaatgggaaacggtactttggaaaacttagcaataaaaaggaacaaactactgacacatgcaataatgtaaagaaataatacaattatgctgagcaagagaaactaaaagcaaaggagttccaaatacatgatttaatttatatgaagttctagggcaggtaaaat

SEQ ID NO: 6636 - DNA, 671 bp, mus musculus
ttttctttcgacataaattctttgataaaatattgtttgggtttgggatttttgttttgttttgttttgcttctatgagcacttttagagtctaatgaagtttcacacgcttattttcctaataactctctgtaatcataattccctctttaaaaatatggaaatgtatataacaagttatttttacttttttccttggcctgccctaaagttcagtcacgttggcattattagaacagagcaatttctccatgggcactgttccttctagtttttatcttcatttcaaaatagcggaatctgttttattataagtttgaaagtatgagttttaggtaattgcatattctccttaaagatctacaattttcattctttctctcagaacatctgcttgtcaagaggattttttaaattccattaattctacctagattaatgtttcaaatgctgtaatgtcagtttgtcttaatatataatattattatttgtatacataatttcacttacacataatctgtacttctggcattagataaatgttatgaattcatacttctctgtattaccaaaccagttattctttgagtgtgtccataacgtaaggttatcagtggcacatggaaatgtctcagatagggttgccagataaaatactggatgtgcacata

SEQ ID NO: 6637 - DNA, 133 bp, mus musculus
agtttatgaaactgaaaataactttttaacaacatcatgtatttttcttattaggcaaggttgtttagttgggaattaaaatttttcttggatggtttaaaggtattgccaaattggctgtaatatgttcaaa

SEQ ID NO: 6638 - DNA, 213 bp, mus musculus
actatgggggcataaatcctctaaaccagattttctatagatataaaaattaaaaagagctatgatacaaagagtccccatttgctctatatcccatgatttattcatttgatcaataaacatatgtgcagggatctaggtataacaacatgagaaagcaacaatcctcgtggaaatggtggaagcaagagaaattagaatttataaatgtgt

SEQ ID NO: 6639 - DNA, 474 bp, mus musculus
tggtgccaaagcacagaagaggaagataataattttgaggtatttgaactggactttgaagaatagaaagtttttttttttccctaaagcagtgaaaacagttgaaaggccagaatgatttatttcaagtgttacctttaaaagaatattaatacttgacagtctcttcacatatatgcctgtttcttttctttcaaaaaaactaaccccatgactagaattttgatctacttttgcctttttttttcttttttagtttaagataaaataaatagtctaacatctgtaacatatcatggctgaatttggttatacacaacatgcttcattttcatatcatatcttacttgagtttaaacctgcttttcatattttactcctttctgttactcaattcaaaagtatttgccatgaatgacttcataaccatacattttagatggtctgcttgggatttttttttgccttatattt

SEQ ID NO: 6640 - DNA, 318 bp, mus musculus
aaatctgaccatattacatctgggctgactacacgttaatgatgctacattgcctataaagtccaagctgtttgtttgaaatttaatttctgcccacccactgactacctctgtagtcttaaatccagtcatattgtgttttatgctccaaatatgaatacaagctatatttcctaatacatgagtgacctgcttgtttaacaggcagtcattggagatactttctctaaccaaaatagcctctccatcatcctttacctgaccaatcttttttatctttcaagattcagttgaaatgcagtctttaatgagaatcat

SEQ ID NO: 6641 - DNA, 1863 bp, mus musculus
ttagagactgcaattattggcatgaaatgtaataaaagtggctgtgcttacctttatattgctacacttttctcttaatggaaagggactccctttgcttatttgtttagaaaaaacctcagggactgggccaggcatggtggctcacgcctgtaatcctagcactttgggaggccaaggcgggtggttcacctgtgctcaggagtttaagaccagcctggccaatgtggtgaaacccccgtctccactaaaaatacaaaaattagccaggcatggtggcaggcatctgtaatcccagctacttgggaggctgaggcaggagaatcacttgaactcaggaggcagaggtttcagtgagccaaaatcatgccattgcactccagcttgggcaaaaagagtgaaattccatctcaaaaacaaaacaaaaaacaaacaaacacctcacggactgtattagagtcagtctctagttttgttgtacttatctccttgatatatccacacactaactatactcaaacctcacagactgcatgaaaattagcttcaaacctaaaataatacaaattatacaacattcattcctgaactatttaaaggctttggcctaaaggaagagaaagctcgtcttgttatcttcacaaaacctgaagatgcaatgtcctgcttccccaagattatactgcctcaatcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcgaatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgcgattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccagccctaatttttgtatttttagtatagatggggtttcaccatgtcgaccaggatggtctcgatctcttggcctcgtgatctgcccgcctcagcctcccaaaatgctgggattacagacataagtcaccgctcccggcatatatggacattttttgtgacctagtcctaagagtttgtctcatcccctcctcttgtagctgcctacactgcaaagtgggccaatcaccacctgcaatgaggctgctagctacagggtggcttgagactgtgtggtgatatatacgtgcacttcacttcatttttcctcagcgtagtca

SEQ ID NO: 6642 - DNA, 628 bp, mus musculus
aactcagtaaacaatggagtctaggccagacaaggagggagagaaatataggaaaactccagtggttttgggaaagaggatagattcaaaacaaaaactttaaagggttacaatgatagttatatgggtactagagtaagtgatcttgaggacaagaggcatttttgagaagaaaatgtttgaaatgaagatgcaagatgtgcccctgccccaggttgtgacaaaagtgaattgagtccataggaacaggtgtcagggatagaggatgcggttgtttgagggagggtatcaggacctgagaagccaaacttgatgagtcattttacgaagggtgacctgttaaagaatacccaggaacaggcctggagtagtcctgaaagagggaggcaggtgccatggactaagggaccaggaaggtgcacacaatctcacaagactccagctgccatcacccatgttcatttccttgaagaaatcatcttattccttaatttttccccaatatatagtttgagactttctgattctctttctataaatacaaagccctagagatttttattatctggtgatccaaccctttttggagtgactaatcaaaaaagcacatgacagtatgcatatttta

SEQ ID NO: 6643 - DNA, 1104 bp, mus musculus
taataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaa

SEQ ID NO: 6644 - DNA, 965 bp, mus musculus
tgtctacaggccgggtcggaacgtcagccccaggagccgacggtggctctctgctcgccccggggaaggtgttgctctcctatcggccccaattccccgcccggcgcctggggcttggctgcggggctcggctcccagccgagggcgcagggctggccaggcctgctttggctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggctcgtctgatccgcacagaaaggccgaccttgagggcggcggtcgttcgggggagaaagcggaggctctgggctcgcgggagcgcggcagccggggctggcatcgcagaggagagacacgccactgccccgcatccccagaaagcgcgaggcgccgtcccagctggggcaggcggccgaggccggtcctcatgcgcgcttctcgaagcttcctgaaacaccttgcggagttccgtgtgtatagaactcagcaccgcccagcccctgggcagctcaactttctgcagccccatcccagcttccccg

SEQ ID NO: 6645 - DNA, 214 bp, mus musculus
gcaagtgctgggatgtgcaggggctcaggtgtgcaggtgctggtgtgtgcaggtgctggtgtgtccaggtgctcgggtgtgcaggtgctggagtgtgcaggggctcgggtgtgcaggtgctggggtgtgcagggggtgtgcaggtgctggggtgtgcaggtgctggggtgtgcaggggctcgggtgtgcaggtgctggggtgtgcaggggctgc

SEQ ID NO: 6646 - DNA, 519 bp, mus musculus
atatattactgaactgttacagagaagaggaaattacccagtcagaatagatatgtctctgtagccttgtatccgcattctaatagccacagagtttatcttagtctgaatgtagctctaagttattaattgttttaatgatttcattgatttctgttaatctgggtaatgtgtcttactaaacgcggtagtttattttgcttttcaattaaccttttacttttgttatatcattttttattaaaaacaaaggttttatctacattttaatgatatgcctatcttagtgcattatgaattatatttggctatctgtacagcagttttcatgaatacttcagggtaatggcatccataatggcttagtatttttattacaagttatcattgatacaaaggatttaaaaaatatatttgaataaatgcttgaattatttatgtaaaaccaacaacttttcaaagattttgaagaacgtaactgttttaaaaaatgtgttaacctatgctttaattcctgaa

SEQ ID NO: 6647 - DNA, 572 bp, mus musculus
agacttaataatgcagcaactggggacccaacaagaaacagatgatatattcaaaaggaacaatatataaggatagaaattaggaaaaaggaaacttataagaggcagtgtaacatgaaaagaaaatacaataatgtcaaccagaatgtgcaaccacagggagccacttccacatgtaggcccaaaggagaaaggggagagatggatgttactagagccacaggaaggtttgagagaagaaacagcatcttaaagaaggctgcagaaggatgcagccactgatagaaccaacagagaataagaaagtctactgaaggagcaaataacctcacctctcttctccctctcctcccatcctccaatctcctgcagatgcctccactaaccaatgctccccagtgacagcaggcaagggagtccagttgttgatgcacaatggaaatgtagtacaaagagaggacagagggtgagggagttcagaggagcaaacagagaaaagcgagtccaaataacttgcccaaattctcacagctagtaagagacagtgccaacaaactctgtgaactgtttcc

SEQ ID NO: 6648 - DNA, 1291 bp, mus musculus
agatgggacaagtaattggtttgactgcctcgagagacttctggttttacattctttgaaatatctactgagcatctactgtacacttcataccttttaaaaaaagaaattattcagcaaattggttcatagaagagtgaagaaatatgcttgtaaattgtcctttgactgacattgtcaacccatggtatgcaaagacctttgaaagttcagtgacaaaaatcaaagatgtgtggtcactgttaaacagagagaaattatgcagagaaaaatgcatttcatttattccaaaattttttgtgcagagaacgaaataagtgagagagaaaagaggaaagagactctgggaagttctgtatcagtcattttcaattaaggtaagtagtaggggattcacagatagtttaaaaaatgtgcatcagtttgcaagaagcatgttaggatctgctgattgtggttccacagtagctttgaatgttctgggtcaaaagcagcccagtgaagggagttgccattatttcagcagattttgaggccctgggctctgtattgtttcttcctttagtcgtcatggatgcctgctgcagcaggaatctcataaacagcttcctgtctgaatcaggtcttagccaagttcaaggttgctatgtttctgaaaccatgagtctgcacctgttttcttgactggacaccttgctttcattcactgcaagttcccttcacttttgactttggagccctttctcatctctggctgggtgcttgattttttgttctctgctctctttcagctgcgattttgcattttctctagtttgtggcagcttaacttttaacttttactttctcagcttctttctaaccatgatcagtgttaaccgtagttataccatcttttgttacacccttgtttccctaagccactgaagagcctggttgcagctcttcctagaaatgatcagatgttatgggtattaatttaaaggttttaatgttttaaattaaaggttgagaacagcttctcaccccaaaatgcactgccatcccctggtaacttggaatagttaaggttttaaggaaaacctaatgtgaagatgtgcattaggattttaggaaagtgcacacttaacttattcaggaagtattttctgaatgaacaatgtgctaaaccctatattaattactaagaatagtgcattgggtagggaaaactctctgttcttgaggaacatcttacattaggcttattatagtatgtaagtgtattatttctctctgtccaacttactag

SEQ ID NO: 6649 - DNA, 1108 bp, mus musculus
tgtgtatgcgtgtgcatgtgcttgtgggaaggcgtgtccttgcatttatgcatttatttgcatacacatgtgtacgcatgtattgtatgtgcatatgcatgcatgtgtgtgcatgtgtgcatatatgtgtgtaggtgcatgcctctcatatgcctgtgcatgtgtgtgtttgtgtgtgctctgcatataccagtggtttggggtgtgtagagagaaagtgatgtgtgtcaggataaatttccatactgtgcctgagcatgcatctcctaatcgtgtccatgttcctgaaggcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtgagcacatggcttccctgactccacttgtgccctgcgtggggtcacagtggagggacagtggggtgaggagggaagagcgaccttagctgagagggaagatcaaggaacacaggccatgcctggggtgagagggagaatgctgctgtttcccaatcacctgcttctctttaccatcattatctcaattaatctgaacaagaaaactactgggcaccagcttcccaccattttgcagaagagagcgttgctgttcagagcgctcacgccactgcccaggattccatgtctcacgcatgtcccagctgggcttagagctccagggtccgtggcttccaagccaagctcagtccctttccagacagagcaggataagcacacatgaaaacatcaagacctagcagtgtgagagtaattctgaatttccacttgcaacctctgtagctatgcaggaacagccgtggaggggtgcacattcaagcaaggtcatcttcctaagcgggagccagggttttaaacagttgtcgtgtggaaactaaagagttgggaagggattctataaattgtcatgctttacatttcaacagaggcagctcgtggggtgaaatgtcatgggaatgggatggattaataaaaatgccagtcttaaaattatttccaga

SEQ ID NO: 6650 - DNA, 724 bp, mus musculus
caacactattaatcattgcatgattctgaagttatttgacgttgggatggaagtgttcatgtttttggaatgacttttgaaaatagaaaaaaatgtttattatccagtatttcaactctcctttaaggcatcaaaaatgttttaatagaaataatttatatttcaaacaccaagatgcttttcaatatttataacttttaaataccttgcaaaaatataaaataagagtgggatcaggaaaagagttaaagcatttctaactttgaatcattttaaaatatgtttacttggagatcaatgagctccagagaaattctctctcaagatgttcaaagctttgaagatattattggctatgaggcacggtgaaagtatgcagtacctgttcaattacgaacctggctccctaacaggtccttattgaagaatgttgatttcattttctaacccgcacattcgtctcataccatcaaaaggtagcaccttctgcagctgctttcagaaaaaatgccaacaaacgccaagcaaatcactgttttgatgagattttatgcagaaattcttagggccccaagaagacctagagtaattgtgggtggcatttagctttgaaagtatttcttaaagtgtatgataatttttgcaaagtaagtgaaacatttagtcttccgtcattatgataaattatataatatgggcataaaatggaacacatttaatctca

SEQ ID NO: 6651 - DNA, 1135 bp, mus musculus
agcgtcagagtcatatgcccaatgtcagagtcctctgacatagtaagaaaaaaagtcaggattctaacgagagaaatcttgagcccagacactttctaccacccaccatatcagttctctctttgtctaagctcctatgaaaagtgcttttcaaaccctaaattgctgcataaatgatagttatatttgttcatctccctgctcgctctttctcactagacactgatatcctatttattaatgtattatctatctatgaatgatacaactgaaatttatataattatatacattatatgaatgctttataagcttgttctgttttcttcttttttaatacatgtaattaatactcaagtatttttattccttttttcttcttctttttctttcagcatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaaggtgcagtccctgccaccccccgctcttctcctttgaaatcacacatctatcttcaggcacacacacaaaccaacaaactgtgttagcttgctagggctgccctaacaaaataccacacacagtcacttaaccaacaggagtgtacagtctcccagttctggaggctggaagtctgagatccaggtgtcatcggcagggtggggtccttctggaactctgagggaggatctgcctcaggctggtcctccagctcctggcggtgtttggcaatctctggcattccatggctggagaagcctcaccctcatctctgcctccagactcaaaaggagctctccctgtgtgtgtgtctgtccctgtgtctaaattctccttgttaaaaggacacaatcatattggattgggggtccccttcttccagcaacaccttatcctaactaaattcatctgcaagtacccaatcttcaaatacagtcaccatctgaggcgctgagggttaggacctcaatgtatgattttttggggggacagaattcaacctataa

SEQ ID NO: 6652 - DNA, 1084 bp, mus musculus
atcaagagtgacacttggtggacacactcgtgtatgaaaaccatcctgaaatgtgatgctttctttctgcttttgcccctgcagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggtaagtcccgggaagagatgccacaaaggatacaggtgtgttttccccgttttttcccccaacgagcttcaagaattgcttgtctctggacgttcatgggcaagcatgtgtgttccttttttcgccttgctcttttggctctggaaaagttacctttactgtgagtaatttcaaagtttctaagatgtctttgtgctggtgtttggagctcgggaagtcatctgtgtgcttgaacttgtagtgctgtcatttttggactgttttaaagcaaccaagtaaggtgagttagttttgggtttggtctgaagctgtttcactgtgagcagagatttttagattgtgtattttcttttatctcacgttagcgagaattgacagactgctgcagatatatgattgtgctttcctttttcttcgtgaagactgtgtaccacattctgtagccacctgtggggaagtgcccgtggctacaagatcctcaaaggcaaaataacttaacacacatcttagtccactatatgtataaaattaaccgcagggtggtcagttctctggtgtgtaccccagtagagacaaaggaaaacaagatctaatgaagtaccgcctatttaggagtgatggtcgtgattgcaagaatagtatcgtttgtgtccataagtgccatttgagagacttaaaaacatagcatagatgtttaaggccttaatttctatcttgaattaagtcatttgttgcatgtaaaattgtgttattgtttttattattttaaacctgaacactttaaaactgctt

SEQ ID NO: 6653 - DNA, 1169 bp, mus musculus
ctcaagaatattatattctgtaccatgataaccaccctaaaatttagaaagactgtaaatacagagagtcacagctcagctgcttcatgatccagatacctttattgttcatgattgtgtcttattgtcctgttactgataaaagaagaaatatcagaccaaaattgttgaattaattgtttgtcttttttgattctccctcatgtattttgtggatccattgctaggttagcatgcacttatttttatgtctgtctaatatactgacccaagactctgtgttagtctgttctcatgttactaataaaaacatacacaagactgggtaatttaaagaaaaagaggtttaatggcctcacagttccatatggcctgggatgcctcacaatcatggcagaaggcaaaagtcacgtcttacattgcagtaggcaagagagagcgtgataaggcaaactcccctttaggaaaccatcagatcacgtgaaacttattcactattatgagaaaaacatgagaaaatccaacccccttgattcaattacctttcatccggtccccccacccatgacatatggaaattattacaattcaaggtgagatgtgggtggggacacagaggcaaccatatcactctctaatatactaagtctggtggcttcaccattttatgctcccctgcctgttctctgaagtcagataaattccagagggttgcttttcagtgtatggccctggtccaggaacattcacataacttgggaatagagcgaccaagttcagcaaataaacacaagacaacaggataattttaaatttcagatatacatggaagaaggttgtatagttttcattgagtatctgaaattcaaattcaccagggtgtcctgtgttttttctgtcagctccacctgggtacatttcagagatgcagactctgaggccccacctcagacctattgaattagactctgcattttaatgagaacgtctagtgatttgtatgcatattaaggttcaagaagtcctcttccagtggtccagtttatgttagggcaggatgttcaagtgaagccttacagtgcatgtctgcaggaaatggaagctcttgaagagaagctgaccatggtcactggtcactactcatttctgcaaccctccaattacaccag

SEQ ID NO: 6654 - DNA, 1199 bp, mus musculus
gtgctgctcacctgcccacagaaacttagcaatgtgctgttagcttggaaatgtccattcgtccatgtggccatcacacataggagggtgtgtgtgatgattgttgcaggagatgaggctggagaggtagtctgtgaccttgaatagattctaaacaaacattagttttgtgtgtgtgtgcgcatatgtataataaatattttttaaagttaagttttatctggtttcatgattagcatctaagtgcctgtcatactctcccactttaaccttggatttcatctgtggaaagaacactatgattgttcctttctcttagattgaccttttgtgaaaccacacacattatctcttcattctttgagggctctttccttcccacccatgcagccctctctcaatcttctccccctgccctaggccttcttggagcttctctgtatctagcctgactgcctcagcaagatcatatacccacatttttagggtctacttctctttttcttcctcagaatgtacctatcttatgtctattcctcataaaactctgtattctgaaaactaatcatgaaacaaattaatcagacacgaagatcttcaataatttaatttgtcctgtctcaatattggtctcattttcttttcttcttctcaggatcccagagcactctagtcaccaaagctttggcaaggatgtggttgaaattgtagggctacctgggtaaataataacaaatatgttgttatgcatcttgcctcacaccatccttcaacactcatcactaaagccgttgtcttttctatatgtagaatgttgccccagctattcaccaaggaagatcactaccaatactattatgatttggaattatttttagacatcccatctatttttggtctggtggtagatttcaataaaattaatcttctatatgaaactgggaatgtgttatgtgccatttattattacagtcaggaactccagacagtgtgaataggttgattaacgaccagagtggaactcatgtcctgggctctcctactgacttcatgtagcagagacacatcattcatcaggaatgaccacacagtctgccatattttatttcttaattacatttcagcttttgcaaacttagattgtaagtcaagagaaatttgaaattataaacttttagagcatataaaaactactttga

SEQ ID NO: 6655 - DNA, 463 bp, mus musculus
aatacaagtgttctttttccaatttctccatgcttttccctaaattatttcccataaataccatttaagattttatattttaacttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtattttcagtagagacggggtttcaccgtgttagccaggatggtctcgatctcctgaccttgtgatccgcccgcctcggcctcccaaagtgctgggattacaggcgtgagccaccgcgcccagccaactttttcatttaatctgacacatacacataagtagatttaagttaaaaaatacttaattcaataaaaaagtctgca

SEQ ID NO: 6656 - DNA, 2113 bp, mus musculus
gtattttttctttaattttttttttctttttgtgtgtgtgtgtgtgtgtgtgtgtgtgtgtgtgtgtgtgtttgtgaaatagagatagggcctttttatgttgcccaagctggtcttgatctcctggcctcaaatggtcctccccactcagcctcccaaaatgttgggattagaggcgtgagccaccatacccaaccagtattttttatttagtggatattttatgtcatactctgaggttattcccctttgtccgtgaagaggtgaggggctttaactctgtattataggaggggaatgagtggggaaaggaggaattggacatttctgtttttcttctcatctacctattaacttgcttctatccatgggagccctttcttttttttttttttttttttttttgagactgagtctcgctctgttgcccaggctggagtgtagtggcgctgtctgagctcattgcaacctccacctcctgggttcaagtgattctcctgcctcagcctcccgagtagctgggattacaggcatgcaccaccacgcccagctaatttttgtaattttagtagaaacgaggtttcaccatgttggccaggctcgtcttgaactcctgacctcacgtgatccacccaccttggctgcccaaagtgctgggattacaggcatgagccactgcgcctggcccatgggagccctttttgattaaggacacctgaccatccatccattagggcatcagaatgcctgctgattttgttttgttttgttttgaaaaccagcgggtgggtgcaggcccagtactgccctctcttgtctctggcagccttggcgtccctgttccctggggatggaggtctgctttgtgtttccagtctttgtggaaagcacatcaggtaggctcaggtctcagtcctctctggttcagcttttcttttcttttctttttgtttttgttttgagacggagtcttgctctggcgcccaggctggagtgcagtggcacagtcatggctcactgcaacctccacctcctgggtccaagtgatcctcctgctccagcctcctgaatagctgggactacaggggtgcaccaccatgcctggctaatttttgtatttttagtagacacagggtttcaccatgttggccaggctggtctcaaactcctgacctcagatgatcctccctcctcggcctcccaaagtgctgggattacaggcatgagccaccgcacccagcctggttcagcttttctgattgcaacattaattgctggggggtggttgtcaggtttaccttcttctgggggctggcagccttcacttcagcagggagggattaggaacccctgtttggcctgccttctccaaggctgctctagcatgaatgaagctgtgcaatgcctggcacagggcagatcaggtagaaggggtcagagcaggttggttattttgaaagaactcaaactctcatttttattttattttatttatttttttgagatggagtctcactctgtcgcccagggtggagtgcaatggcgcgatctcagctcactgcaacgtctgcttcccgggttcaagtgattcttctgcctcagcctcctgagtagctgggattacaggcgtgtgccaccacgcacggctatttcttaattgatgcctggcaagtgcttttttggttgtttatgatattttgtttgtttgtttgtttgtttgttttgagactgagtctcgctctgtctccaggctggagtgcagtgccactatctgagctcactgcaacctccacctcctgggttcaagtgattctcctgccccagcctcccacgtagctgggattacaggcacataccaccacccccagctaatttttgtgtgtgtttttttttagtagagatgggggtttcactatgttagtgaggctggtctcgaactcctgacctcaggtggtctgcccgctttggcctcccagagtgctgggattacaggtgtgagccaccatgctcggcctgtgatgttctttatctttatgcattttaaaggaagccattgtcattgtcccatgtggtttttctggtatacatattcctgccttccatatctaccgcc

SEQ ID NO: 6657 - DNA, 1314 bp, mus musculus
ctcatggcattgcagtgccttggcctcgagcaattaaatcaagggaaagaggaccaactccctcttgaccccgttctctggctggctcgcatcttcatccacagctgagatggagagagacgcagcacagacctacctgcctcctcccgctagaacatgggcttggtctctcctacttccccagggatagcctttctctagctctgtgtttctcctctcattttgaggagatgccatttggaatctgcttggcgtctatagcaagtcctgctctagctccaaacggcttcttgttaagcaatacattaaaccattaccctgttaaatggagtttgcaagaatttttaacagacttgaacgctcgcactgcaccactctggcttgaacctgcatgccattttgaggccctgcactgaggtcgccctaccgaccaatggcgagagggagggttcttaaagcagcagaaaaaaaaaaagaaacaggagaaaggcaaactcaatgggtttcatgacagtgaatgcagatgaagtagcaactcgggacttggaaatgtttgcacatgaaatgctggaacagagagacatgagcgcaggcttcctcagccagtgaaagtgagcgaggtagcttcatgggggctctgacaacggcaagtttagaagcctgagcatttactgcaggtggaacgttgattcacttattcaataacttccctaatcacctactatgtgcctagcacggttccaggagctggggacagatacagcaatgaaaaaacagaaaaccctgcccttgtggagcttctgctttgtgtagagagatgggcaataaacaaagcaaatattttctcttttagaaaatggagtgcacagagagcaagaaagctgggaagagagaagggaagggaggcagagccatgtgcagcgaatagctattatgcagctctctattggtcttcaacagggagaccacgaaggcgccactgaggtgagggtggggccgagatgtgcaggaggggaggcggccaggctgacagacacctggaggacagtgtcctgagaaagaggagtggcccagacaaaggccttgagcaaagggagggctcccagtgtctgagggcagccagggaggagagaggagggggacctctgtactggacgccaggggctacccaggaggccagcagggagccctctgcttccacagcctggcctgccccagggtcttaccagggagctgtgagatttcccccactttcccacatggggaattgggttaaggagcccccctcacaagtcagctgagctaggatgctgc

SEQ ID NO: 6658 - DNA, 1177 bp, mus musculus
tcctaactaggcctcctgggtcagaggaagaggaaggaattttaacatggaaagaatcttctaattctgcctcgacaatgaggaaggaataccaaactgaatcataggaaatgcatgtgtgcaggggaaggggtgagaaaatggagtttgaaatggagtccagagcaagtagcaaggcacagcggagtgggtctcacttggagtaagcagttccgtcttgttggaggatacatggatgcaggaaggcaggaagtgagaccaaggggaaattatccagatttggcaggactgacatgatcagatttttgcatttggaagtctcccttgctggtgttgtattgaattagtttagcaaaatgaagcctggagacttgggatggaggctctggaaatgacacaggaaaaaatgaagatggtgtaaaccgcaactgatgtcaagtagacatagtaatgaaaattggcaccaaagagccaaccgaaacgccaggggtttggtctagatcctgctctctctacacagaaagccagtaactgagactatgagtattgccaaggaagaaggatttaatcgggccctgcaggagatgggagctcagtttcaaatctatctcactgatccccccaaactaggggtttatagagcagggaagaaatgtaacaatgtgtgagaacagcaactagggagggacaaagaagcaattatgaggaatgagaggtccagcatcttgattgtctgaatgtggtgatctggtgagtttcagttctttggctgaaacttcagttcttccactgaaactcagacttttttttttttttttttttttttttgagaggcctggaggtttgttcttgaggaaggaactcagataaaataaatacaaggttgaagctctaagtccagaaggtttaatttctttgtttgtctagaaaactacctatgggactactggatcgatttcagttgtgtataatatatgtgcggggataggagagggaaaatgttagagtagataaattgtagggttgagtgacaaaaaatgatgatgtcattcatagtgatatggcatgctagagacctagggtggtaagtgatgaattctgcttcatatgtttgtggctttgtgcttctgagaaatatagatagttatgtcccggaagtattcagatgcaagagttt

SEQ ID NO: 6659 - DNA, 465 bp, mus musculus
ctcagaattttctattgtgtgaaattatcctcaacaagttttagaggacttcagaagaatgtataaagcagtaagattagtctagatttttatagttactcattgttaatgactttcatggttgagtcaactgaatttgactcaccctcatctattgtatcagagatacttcactgatcttagaattgacatatcttatattctgtccttgatatattcagtgtatagttagtattaaaacaattacagaggaatgcattaatttgtggtttatttcaagtttttaaagcaagttatttaagtgttctcatttaccttaattaccgataatttcattttatgtactagctgacttcttgcagaccacttctcattttgattacttcagggcgttattcaattaccaagcattacacttgggatctctgatatttctcttgatacatacataggttcttgatgcta

SEQ ID NO: 6660 - DNA, 935 bp, mus musculus
ccgagggtcctagaatcccagactctacatcctacaagagttggaaattactctttctgctgaatttactctgcaacctagttgcaccacactttcagcctgaaggacacaagggaattcagggagaatgcaagagaaaagaatacatgccagcaatataaccagatctgacaggttagtttaaaaaacaaaatgcaattctgtctggatcagagtgtgtgaatatggcagggtctagaggctgggggctcaggcctggcagaggccagttaggcaggatgccttttccttccttaatcaccactccctcacccacaaacagggcagccaaaaattttaggcaagaatcagactagaggcagaattagaaagtgtcagtaaaatagcagtaggtggtgttgggatgccgacagaccctcactggctcctccagaccacctcacgggaagaaccgaggggggctgaagtctctgtaccctctcctcttctcaagcccccctttcccaggttggggagggtgaaattatttatttggggggtgggttcttttttcttttttccctgcccctcatttgatctcttttggtgcagtgctgctgttaacaaaaaatacagcatgtttgagacaaagtatgcacaattcctcttccagaaaggaggcctttgaagaaaaggcgagtgatcagaataaagagagggagcgggggtggggagggggcgggaggtgagtggggagcccaggctaggagggcaggctttgatctccccacacaggcctgtgccttttgcgttttatttcactgttgggatgaggggagctttttgcaagggcgtgatgtaaatgcttaaggaaaggaggcagggtgcaagctctcaaaactacagatgcagacacaggtgccagggatgcctcctgtctgctcccatggggcatc

SEQ ID NO: 6661 - DNA, 1574 bp, mus musculus
ggagccttcaagaggcccttctgggtggatcaatcacttgctgtgacattgccctgtccccttttgagggcagctgtttccttacatatgaatttgcccctgagcatcctggtggcatagaaaccctccaaggaggcccggcgtggtggctcacgtctgtaatcccagcactttgggaggccgaggcaggtggatcacctgaaggcaggagttccagcccagcccggccaacatggtaaaatcccgtctctactaaaaatacaaaaaattagccaggtgtggtggcgggtgcctgtaatcccagctacccaggaggcagaggcaggagaattgcttgaacctgggatgtggaggttgcagtgagccgagatcttactgttgcactccagcttgggctacaagagcgaaactccatctcaaaaaaaaagaaaagaaagaaagaaaagaaccctccaaggaggccctcaccaccgtgtgtctgtttgagaagggtgatccctcaagcaagctccttcattcctgtgttcagtgaacatctgcctgcccactccacactgtaggcccctcgagggtgggatgggtctgtgctgctccccagctcctaggcgggactggtccatgacagatgctccagggcatttgcttttttgttgtttttgtttttgagatagggtctcactctgtcccccaggctgctgtgcagtggctcaatcacagctcactacagcctcaacctcctgggctcaagcagtattcccacctcagcctcccaagtagctggggctacaaacaagcaccaccatactcagctaatttttaatttttctgtagagatagagtttccctatgttgtccagactggtctcaaactgctgggctcaggcaatcctcccacctcggcctcccaaagcactgaaattacaggcatgagccaccatgcctggcccatgacatttgttgaatgaaggaaggtacacattacagatgaccatggcgcagctgaggctggctgtagtggcactgacaccattctctggagggtggcacaccccttggatcaaatcttctgagagcgaccctgatggcatgatcagcattttctcaacaactgtcttaaggactttcattacccctcccaacttccccaaaagctacttcccctgtccctccagccctcaccccacctttcccaagggccctaatcaaccacttccccttgcatggcacagaaagcattagtatggaagaacccaagtccctagatctggaaagtggcgagaggggacgaaagggcaatgtccagcttaggaccccaaacttcttgaaggcagggtccacacatctgggagtgggattctgaggctctgaagggacaagctctgacatgcagattcctcagattatccccaagcccttcgggtagtaaatgccttccttcagggccaagcccccaaggctggtggtggcaaagccccccagtggccttttccacaggctaacaccgccccctgccgggctaagccaggacagccacttcaaatgccaccttaggaaatcggaaacgtggctacctt

SEQ ID NO: 6662 - DNA, 1100 bp, mus musculus
tcagatcttgggggaaagggggtgaggcagaaagaatggcgctcggccaaggggtgagggtgggctccgggtgccacttttattccagagctcaggagaggcaggatgggtgggaattgtcagatgctatggtgagctatttctgcataaaaatgttttgttgcttaaggagaaaggttttgtgctgagtctggctgcccctgcagctggctgtgacctgaagatccctttcaagtgggaagctctcctgtgtttttaccttttcttcctcagacacagcttttcttgtctcccattcccattttgatcacacatcttttccttcggctctatgcacgggttacttttttctcttggttctaaggatgcaatgagatcatcacctcctcttggccccgccccaccctgaggtcagcctaatcctacctggccagaggtggctggctccaaagctgaaaactgcagacacccagaactgccacgccctggtccttgactggggccctggccagtccccctccttattcagcccaccacacttgccaggagtttaggcatcattcatttctcatcctgggacccagggttttgatgtccagcagtcagctgtccccacgtggcggtgctgtctttgttttatttctcccaggaagacacaatcaggtgtggtggagtcttgttgtcctgaacatgagcaggtctccagaatgctgtgtgtgtgtgtgtgtgtgtgtgtgtgtgtgtgtgtgtgtgtttgtatgggggtcggagggagaggtcaggaatgttcaggcacccttatctgaatgccctgggaagggataccccctgtcttaagaccaagagaatacaaggtgggatggccagaggtggcctgctgaggctcgagggatgggtgggaggttgagagggaatatgagggaatctgtctccacctgaggctgagcccccgcctcccagggggaggaaacctctcccacaggcgggtgctaggggaatgagatcatccttcagatgaggaaataatcatagtgctggagcagtgagaaggcagaggggaaaaggtctgatctgcagctccacagaaggaagccagagtc

SEQ ID NO: 6663 - DNA, 904 bp, mus musculus
taggcctatgactagtctgaagaattgtgttgagacgtgtcagtttctagaaagttcagtcgagtctgtgaagtgtcatttacagatctcacagatgtgcagtctgcccagcccacctctttcttttcttctggagcagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataattagctgtcctctgttgaacctaccatctatatattgatttagtagctgaaaaaatatgaaaatatacagaacagcatgaacttagaaaacaccacaggaaat

SEQ ID NO: 6664 - DNA, 904 bp, mus musculus; identical to SEQ ID NO: 6663

SEQ ID NO: 6665 - DNA, 922 bp, mus musculus
atcatatcagatttgtctgcattttttcttcccaagctgtttgctagcctgccctgtgtttaggattggttgggcaagttgcaggacagatagaagggggcttctgaaggcttctgtgaccctatcagcaaatgcctacatcagaaagagtgttttctcatttctggttatgcttctgtaaaagtgggtgttttatggccgggcgcagtggttcacgcctgtaatcccagcactttgggaggctgaggcaggcgggtcatgaggtaaagagattaagaccatcctggccaacatggtgaaaccccatctctaccaaaaatacaaaaattagctgggcatggtggtgggcacctgtagtcccagctacttgggaagctgaggcaagagaatagtttgagcccaggaggtggaggttgcagtgagcagagatcgtggcactgcactccagcctggcaacagagtgagactctctctcaaaaaaaaaaaaaaaaaaagtgggtgttttactatctatcatgtcatgacaaccacctcaaaccttaggggctttaatttgatggtttttcatgttctgcgggtggactgttgagctgggcggttcttctggtctctctcgaggtctctcatgcagtttcaggcagatggcagctgcagctggttggttctctcactctccacatagcttcagggcttctcctttccacaaggcctctccaggtggtctgtttgtgtggtctctccagcaggatagccaaacatcttgcttgacagcataactccaaaaatgcaaggaaggaagctgccaggcatcgttaaggcccagcacattgtcacttctgccaagttctatagtttcgagtgagtcacaggctcagctcagatcccatgtgggaggaactgcagtgaggtgtgaatactggga

SEQ ID NO: 6666 - DNA, 3135 bp, mus musculus
tatttaatttaatgaattttctggaatttttggaccattccattggggacatttagataatttctggccaagataaagtgtgactgctttgaaaagtctacaaaagcaacctttacaaaagcttctcttggcaaagcacagcctagaaccaagccaatagcatttttcagcttcactgcattcgtggcttttgaggccatgaggtgtcagtatcctttctgtagatgtttcagaagaatgcctcaattcatatttcacttgtgggattttgtagtttggcataaatgaacactacaaataggttctagtttggtgaccatatattacaaaaatggttggattcatatttatgtatattcgtgaatttcaggttttttgaaattgatatccagcctgtgaaatcaggtgtaatgttttcaaaagtaaaatttagtattactaacacgtttcaaatactattttataatacacttgtttattagtctgttctcatattgctatataggactgcctgagactgggcaatttataaagtaaaaaggtttaattgactaataattccacatggctagggaggcctcagaaaacttacagttatggcagaatgggaagaaaacacatccttcttcacatgatgacaggaaagagaagaatgagagccaagcgaaggggaaagccccttacaaaaccatcagatcttgtgaaagcttcctatcatgagaatagcatggggaaaaacacacccatgattaaattacctccacctggtccctcccatgacatgtggggattatggaaaccacaattcaagataagatttgggtggaggcaaaaacaaatcatatcattccatccctggcccctcccaaatctcatgtcctcacaattcaaaacacaatcatgcctttccaatagtcccccaaagtgttaacaaattccagcataactcaaaagccaagtccaaagtctcatctgagacaaggtaagttccttctacctatgaacctgtaaaatcaaatgcaagttagttacttcctagattcaatgagggtacaggcattgggtaaatatacccattccaaatgggagaagttggtcaaaacaaaggggctgcaggccccaataggacagtcattaaatcttaaatttccaaaatcatctcctttgactccatgtctcacatccagggcactctgatgcaagaggtggtggccttgggcagctccacccctgtggctttgcagggtacagcccccttcctggctgctttcatgggctggccttgagtgtggcattgccaggtgcatggtccaagctgtcagtggcagtaccattctggggtttggaggatggtggccctcctctcacatctccactaggcagtgccccagtgggactctgtgtgtggactctgactccacatttctcttccacactgctctagcagaggttcttcatgaaggctccacccctgcagcaaacttctgcctggacatccaggcatttacatatatcctctgaaatcaagatggaggttttccaacctcaattcttgacttctttgcactagcaggctcaacaccacatggaagctgtcaaagcttggggcttgtaccctccgaagccaaaacctgagctgtaccttgaccccttttagttactgctggagtggctgggatgcagcgcaccaagtcaataggctgcacacagcaggggggtcctggacctgctatcaggaagccattttttcctcctaggccttcaggcctgtgatgggaggggccaccgtaaaggtctctgacatgccctggagacatattctccattgtcttggtgattaatatgtagcttcttgttacttatgtaaacttctgcagcaggcttgaatttctccccagaagatggggtttccttttctattgcatcatcaggctgcaaattttccaaacttttatgctctgcttcttcttgaatgctttgctgcttagaaatttcttccacaagataccctaaatcatctctctcaagttcaaagctccacagatctctagggcaggggcaaaatgccaccagtgtctttgctaaagcataacaagagtcactgttactccagttcccgacaaattcctcatctcagtctgaaaccatctcagcatgaacttcattgcccttattactatcagcattttggtcaaagccattcaatacatgtctaggaagttccaaactttcccacatctttctgtcttctgagccctccaagtctctaggaagttccaaactttcccacattttcctgtcttctgagccctccaaagtgttctaaactctgcctgttacccagttccgaactcactcccacatttttgggtatacttatagcactccactcctggtaccaatttactgtattagtccattctcacactgctataaagtactgactgagatggtaatttataaaggctaaagatctaatttaatcacagttcagcatggctggagaggcctcaggatacttacaatcatggtggaaggggaagcaaacatgtctttcttgacatgatggcagaaaggagaagaatgagagctgagccaaggaggaaggccattagaaaaccatcagatatcatgagaacttattcactatcatgagaatgccatgtggggaaccacccccatgattcaattacctccacctggtccctaccgtgacatatgggcattatggaaactacaattcaagatgagatttgggtggggacacagccacaccatataagcttgatcaaataaacttttttcaaaaaaaaaaggaagaacagaagatcattttgaaaataacaaaaatgtgccacacatttaatactttttcttctaaaagctttagatgcttccttagatatcatcaaattatatgtcactgcagtcctggaagaaagatcagtgataggaattgtaggcatttatgggcttcatggttttgtccaagataaaaagaggaacccctatttgttgctcacatcctttagaaaagtaacttaccatacattgtctcttgttagcctcagaacatcaacgtaagggaggtattattagccctgaggttcaatgacattaagagtttaaacaaag

SEQ ID NO: 6667 - DNA, 220 bp, mus musculus
gtaattgtgtcttaattttcttaattgctgggttttctgtgtacttatcagtaattcagccccaaactctttgaccagtcagaaataattactcctttctcccaccatggccatttgcatttttgttagtctagattgaatattggctaatggtttaacatttacattcataatcataatatcccttggggcttattttgtttatctttgaagtcccaga

SEQ ID NO: 6668 - DNA, 1738 bp, mus musculus
tacaatatgcaatagtgcttaccagtgcattgcattccccgtggtacatcaggcaggactgtgtaagcaataattctcaatctctattgttagaaggttttcttcaagttagtgaggaggtttttttgtttagtttagttttgtttcaccaggcacttgattgcataatgtgcttttcacacggatgacctcacttgagataagtggtcatggtcatttgcttgcacatggggtgtcatactcagtcatgtgatgctgttatttctaaccccagttttttggatgaggagatctagggtatactgaaaagttcaatcagttatctatgagacaatgtggccagataatttcaaccaatagtactgaatagtgactacttgattcaattcggtctctcttttttcttttacagaattttgaatacaagtaacagacagagaaaaatggtacaaagggttaaaagcagtcttagtaacattggagatgtggagagaaaattagaagagagaagcagaaataaggaggccctgagtcacaagtaaggagaacctctggaatgaaagtaatgaaaaccagcatttgaatgggcaagatgaaaaacagagggattctcagtccttagcgtgatggttgggttttggacagtaatgacagacattccagttctccatgaggtttgcccagatgttcccattatactctattttctcctatttttgtagttcatggatttgtttctcactaggttacctaaatgccttaggctttttcaggtttctttgtgaaatgtgattctgtcaatgagctttcagttcaacaacaacaacaaaattaaagttaataattattctgttaattaagagctcgccttctagttgaagactttgcatatgagctgaatttgagtttaaacagttcagtatgttttgttagtgtttatgaatcaggtaactaacactgaagatgtgggtagagatcctcatttctatgtcttgtctccttatatcctatgtgttgccatttctcttaaggtcaaataatacagtttgtagttagggaccaaagaatgtccaaggggattaaagtcaattaatatattcattgtaaaaagtgttaacagagttgggaagtttcagtattcaatctcaaaaagcaaaatctattatgtgacttcggtgtgataaaggaggcatgaaatatttttttcagttccaacaaagaaatagatatattcttagacatatgtataacttgctcttacttactcagcttatagcaaaagttcttgacaaaatggtgatcaagtgccaaaacagtccatttaaggtgttatgcagagtccatgccttatgattttttaagtgagaattacaaccatatgtctttgatggtttgaatatgtaactatttaaggcagtggactggataaaattacttttttggagatcctcttcaaagctataattctgtgatcatttatacattttgtatagcagatattataatgtgaatacatgcagcttgaacaatgaaaatattttatcaattgccctgtagatttgtgttttaatagctttgtaacatgtaggaagcactttagagtattagcaaaaaaatgatacagtatcattagaaagtatagtaatcatagatgtgattaagaaagccctgtgtcatggttgacaataatcatctgaataagttactattgctgtaaattctccgttctgtgcaatta

SEQ ID NO: 6669 - DNA, 1047 bp, mus musculus
gtttaggcttaggtcagaatttcagttttacttttttttttttttgaacataaatattagcatagaaatttgctacatccctaccccctgaaacaaaaaggagaaaataaaattttgctgatttcagaaacctggcaaatatattttttaaagttagggtgaaacttggtttttacttgtaagtctgagcattctttaacttggtttaccctaaaataaaacgggcaatgactctaggttggatgaggccagattcatgaagacctgggccttcccaagggatgacatttttacttcctacaactgggaaaatcaacagaaatttgaaattgcttctctgggccataaaataacaagggatctgagtttatctaccttgattaccacagaattaaataaactaaaaatagcttggttaggagactgatagaaaaataccctgggaaggtctttttttatgggaatcttttgggcatgaatgacaagactgtcattgatttatgactctttgttactgagatgagcatggccaggccagttctatcagcaagaaggcaaactacttaatcatattcatatcctcttgatttattttcaattgccatcactgctttttttttttttttttgcatttggtttggtttggtttgaatgtcagccatccctcatgacctaggttacaaaggaaaaacaaaaagagaggctttataggaacttgaacatggaatagctctttccctgtactccagtggtgagtaaagtcaaaataaatcaggaataaattctgacagccaatgagcaggcctcaaattggccctgagccattccatagttgttttataattacatcttcacatacagcagatttacatgtgttaagattcatttagaaatggcacatgggcacctgcaatttggcattccagttagagccctagtgtatcacacacttgattaataaactctgaagtgctgaaatgattctgtgtcattaatcatattctcttctacctctgtattacctgaaatcattagaggagaaagcct

SEQ ID NO: 6670 - DNA, 807 bp, mus musculus
aaaatatatgttctgctaggaggaggtaattggtatatattcatgaggtctattacttttattatgtagtgtaggtcttctatattcttacctattttttgttcacttaaaccatcttaaaccaagatttatatattttctcctattatcagtgtgatgttgtcaatttctccctgcctatcctatattgtatgctttatgaagctctttgatttgatatttgatgcatagattttcatacctgttatatcgttattgtgagcaatgctcttcgacatccacaaaatgtccttctttctcctttaatatttttgtggctgaattatattttgtcaatgatcaagattgtagtatatggtgtttttttttttttttttttttttttgagacggtatctcactctgttgcccaggctggagtgcagtggcacaatctcagctcgctgcaggctctgtcccccgggttcaagcaattatcctgcttcagcctatggagtagctgggattacaggcaggccccaccatgtccggctagttttgtatttttaatagagacagggtttccccatgttggccaggctggtctccaactcctgagctcaggtaatccacccgcctcagcctcccaaagtgctgggattaccggcgtgagccaccacacctggcagtagtgtttgctttttatgtttgcatttaccttgtctactttgcctatcttttattttcagactttccgaatctcttcggtttacatatgttttacattaggtgttccttgtgaatatatcttataatgttgttctaccta

SEQ ID NO: 6671 - DNA, 595 bp, mus musculus
acatgaagtaaaaggatgacacatttagttctatgtctgcacaagaaactggatttgctgctctccataaagtgaagggaccaactatacaacatacagaaataattaaatgccttctcattagaatataactagagcttgctaaagtttcttatttcatgagggcagctaaaatgccagtccatggaacaggcgcttctcctcctatccatttatgccgtagttttcatgaatttctggctggatgccgcaaaggccaagaggttatccacaccctcttccctgttccgctgaaagtaggtctggaggatggtcattttatcctgggtctcctccacttccgtgctgcagctgccttggggtcccagtgccacagcttccttggccttgaactctttctccctctgcaggtggcactattcaatttcagcctgaactgccactttggcctgcttcagcctctggttcttttggctgcaggcctctgacaccttctcaacggcctgcttctcaacctgcagcagctgctggatgccctgtgactgactggctatgacagtggtgattctgagaccaaggcaagtggcctaaatca

SEQ ID NO: 6672 - DNA, 662 bp, mus musculus
ctgcaccttaatttcttgcctataacatggacatagtaaagtacctgcctcatttggtggctgtgagggttaaatgagaaaacgcttgtgatttagttataattcttgcttgccaacattgtagatgaccactggctttccaaagcagggatgagcttatgagaaggcaaccatcgcatgactgaggaagtaggtttaacaatgagcaagagccaaagcagctggaccttgaccatttctcatccctcatgggtagtccactgctgctgcaggggagactggccaactgtttctgaaatgaaaccatttcttcacgagtcaatggcccatctgaatggtaggatgcaagccaccagagggtgtgctgagggaaagtgggactcattccttacctccactcctcaataggatggggatttagatgctgcactactagttaatggaaaatgtgccctaagacacataaagtgtgtaggataatgcttggtgcggggccagcactccctacaagccagttgtgacaatgattcatttttacatttcatgagtagttatgacaatatctgcctggaaaggcataattatagcaaagacctagtccagtacctggcaaataatacacgcccaacatgtgctagctgatgttgttacaatatagtata

SEQ ID NO: 6673 - DNA, 661 bp, mus musculus
cttaaccatggtgtagagcagagatgaatagtgaatgacaggagactcaccaaatccaagacagtcccccaaatcacatcatttatcatctttgcctcatttcctgggattagggccaaaatagcccctggtcatgatgtctgttcagcaaagtgtaagaaaaatattgtgtgaactctggaaacacttcacccattttaaaagtctttgcaaatgatttatttatgtgagttttctctttctcttccctctttagccgtcagtgtcagcagctgagcatcagcacggcatatcatcctcacctccaatcccaggacattcagagtgttggccaacaggcttgttggttttgcttgggccattttgaaaccatccttcctcttttgctctgtcttttctttttgttgtgttaaatgccaactattcagtcatgaagacacttatttcaaacacatttacaaaactaattgtggaagctgcagagaatcctttgtttgagacattgtggtctactatgtcaaatcacagctagaaggcaacttggaacttaaattatctgtccaggaaatgtggggttttttctaagcggaatcattataagccttacttgcctttctgtaaagaggggaataaactagtttaagacaaatcaatctaaata

SEQ ID NO: 6674 - DNA, 132 bp, mus musculus
gcacctaattttagaatagaattgctgattaatgggatgtatgtaaatttagttttagtggatcttgcctgttttttcagtttgtgtgcccttcaacaaagcatgaaaattccatttgtttcagttctttac

SEQ ID NO: 6675 - DNA, 132 bp, mus musculus; identical to SEQ ID NO: 6674

SEQ ID NO: 6676 - DNA, 1054 bp, mus musculus
tatactttcaaaatgcagcagtaagagtggctgcaacagtaggcaaattacccaactatttacatatagatacaactattgttacccattggtaattagatcataacagtcagtaccaagctctgaccacatttagtagttaacaaaattatttttaaaaggatcatgaactaaagattatcatatgaaatacagtgctgatgtgaaagataaacattttataaaacgaactgaagttagagacaacatatttggtccagaattttcttaccacgagaactatccaaaaattgaacaagctgcatcacaaaaaagtgaggtggtcacttaagtatccaaaagcagaaagcgaaggactgcttaacaggacagaaggaattcctatattcggaaaagtcagaagtcaatgttgaaataaaggagaaaaactacttggataactgacttatgacactaatttaaaaaacccagtgaatactacattaaagaaaaagaccgggcacagtggctcacgcctataatcccagcactttgggaggctgaagcgagtggatcacctgaggtcaggagttggagaccagcttggccaacgtggcaaaaccctgtctctactaaaaatacaaaaattagctgggcatggtggtgggctcctgtaatcccagctacttaggaggctgaggcaggagaatcacttgaacctgggaggcagaggttgcagtgagccgagatcgcaccactgcaccccagcctgggtgacagaatgggactctgtctcaaaaataaaataaaataaaataaaatttaaaaagagttaagaaaaagacaaaagataaacaccaaataaaacttcttaaataggtagaaacattgaaaaccaaatttgggaaatttttttttagccaattaaaactgaataacatgagattatttcttatgcctggttccattctaagtcaaccacaccatcatcaaaatttctctctctgaatatatattcttttaagtacattgttattttcctccattgcattatagacattcattccaaatgtta

SEQ ID NO: 6677 - DNA, 251 bp, mus musculus
tttaatgaaaagtctctaacttggaaatataaaggcaaataaggtggaatttcaatctaagaaactgaggattttgtgagataaaatatgtggcttaggatgtagcccaaatatttaggattattctccttgccttcatttccaacatcgccatcagggtcaccaccttctcttgcccagactcatgtactagtctcttacatagtctctcctggcttttactattacttccttgccatccttcttttgca

SEQ ID NO: 6678 - DNA, 158 bp, mus musculus
gtgagactggtgaagtgataaatacacacatcaatagaacagaatagaaaagccagaaatgaacaagcggtcctaaaacaaatgaccatccatttgcaaaaaaaaaaaaaaaaaaaaaacccaaatcacacgaacctcaaacctaatatactttacat

SEQ ID NO: 6679 - DNA, 893 bp, mus musculus
cagcaccttcgtcttggacttccagtctccagaactgtgaaaaataagtttccgtttaagccacccaggctgtagagtttgttatggaactctggcagactgagattgttggagaaccacagtcctggtggttgagtgcctgcctcaggcattattgtttttaggccagtggtttgtgcatcaaaatgcttggtaaagcagactgccagggcttactccaagaatttcagatttaggattgacatgagaagtcacatttctaaccagttccccagcggtgctgatgctgccgatgctgccaatgctgccaatgctggtccatgttcggagaaccactggtttagatggtgtgtcggagaggcttcaggcaagcgctgggagacttgaggtagggatagtggctctcccgcccaactaggaagttgtttaaactcagagcctcagttgcattatctgtataagggtgataatatttattctgcttatttcatgggattattgaagtcagatgcatgaatgaaactttttaggtcctcctgctcttcatacaaagtagttgggttggggtcggggatgttgcattctttttgcaaaaagagaaggacaaatgaaatgctgaagtattctaatagtaaattataaagcaaaagtaaggtatttccttccttttcttcaccagatacggcctggtcatctgatttgctggctgcttggacattggtctttacccacttcttttctctgcaatccccacagcaacttctcttaaaagccaggcagtttagctaagaagcctttattacagtatctgtggctcctttttctggccctgccctgtcaaggatgcctgtggcttttttggtgattgagacagtggaaattactgagtttct

SEQ ID NO: 6680 - DNA, 1083 bp, mus musculus
tctcgatcttcttcacaaccacggccctggaggaactggtgcggctgagggagctggagcctgcgccagagccaaagctggagcccaggccgtagctgaggccggggcttgtgaggcccccataggccgagctcagaccacctgcatagccgctggtggtcttcgtatgaatactcatgttctgcatcccagacttcagccggctctctttgccctccagcagcttcctgtaggtggcgatctcgatgtccagggccagcttgacgttcatcagctcctggtactcacgcagctgccgtgccatgtcctgcttggcccgctgcagggcagcctccagctcggacaacttggcgttggcatccttaatggccagctctccacgctgctcggcatctgcaatggcggcctccagggaagccctctggcctttgaggccctcaatctcagcctggagctggctgatgttccagttcatctcagagatctcagtctttgtgcgccacaggtcatccccgtgcttcccagccagactctgcagctcctcatacttgatctggtacatgctctcagcctcagcccgtctttggttggcaatatcctcgtactgtgccttgacctcagcaatgatgctgtccatgtccagggagcggctgttgtccatggacagcaccacagatgtgtccgagatctgggactgcagctcccggatctccttttcgtacagctgcctgaggaagttgatctcgtcagtcagcccttccaggcgagactccagctctaccttgttcatgtaagcttcatccacatccttcttgatgaggacaaattcattctccatctctgtatgcttattgatctcatcctcatacttgttcttgaagtcctccaccagcctctgcatgttgccaagctccgcctccagcttcagcttctcctggcccagagtctccagctgccgcctaaggttgttgatgtagctctcgaacatgttgtccatgttgctccgagccatcttctgctgctgcaggaggctccacttggtctccagcatcttgttctgctgctccaggaaccgtaccttgt

SEQ ID NO: 6681 - DNA, 1083 bp, mus musculus; identical to SEQ ID NO: 6680

SEQ ID NO: 6682 - DNA, 8004 bp, mus musculus
ttttttggaaacttttcttcaattatttgttgataatcttttcccttccatattttgtgtcctttgcctttcgatgggaatttatgtcacttaaatattgggtattctggactgttcttctatttcttgacttttctactttctatttgttaatttttttactctactttcagagaggtttcttaaaattttgtcttctaatctttctattgaatttttcgcttgtgcacttatgtttctgatattgaatatattttgttgttgtttgagttttctgcattaaagcaacctgttcatggtttctgcatgttacaaatagctttgttttgatttttctccctgcatagtgtttcctccaagttgctttagatattttgttgtttgtttgttttgatctttatggcaggagcctttccacaggtttttctcatctttgactttctatgcattcctgtaagtaagggatttaaagcctgattgctcctgataaacacatgatgggacttctccactctgagctacattgtaagttgacctgtgtgagtattttattggggaatcccaatagtttttgtctttatcttttctgctgtagagtggatcaaattacccaggaaagacttctaatttctatctacaggaaggggtctagaagccagctccaagtagaagaaagagctgggggtgtttgcattcagtattcagtatgcatctgatgatgaatccccatgttgtcagtatggtacatacacacaactgtgtgtagcattccccagctgaagatcttattttccctttctagtgaatacatctccagatttttaggggaggagggacatgcagcagtgaaacatcagatatatatttggttctcagacatattctacctaagctgccagagttcagaaccactcccttcgtcttccttctaaaagtaatggatactttcaatgattctgcaagtgtaaattgggtttgtccctacccttccctactgatggcagtttccattcattcgtttatagtttccgaaactgtgccctttactgctcctgatttccccatccttgtggtttatatttttaagaatatacacccctttgctatcatttttgtaagtatgtcccagtaatctatcttaatgaaagactaaaatggcatatttttaatatttacttatttattatttttatttttccataagttattgggatacaggtggtatttggttatatgagtaagttctttagtggtgatttgtgagattttagtgcactcgtcacccaagcagtatacacttcaccatatttgtagtctttcatcccttgctcccctcccactcttcctcccaagtccccaaagttcattgtatcattcatatgcctttgcatcctcatagcttagctcccacatatcagtgagaacgtacgacatttgagtgtccattcctgagttacttcacttagaataatagtctccaatctcatccaggtcactgcaaatgctgttaattcatccctttttatggctgcatagtattccatcatacatacatacacacacacacacacacacacacacacacgcacatatatataaaacacagtctccttatccactcattgattgatgagcattttggttggatccacaattttgcaattgtgaattgtgctgctataaataggtgtgtgcaagtatctttttcaaataatgacttgttttcctctgtgtacatacccagtagtgggattgttgaataaaatggtagttctacttttagttatttaaggaatctccacactgttttccatagaggctgtactagtttactttcccaccatcagtgtagcagtgtttcctgttcgccacactcacaccaacatctactgttttttgattttttgattatggccattcttgcaggagtaaggtagtatcatattgtggttttgatttgcatttcctgatcattagtgatgttgagcattttttcatatgtttgttggccacttgtatatcttttgagaattgtctatccatgtccttagcccactttttgatgggattctttgtttttttcttactgatttgtttgagttcattgtagattctggatgttggtcctttctcagatgtatagattgtgaagattttctcccactctttgggttttctattaactctgccgactgttccttttgctatgcaaaagatctttagtttaattaagtcccagctatttatctttgtttttgatgcatttgcttttgggtcctccatcatgaaatcctcgccaaagccaatgtctagaaagattcttccagtgttatctcctagaatttttatagtttcaggtcttaggtttaagtccctaatccagcttgagttgatttttgtataagctgagaaatgaggattcagatttatttgcctatatgtggctagccagttaccgagcaccatttgttgaaaagggtgtcctttccccacttcatgtttttgtttgttttgtcaaagaccagttggctgtacatatttgggtttatttatgggttctctattctgttccattggtctatgtgcctatttttatactggtaccatactgttttggtaactatggccttacagtatagtttgaaatcaggtagtgtgatgcctccagatttgttctttttgcttagtcttgctttggctatgcgggctcttttttgataccatatgaagtttagaactgttttatctaattctgtgaggaatgatgtggtattttgatgggaattgcattgaatttgtatattgcttttgtcagtatggccactttcacagcattgattctacccttccatgagcatgggatgtgtttccatttgtttatgttgtctatgatttctttcagcagtgttttgtaattttcttcatagaagtccatcaaccccttagttaggtatattcctaattattttattttttgcagctattgtaaaagggttgacttcttgatttgagtctccagttggtcactattgatgtatagaagagctactgatttgtgtacatgaatcttgtatccggaaactatgctgaattcttttatcagttctaggagcttgctggaggagtccttagggttttcaaggtaaatgatcatatcctcagcaaacaatgacagtttgacttcctctttaccaatttggatgccttttatttctttctcttctctgattgctctggctaggacttccagtactatgttgaagaggagtggtgagagtggacatccttgtcttgttccagttcccagagggaatgctttcaactttttcccattcagtattatgttggctgtgggtttgccatagatggcttttattacattaaggtatgtcccttgtatgcagattttgatgagagttataatcataaagggatgctggattatgtcaaatgcttcttctgcatctattgagatgatcgtttgatttttatttttaattctgtttacatggtgtatcctgtttgtcaacttgcatgtgttaaaccatccctgcatccctggtgtgaaacccacttgatcatggtggattatctttttgatatattgttggattcagttagctagtattttattaaggattttagcatcatgttcatcaaggatatcaatctgtagttttcttttctggctatgtcctttcctagattcagtataagggtgatgctggcttcatagaatgaattaggcaggattccttcttcctccatcttgtggaatagtgtcgaaaggattggtccaattcttctttgaatggctggtataattcagctgtgaatccatctggtcctggactttcctttgctggtaatttttaaattaccatttcaatctcgctacttgttatttgtctcttcagggtatccaattcttcctgatttaagctagaagggttgtatttttccaggaatttatccatctcgtctacgttttctagtttatgtgtgtaaaggtgttcatagtagccttgaattaccttttgtatttcagtggtgtcagttgtaatatccaccgttttgtttcttagtgaggttatttggattttctctcttcttttcttggtttatcttgttaatggtctctcaattttatttatcctttcaaagaaccaacattttgtttcatttatcttttgtatttattttttgtttcaatttcatttagttctgctctgatctttgttatttcctttcttctgctgggtttggatttggtttgctcttgtttctctagttccttgatttgtgaccttggaacgttagtttttgctctttcattctttttgatgtaggcatttagggctatgaactttcctcttagcaccgcctttgctgtattccagagtttttgataggttgtgtcattgttgttgttcagttggaagaatttttacatttctatcttgattttatttttgacccaaagctcattcaggatcagattactaaatttccatgtatttgcattgttttgaaggttccttttagagttgatttccagtttcattccactgtggtctgagagagtgcttgttataatttccattttcttaaatttactgaagctcgttttatggcctatgatatggtctgtcttggagattgttccatgtgctgttgaatggaatgtgtattctgtggttgttggatggaatcttctgtatatatctgttaagtccatttgttccaaggtgtagtttaaatcattatttctttgttgactttctgtcttgatgacctgtctagtgctgtcatggagtatgggaatcctccactattatttgttgctgtctatctcatttcttaggtctattagtaattgttttacaaatttgggaactccagtgttaggtgcatatatgtttagggttttgatattttcctgttggacaaggcctttcaccattatataatgtccctctttttctctcttaaccactattgctttaaagtttgttttacctaatataagaatagctacccctgctcacttttagtgtccatttgcatgaaatgcctttttctacccctttattttaagttcatgtgagtccttatgtgttacttgagtctccctaaggcaccaaatggttggtgagttcttatccattctgtggttctgtatcttttaagtggagcatttaggacatttacattcaatgttagtattaaagtatgaggtattgttgtattcatcatgctcttcattgcctgtgtactttgtttctttttcttttttgtttttgtttttaacttgtatttttgtttgataggtcctgtgtgatttatgctttaaagaggttctgttttgatgtgtttcctagattggtttcaagatttgttcctttcagcagttcttgtagtggtggcttggtaatggtaaattctttcagcatttgtttgtttgaaaagactgtatctttccttcatataggatgcttagttttgctggataaaaaattcttggctgataattgttttgtttgagaaggctgaagataggcccccaacctcttctagcttgtagggttcctaccgagaaatctgcagttaatctgacaggttttcctttataggttacctggtacttctgtctcacagctgtaaagattctttctttcatctcaactttggataacctgatgacaatgtgctaggcaaagatctttttgcaatgaatttcccagttgttctttgtgcttcttgtatttggatgtctaggtctctagaaaggctggggaggttttcctcgattattcccccaaatatgttttccacggttttagaattctctttttcctcaggaacaccgattattcttaggtttggtcatttaacataatcccagacttcttggaggctttgtttgtatattcttatttttctttctttgtctttgttggattgggttaattggaagaccttgtctttgagctctgaatttctttcttctatttgttcagttctattgctaagactttccagagcattttgcaattctaaaagtgcatccaaagtttcctgaattgtttattgtttttttctttaagctatctatttctttgaatatttctcccttcacttcttgtaacattttttggatttccttgcattggacttcacctttctctggtccctccctgattagcttaataactaacctcctgaattctttttcaggtaaatcatgcatttcttcttggtttggatccattgctggtgaactagtgtgattttttgggagcgttaaatagccttgtttttcatattaccagggttggttttctggtctcttccatttgggtagcctctgtaagagggaatgtctagggctgaaggctgttgttcagattattttgtcccacggggtgttcccttgatgaagtactcttccccttttcctatggatgtggcttcctgtgagctgaaatgcagtgattgttgtctctcttctgggcctagctacccagtaagtctacccagctctgggctggtactgggggttgtctgcacaaagtcctgtgatgtgaaccatctatgggtttctcagccatggataccagtgcttgttctggtagaggtggtgggaggttcagtggactctgtgagggttcttagttttggtggtttaatgctctatttttgtgcggttggcctcctgcgaggaggtggcactttccagagaatatcagctatggtagtatgggtaggaactggcagtgggcagggccctagaactcccaagattatatgccctttgtcttctgctaccagggtgggtagggaaggaccatcaggtgggggttggggtaggtgtgtctgagttcagactgtccttgggcaggtcttgctgtggctgctgtggaggatgggggtaagattcacaggtcactgaagttgtgtacctaggaggattatggctgcctctgctgagtcatgcaggttatcagggaagtgggggaaagccagcaatcacaggcctcacccagctcccacacaaaccaaagagctggtctcactcccagcgtgcaccaccctgccaacagccctgagtgtgtttccaggcagagggcttgaaaacttgccccagactacccgcctctcagccttgaaagaaaagggcttggttcttccctgtgaagtctgcacactgggtttgtgccctcccctgagttctggccaggaggtttctcaccccattcaaattattacaaagctcaactagagatttccttctccctgtgggattttactccctgcttccctggccactctcctgacagatccctgtggtgccaggcaggaatggcctgctagggaacccagccagttcccagggcctttctgctgctccctctaccactgtatttcacttggctctctaaactgactcggctccaagtaaagtcggaaacttctcccacaaacagaacctcagcttctccagtgggagtgtgtgttcggtagaggagagtttccctttcctgtctccagagtgggggcactcacagtatttggggtgtctcctgggtcatgcaggagcagtctgcttccttcagagggtctatgggtccttttgggattgcttgcacctgaggtctgagtaaggagcagggagaccttgggtagtgcagggctgccaccagggtgcacacacacttggggtccgctgtcagcttcttggtttttatttttgactctcatagcatatgacaaaagcttgcacgtagtagacacttacctggtatttgtaggattgaataaatgaatattttaaacacatccaaaacgtagaactacagcatttgcacatgctacagatttatgcctttaacaaattaatgaaattaaatgtctctttcctcctccagtaatgcaacatatagataacttcatcagtttaaaaaatctatattgcaaaaagttaacaataatttgagtgagcat

SEQ ID NO: 6683 - DNA, 3040 bp, mus musculus
tggagaaaaaacttgttttaatagaacacataatggagagcacacaaccattgctcaatataattacagtgctccagttgtcagagtggacattgtctttgctattaagatttgtcttctggactagagtgtaagaattcatacccaagtcctagagaatgaaattctgcaaatgaaaatactaaaaggaatcacacactttattagtcccttttcatgctgccgataaagacattctcaagactgggcaacttacaaaagaaagaggtttatttgacttacaattccacatggctggggaggcttcacaatcatggtagaaggtgaaaagcatgtctcacattgtggcagacaagggaagagaccttgcacagggaaacaccctttcttaaaaccatcagatcttgtgagacttactcacaatcatgagaacagcatgggaaagacataccccatgattcaattatctaccaccaggtccctcatacaacatgtgggaattcaacatgagatttgggtggggacacaaccaaaccatattattctgcccctggctcctcccaaatcccatatcctcacatttcaaaatcaatcatgcctttccaacagtcccccaaagtcttaactcatttaagcattaactcaaaagttcacagtccaaagtctcatccaaggcaagacaagtcccttccgcctatgagcctgtaaaatcaaaaccaagttagttacttcctaaatacagtgggggtacagggattgggtaaatacaccccttccaaatgggagaaattggccaaaacaaacgggctatgggccccgtgcaagtccaaaatccagtggggcagtcaaatcttagagctccaaaatgatctcctttgactccatgtctcatatccaggtcacactgatgcataaggtgagcttccatggccttgggtagctccatccctgtggctttgccaggtacagcccacctcccagctgctttcacaggtgggcatgagtgtctatggcttttccagtcacaaaatttaaactgtcagtggatctaccattctggggtctggaggactgtggccctcttctcacagctccactaggcagtgccccagtagggattctgtgtgggggctgtgatccaaaatttcccttttgcactgccctagtagaggttctccatgagggccccacccctgcagcaaacttctgccagggcatccaggcatttacatatatcttctgacatctagctggaggtgcccaaaccccaattctggacttctgtgcactcataggctcaataccacatggaagctgccaaggattggggcttgcaccctccaaagccatggcccaagctctacgttggcccctttcagccacagctagagcagctgggatgcagggcaagtccctgggctgcacacagcgtggggaccctggagcagacccacgaaacaattattattattattttttctaaacctccaggcctatggtggaaggggttgctgcaaaggtctctgacatgccctggagacatttttcccattgtcctggtgattaacatttagctcctcattacttatgcaagtttctgcagcaggcttgaacttttcctcataaaatgggattttcttttctattgcattgtcaggctgcacattttccaaacttttatattctatttcccttataaaactgactgcctttaacatcacccaaattacttcttgaatgctttcctacttagaaatttcttctgtcagataccctaaataacctctctcaagttcaaagttccacaaatctctagggcaggggcaaaatgctgccagtctctttgctaaaacataacaagagtcacctttgctccagctcccatcaagttcctcatttccatctgaaagtacctcagcctggatttcattgtccatatcattatcagcattttggtcaaagtcattcaagtctctaggaagtttcaaatgttcccacattatcctgtcttcttctgagccctccagactgttccaacctttgcctgttacccagttgcacagctgcttccaggtatattttcagattttcagaaaatcttttcagaaaagattctcatgtatcttttcagcagtgccctattctactggtaccagtttactgtagtaatccatttgcacgctactaataaagacatactcgagactgggcaatttacaaaagaagggtttattggacttatggttctacatggctggggaggcctcacaatcatggcagaagttgaaaggcacatctcacatggcagcagacaagagaagagagattgtgcagggaaactcccctttttaaaaccatcaaatctcgtgagactgactaacaatcatgagaacaacatgggaaaaacctgcccccatgattcaattacctccccccaggtccctcccacaacacgcaggaattcaagatgaaatttgggtgaggacacagccaaaccatatcacacacacacacacacacacacacattaagcattagtattcagagaactattctgggaccaatgtcctaggttacaatccaaggctagggaaggagatcctctactctctgaaagggcatagtaaggcacagaaccaatgactgctgcagagcctgccatatggctgaacttcagggctctctgcagtgacaaccaagcttcacggacacttgcagcaaccctctctgtacactctggaagcttaatagctctgtgcctttagtggtttcccagggtattctctgctatataaaacaattattacagttttgacacaactggagagcaagctcttgatggaaaacaccagtagtaaaggcagtggtggagagatttcccagagattctcaagcacatattgctcaatacggtccattagtggagagctggataagtagacaacggaaaccacagatgctgcctaaaatttgaacccaaatgtcacaccacggccatgaattagttctttataaagttcttacttgcctcctgaaaatg

SEQ ID NO: 6684 - DNA, 1034 bp, mus musculus
taagagtcgcagctccatttatgtggattaaaatacctaccaaggcaaggacatttaatagagtggtattcaagagtttggaaaatactatgttcataaaactatcatcatacggtggcattttcacttaaaatacatgcatatccctaatttattttttgatacagaatactgatttgttccaaataggtcatgtttctatttattgttgagtgccacaataaatagctggctcgttttgcactcctgtccctctctatggcattgttcgagtagctgtggacacagctgtggggtgttttcaagtggtcagtgaagtaagtctgctcttgtaaaatacagacaagtacagtatcaaaatagcgcgaacgcgcaaaaattgctttcctggccttttaaccctgagaaagattaatggttgtttggattagaaactgtaccctaatgagggggctgttgcctctggggagtaggtatgagaaaggggactgttcacctccaggtcatcgttgcacaggctgcgagtctctgacgacccgcaacaccactccagacagctgcccgggctctgccagtaagtgcctggtcctccgggagctgttgaggggaccaggccatcaccatcacaatggcctgggggaggcagtctccaggaccaagcgcactttgaatggacagaaattggttcttaaagccctaggttgaattactggcagctgggggtgggagggtctagtttctcgtgctattattctactgtttttccaaccactccaatcactctcagaataaatgcaatcgcctaacaaattgcaataactgttttgagatttcgtcccctctgaaatgcctcatgaagctatgcgcacaacagctaacttcaaagtaaccccacttcattctttctggctttaagtttttgtctttttcagttgggtgctttaaattgattttccaatttataaaattggaaactgattaaaataatcatgagagaaaaggaagaaaaaaacaactaatcatcctattaccca

SEQ ID NO: 6685 - DNA, 1320 bp, mus musculus
ctgtgaaagtatctctaactgaatccacttcttaaacaaactactctattttaaataaggaaagaatggagaatctagacattttacaggtgtatctgagcaaaatatatatttgggttagtttttatcacattatcacgtttgtctttatattttatcttcatcctaaattttctccctatcaaaacagcaggaaatttttaaacttttatattgtacactatttttgcataaaataagagctgtagctaccaaatactatttactacttagtaaaggtggcttctgtgtattaaactacgaattacaaatatcacttcactaaccactataattatttttggctttttcagccactggaactttttttggggggatttaaatacaggaaaactgtttaagcaaaaaatgcactgctttcatgtaaaatgatataatcttctttaacaaatattttcttcattgataactgacagatatctcatagcattaacataaaataccagaaacaaactttatctccctattcttacatttagtgcaaattggaatgcgtatgtgaatgttagaagatggacttaatctctgacaactttattaatttctctagctacagcaatgctatttaaaagccagttaggtatgaatagtacagtaatagtttgggttctcccttgataaatgaataaaaggctcaattctgataagtgatcaaatttcttgaaattctttcaaatcagctgaaaatttggttggggtgaattgatggtttttgagaagtaggccaggtatcctcacaaagaagttttagaatagggtttcttttaagtttttaaatatcatcctttgtctttccatatggttttcataaccaaatacatgactatagcatggttatttttctagtactgccatttgtgatatagccacatcttggcgtgcaagctagacatctcaggtaaatttgtttttttttttttttttagccctagaggtaacattataactaaaatgcattcctgcaattctgtttgcagtgcttcactaaacattgaaataaagttgtaaattttttcttcagtaatccattttatagttaatcataccaaatttaagttgatgacctaaagtccaggtagtgttgaagatagtatgtatctagaatactggtaatgagaaattgttgtaaattgaagaaaacaagatgctgccatatattaagatagaatataattaactccatgagaatggttactcaggaactagttaaagagcaaacccatttctcccgcttcactctgtttcagatatttttattgg

SEQ ID NO: 6686 - DNA, 645 bp, mus musculus
ttagttcacacttcgctgctgagcttggagatgggaattctaattcttcttggataattctactggaatacctcaccatcaattcttacttaacatattcacaattcctccccaaaaacaatccccatctaccactttactattgtacctgtttcaccagttatcttaatttacagaatctgaaacccaaggagtatgagtgagtttttaaagccacatagccagcttagtgcaatcccaactctgaaaggttgtagtcatctttcactcacttccttcatccaggatctcccgttagtcactaaattgtgttgatttttccttcaaatggtctttgtatccatctgcacccttccatccccactgccaacccccctgttcaggttttcaacacctcgcgcctcagtgcctgtgacagctcctggcaggcctctaaatccatcctgcacacaggcctcggtagcttgcctgaaactacagcatgtttgcacagaaaggatttgggagatcatcaaatctgttgcactaaacagagaaaatgccagagccaacacaaacctctacatgatgcctgggtccatgctgattccccaactactaagataggggaaaagaaggaataaaggatacatttcaagatagtca

SEQ ID NO: 6687 - DNA, 722 bp, mus musculus
ccagactcaacatagaagacatataaatgctggaaatgctatggtttggaacaaaagtctctctagtccaaacacacacagtagaagcaaagaaatataagatagcatgccaggcacttttcctgttcttagcctggaactcgaactactgttatacaaacactcttaaactccctgagggtatgtcttatgcctatgatggtagcagagggggatattgaagagaaatcagagataaacttggatatctagtcctgagctataaataggtataacagtaagattatttcaaacattacaatgattcttatcagattttgagataaattttgaaaagttataatttagaaaacatgtctctcagctttgtctaaggaagaggtccacagagtttctgatcatttcaatttgaggtgcatacacaggtgctggctctgtgaggaacaagtcctggtcctgggacagaaaagttgcgatcgcactcaccactctagcacgtactatgtatttacttgtttatatgtgtatttcccgtttccacgctccaaaatagaaacactatggcaaagactttatctgctttgttcactgctagagaataccttctggcacatagtaggtgcttcacgattatttcttaaaacaataagtaaactgatttgccacttagtagctcaagctctttgcttcttcaccccccttccattgtctaggtttattta

SEQ ID NO: 6688 - DNA, 355 bp, mus musculus
ttattttcctttactgcagaatcagttgaacaaaacatttaaaacatacatatttatattataggtataagttcaatattatgttgagctgctgagaaagactaattagatattgttagcaatacattttgaaaacgtttccacaaagagtcttgttcagtcaaaagtatttcttataaatactttttcaataaagttatcatatctatgctatggataattgccatcaatattctttggatcaaatgagctataatgtaaattgttgacctaatgacatatagaactattaaaaatatttttgaccttgaatatattttttatttaaagaatctttccccttctaattagtaag

SEQ ID NO: 6689 - DNA, 387 bp, mus musculus
tccttttttccttctctttaggatgtgcttgtctgaagatagcaagcactttggtctgtaaatgtgaatagcttcttatagagtttgaagttcacaatctgcccaacgagacacagcgactctgggttcagaagttggggaaaggggtgtcaaattctggacacatccaaaactcagcattggtttggaacaactaaaagaccatgctttgtaaagcaaagatgttcctcaaaatttagtctaagaaaaagttctaaaacataatgtgactagctctaacattagatcttatttctaaaattcaaagacattaggtctgtcaaattataaactctttcttctatacctttgtattgaaatttagtaatgaaatcatatcttctacta

SEQ ID NO: 6690 - DNA, 1262 bp, mus musculus
atagaattatcatatgaaccagaaactcaactactaggtatgtcaaaggaattttattagtctattttcatacacatataaagaaatacctgagactgggtaatttataaagaaaaataagtttaatggactgacagtttcacatggctggggaggcctcataaacatgatgaaaagtaaagaaggaacaatggcaagtcttacatgacagcagaaaaaagagcatgtacagaactgctctttataaaaccatcagaactcgtgagacttactcattatcatgagaacaggatggcataaacctgcccgcatgattcaattatttcccaccagttccctctcaaaacatgtggggattatgggagctacaattcaagatgagatttgggtggaggcacagccaaaccatatcaggaattgaaattagtatgttgatgagatagctacattcttatgttcattgtagcatttttcaaaatattcaagatattgaatgaaactaattgtctattaacagattaatggataaagaaaatgtggggctgggcatagtaactcacacctgtaattccagcattttgagaggctgaagtgagaggataaattgaggccagaagttcaagatcagcctagtcaatatagtgagactcagtctctacaaaaaaataagaaaaacttagccaggcatggtggtacatgcctgtagtcccagctactcaagaggctgaggtaggaggatcacttgagcctcagaatttgggactgcagttagctatgatcagtctactgcactccaacctaggtaacagagcgagatcctctctctctaaaataaataaataaataaataaataaaataaactgtctatatacacaatggacaactactcttaaatttcctcttaaaaaggaggaaattatgtcatttgcaaaaatattgattcacctagaagacattatgctaactgaaataaggtgggtacagatagacaaatactgcatgatcttacttacatgcagaatctgaaaaagtcaaaatcctagaagtagagagtcgaatggtagttaccagaggctaacggtcaggggtatgagaaaagagtagatgttattcagagagtacaaattttcagttagacagaaggaatacgttttagtgatctattgcacagcatggtgatgatagttttttataatgtatatcttaaaatactaaatgagtacattttaaatgctctcatcattcaaatattaacaaatgt

SEQ ID NO: 6691 - DNA, 1097 bp, mus musculus
taactggttttactctcccaatataagcttatataaggtgtatataaaaggatcaaagggttgtattagataggttttataaagtaggcttcttttgagagaacctactgtctaattctaacccctgaagatatgtgttagggagtgctacttctaaaccccaaacttagggagtggggctttggtagaacccactttaagggctgatatgtatctctatttcccagggacctagtgcctgatgcacacagagaacaaagctaactgcagtggtagcttaggagggccatcttagaagtgatctttcaagcatctcccagccagtcaaaggtgaggaaccctcacagcactgtaaactcaggttgtcttaaaagtgatacatccgaagacactgtccagcccaagcaggaaaaggccagagcttagatgttctggagagtaccctggtatagagctgagaaaggttctaatgctttccagaaagccagacaacacaactcataagtgtgagggatttagtgccccacagggcaaacattgctcagcaaaagaggggagtgaggaatgagccagtaaaaaaattcccttcctttcttgctctcagctcattgttccaagtatctgtggtttaaggaaatctgttagaaaggtgtccatcatgcaaaatctttgttagattatcatgcaaagcttggaccaagttagcaagacacccaccatcgttactggctttccttccttccctgaatcatttcccttgttttcctcattcttgctgtccttagattgactctaccagtagagccttagctagaagttttgcctcaacctattttctatggaaggcaggctacaccagcattgctttgagcctttccgaggatggcgttgtttgtgagcagtaggtacaacaggcatggaatattcagaagctcatttacctgcagctttaaagctacatcttccaggttgatctatcagtagtaaagctgacgttttgatctccttttgccatcttctgtgtttctctgttaactggtctcaaactcagtaggaaaagtcatataattgatatctcaagccccaacagcataggc

SEQ ID NO: 6692 - DNA, 2689 bp, mus musculus
gagaagttcccctttcagatgcttttccttctccaccccaccccaccccatagtgttccctcattctcagcctccccaacactcatccccaccctaccctgattccctattctccgatcacaaaccctcaactctcaagataacataccgttgagatgaaaatggttgatatggctgggagttgtaaaatgagagcactggattcaactctggagagaacacgtagtgtgacactttcattttacagagaggcagcaaggggctgatgcatgacttctgccagtgttttacatttttaaaagacaaggaagaattcgatgtgaaggtgtaattagagtttgggatttgggtgttctaggctggagagagtggctggggtgtggggtcctgtgccctcccttctccccacctctccaccaagctgagatcttatctatccaggagactctttggaaatggaattcttcagggcttttatctctgtccttctacctccctttaaaacatacagcattgctttcatgtttgaacaataagataattcagttaaaatagagctacaattcttgtctcactcaactgcccccataaaaagcaactaaaatatccaagactttgctcaaatagaatctgtctttggagacttcccccactatttcctgacagacggtggtcatagctcctatatctgcttccacacttacctgtggtatctccccttctagacttgggcccaaagcctcttggcataagaggctcattgcatgtacctggcacatcctgaactctcaatatggtaggatgaatccatcaaagaagtggatcagtaacaattagcaatcctgagtttaatcttgagatgctgcatatggaaagctcttttcttgagacagagtctcaaaatgtggagatgatgtttttcttccatatcagggtgaggaaacatctatgttgcctactttagtttctaaagagctttccaggctgggtgcggtggctcacgcctgtaatctcagcactttgggaagctgatgtgtgcccaggacggagtgcagtggcgtgatcttggctcactgcaacctccgcctcctgggttcaagtgattttcctgcctcagtctcccaggtagctgggactacaggcgtgtgccaccatgctcagctaatttttgcatttttaatagagatggggtttcaccatgttggccaggctggtctcaaactcttgacctcaagtgatccgtctgcctcagcctcccaaaatgctgggattacaggtgtaagccactgcgcccagcctggaaagctctttagaaactaaagtaggtggaccaggcgcggtggctcatgcctgtaatcccagcactttgggaggccgaggtgtgcggatcacgaggtcaggagatggagaccatcctagctaacacggcgaaaccctgtctctactaaaaatacaaaaaattagccgggcgcggtggcacgcacctgtagtctcagctatctgggaggctgaggcaggagaatcacctgaacctgggaggcagaggctgcagtgagccgagattgcaccactacactccagcctgggtgacagagtgagacttcgtctcaaaaaaaaaaaaagaaaaaaagaaactaaagtaggcaacataaatgtttcttcaccctgatatagaaggaaaacacctatctccaaccaacaaagatttccctcccaaagatccagctgtttcactcaacatgtatttcaggctgcctgcgaggtacaggaataagtcatcactaagaggcacaggaataagtcatccctaagaaagctgccttcttcagctggatgtggtggcttatgcctgtaatcccaacatcttcggacgccgaggcgggtggatcactttagttcaggatttcgagtccagcctggccgacatggtgcaaccccacctctactaaaaatacaaaaaattagccgggcgtggtagtgcacgcctgtaatcccagctactcgggaggctgaggcaggagaatcgcttgaacctgggaggtagaggttgcattgggccgagattgtgccactgcactccagactgagcaagagagtgaaactctgtctaaaaaaaaaaagaaaaaaaagaaaagaaaaaagaaagctgccttcttcaaggccttctcttccctcattcttggtcaccctcagaacatcttctcttccagttctcctgttcttgagtgatgaatacagtgtctcatttattagcctagagaccaatagaaaactatactctctaccttttcagaaagactggggaaactagtcttttttttgccctgctcggagaccgggcatctgaggtttgcctactgtttgggagaggaacacagggatactgaggaggcagaggagagaatggctaagcccctcagctctgccctgcagtggcctctggccccaggtgctgctggccctaccaccccttcaccaagtcactccactcttgacgctgcaccctcacccagcagtctgcaaaccagtttagttaagagtgcccaaagtggaaagaaggaagccaaatgccaaaatcatcccttttcctagtattatttggttcgggtgaggtcaggtgtagcaagtagtcagttgtgaggcaagatttagggagcacaggaaggctcaggctcaaaaataaattcca

SEQ ID NO: 6693 - DNA, 374 bp, mus musculus
aattctccacctaacttcttcaaaatcctcaactattcatccaatctggagttaataagaaacatttgtgtataagtaggagcaaataatattttacttttttatttataagatagcaaatgcacatcaggaattgcaaagctgtttttgagaaaacgaggatccagtttacctgaagagttgtgaagaatatatgaagatggggtgccatcagaggtgaggtaaccctggttttgaggggaaaaccttaaaactagcaaaggaaagccagtaagaaggggaagtagaatttggaaaatagaagtaattgagccacaaactttacaaaaaagcgtgatacagaacaaaaatagattatgaataaaaaatagatt

SEQ ID NO: 6694 - DNA, 196 bp, mus musculus
cccacatattttacgtgttatgtttttattatcactcaagacataagttacatttagtcttgaagtgtattttatctgacattaacataacattactccagactctttatgctgctaacatggtgttatgttttttcatctatttatttttgatctatccgttctttatttttaaagtacatgtctacaaaagcca

SEQ ID NO: 6695 - DNA, 2612 bp, mus musculus
tcgatgggtataatgtattaggcgtattcaacatgactataccataatattcatattctcactatatccaacatttatatgtactaacttcattataaaaatttttaaatggggcttaaagagccttccttttcaagaaatcactctttataataacatattctctaaatttaaaagtaatcatataaaaatgagataaaaataaataggtactttatataaagtgtttgatatgaaaaagaaaatttgcactggacaagttaaacagtcaaggaagattgctcaagattgctgcaatacagaagagaaattgaactcaactccactgaatcagagggcaggagagcttttaagtactggaatgagccagtggaaaagtactagatgatattggagaggagattagtcaatgtgactatgccatctgtatttgctaatctgcatttatctatcaaacttagactcttaaactcccacagagactgggagatgaggatgttattgtccttgatgattatatatttcaaagtgttgtctcccagttccttgagaaagacattactggactgtaaaattgtcaagcaactagaaggagatttatattttagaggggcagagaaagaaattacaatagaaacttttctaaagcaaatgctctaagaaaagggtggcaagggacatatatttgtgaaaattttctgaaacttagtcaagctgaggggagcatttagtctgtcctggtcagttgtatgatactgtggctaggatcccaggtacttgtcaccacaattatgtctgtctgtctctccttttctcttttttcttatagtagcaaatatttgcaattcagagaaaaccattcctttgctgtggcccgttcaacagctgaaaacgtgaatatgtaacctcagtgcaggagttatattcaaggcagttttaattttttcatagtgttcagtgttacacatgagagatacagcacatggacatgcctggttagaatcctcaaaaacaaaaatcttaaagggttccataatgccacatattaccaacataggaaactccattatttatggtggaaatttaaagtacatatatgtatgtgtgtgtgtatatatgtgtgtgtgtatatatatatatacacacacataattatatatacacacatgattaaaatgtgtatgtatatatatgcacaattatatatgtgttaagtatatataattacctatatgtataatttgttagacatcaacattctttttgctatctcaaaataatttggaaatgttaaaatagccaacgtaaggactatatccaaagaatttgcttacctggtattcagagttggattttagaaataacttgccatatgtggttcaactggacaaaaacaagcaaatatgtgatataatagtacaatatagtacatggccaagtaagaaaatgaattatatctttctatgcaattgtatatgtataaatatctacctatctatataattacgtgctattcattataaatatgtataattatatataacatatattttcttttaaatagttacattacttaaggaggaatgtataaacatataatttccaaatattaacattttgtttgccttttgtaagtaacttgcaaatattatataatcaatgtaggtatctactatgaaaatgagattttaattaaaagtttgcctacttatagaaggaaacatgcatattttatttcctacttttgctttggttgttcagaaattcaattagttcaatttaatgtttaatcattactcttaggagttgatatatttgcttgttttgcatcactgattctaaacagtcaaggaaaggcaagccacccttggaaggtcttagagtctctgtgttcatgaaatttgtcatcaaattattgcatcagtaaaaagcttgagaaacttttttttctgttttgttatctaaacatttaacagccttgttacgtatatgacttgtactgatttatcttattttcagaagatcaatttatgttgtgtattctttcttcaataatatatactttccctttgaaatgttcaacttaatttaaaaataatataatttaaaaagtggagcatggtttagctaacgaaatatatttattgaacattataacgtataatgtgatgtagataaaaatattagtgactggatttttcccctggtgaatcacagtggggagataagtatttgaaggaatcatttcagtacagtgttgtatgtatcaagtagtatccacagagatgtaaaagctaatggaactctggagtcagaccaactgaatttgaattctcagctttggaactgactagttgtgcagtctttggcaagtgaattaacctttcagtatttccatttcattaagcacaaaggcataaagatacgaacaattttatatggtagctgtctggattacatgattaatgcatataacttgcttaacctagagatagaattatattgttaactaaatataatttatgactgtgactgagagcctggattggtgaggagggttgaggatgatttcctgaaaagctgctttcagagatgattctggctctcagaag

SEQ ID NO: 6696 - DNA, 499 bp, mus musculus
tggtaatccaaattcctgaattcagcccatgtccaacttgagtgagaatcactcttatttggggtgtcaacaccattctggtgccccagtcttgcagttctgggtgaaatcatgaagggaatcatgtcagccagtggtggtgatggtaatgttgcatgtggggtctgtgggcagggttggtacagtattagagaacctcctgcagaggagatcaaaatcagctccttacaggtatctatccaggtttgaggtgccctgcctacatggcactgcaagctctagtttttgaataataacaaataaagtggatttaactgtggttaatttaaataggatattggatttttgttcctaatcacgaacttggctagctcataatttaatatttacttgatgtctaattaggcaagtgtcttgttaactgttaaattaaagttagaaatggaatatatttgaatagtcccctttgttataaggatgatatcttattcagatcact

SEQ ID NO: 6697 - DNA, 352 bp, mus musculus
gggcctcttttcttgaagatttacattttcaataacacataggatacagaaaaagtgggaggatgtcatttatcagaaagacagagagcagatgtatggtgtatagccagaaaaattagctggagacacattaacattaaatatcttaaaaggaagtactcaacaagagcctcagaattcagtgttttgtatcctattaaagtaatattttgtactttgcagcaattttatacttggatttccaaatctttacaggcagaagatgatcattatctttattctatctgtgtgaaattgactatggctaatttgggaagaacctttaaagtaatacctatataaattcaagttg

SEQ ID NO: 6698 - DNA, 134 bp, mus musculus
gtcttttacttaattttattttgacaagaacatgagaaataaaaaagttttagattatttagatatcaagccagggaaaacttatccagtctggcttccatgtgtctggtagagcaaataacataacatcagaa

SEQ ID NO: 6699 - DNA, 629 bp, mus musculus
tggcattcgccttcgcatctagttaaaaaacatttcatacatctactctttcaggaagctctcttttaacattcaatgttaggtactttctcatcccaaaagtctctcccacaatagagtcacaacttctatggaaacaaacaatgtctcactcatttctgaatccctgttcccaacacagtgcaaggcatgtgggaggaggtactcaggaaatctttattttatgaatgaataaaagctaacaattgtgtatagcaggttttgctatgtactagaaattagaagtagagaatactcttcacactgcagaaagactatatcaatgcgtaaaagattcacataatctgaagcaagttattttatatggaatgaattggggtaactatacatagtataatataaaattctttgccatgcaaaggggaataaaaatgagccaggcgctgcacagaatttgggaacattgattggggaacagttctgaagtagaggcctattgtgtaagtaaatctctggctgagttcatcggtctcctttgattgttcagctaatgtcacttcaaaacagactatgctttcttcatgttaacccttttttaaaaaaattgaaactgttcagggcttcaagac

SEQ ID NO: 6700 - DNA, 629 bp, mus musculus; identical to SEQ ID NO: 6699

SEQ ID NO: 6701 - DNA, 629 bp, mus musculus; identical to SEQ ID NO: 6699

SEQ ID NO: 6702 - DNA, 802 bp, mus musculus
atgcaatcttcataaagttttgcaaaaaggtagagtacaagttgctaaataaaacttgaaatctctttagtgtatgaattatatttctatgtatgcttgagagtaatctgcatttcctgtttctacttataggatacaaacttctgaagacaaagtctatgcattttctctcatagttttgtaccaagcatatcatgagtgggcaaagaatgttgttgtttatcataataaaaagattcataatctttgaaacatatctttttttttaacatagaaagtgcagaagatagatgtttgtatgttgcaaggttttttgtttgtttgtttgtttttttgacggagtttcactcttgttgtccaggctggagtgcaatggtgcgatctcggctcactgcaacctctgcctcccaggttcaagtgattctcctgcctcagtctcctgagtagctaggattacaagcgcatggcaatatgctcgctaatttttcgtatgtttagtagagacagggtttcaccatgttggccaggctggtctcgaactcctgacctcaggtgatccacccaccttgacctctcaaagtgctggggttacaggtgtgagccaccgtgcctggcctgtatgttgcaaggttttgaaaggaaaaatggaaaactgtattttattttcattaacttagattacaagaagaaggtattagggttgatgtagcagtcttttgatggagatttgttagctcaaagggcatctgagagtctaaagttccaaccattcatgatcaccgaatgggctaatgcacttaaa

SEQ ID NO: 6703 - DNA, 507 bp, mus musculus
atccttggaaatgaagattcaggaagcttcctggttggtgaacacaccaaagtttaggagggtggttcccccagaaataacacagaaacactacaccctacccccataccttgttctatgaatctttttcattttgctattcttcagttgtatcctttcctgaggtctgtcagccattctaatgaagcatcagacctgaggagggagttatgggaacccctgatttagagccagttggtcagaagtacatgtggcccaagacttggaactgctgtttgaaggagaggcagccttgtgagactgagtcctttaacttgtgtctgacactaaatccaggtagatagtatcagcattgaattgaatttgtagacacccagttggtgtcagagaattggagaactgattgatgttagaaaacaccatactacagatttttttaaaattagcagatgattagataactacctgtgataattatatccttgcttattaataaggcattcaaaa

SEQ ID NO: 6704 - DNA, 838 bp, mus musculus
taccatatgtgtggactctttagacaatggcttttgttggttctatatgaaagtaatagaacagcagtttgtatcattgtcttaagcagaaaaagtctgtaacagtttgaagaattagacaatcctgtttttttcaataagatactccccctttttatattttagtaataacatggtttgaataataagggaactggctaaggtttttgttgttgttatgttgtttgaaagccgttgaagatcccgtcagccaaacttggaatttggtccttggtataccacagagccaaccaacagcagcaagcagcagtgaatgtgaataacaagttctctttttttcttccccgtgtaagttaacaaatcactgttgtctccagtatacagaacctcagcattgacattctagaggtaaaatgtatttcacattttgaaaaggaccaaccctaagacagttggtaaagttaaaaaaaaatactgtctctgaagtccttcattgactttctgagtttattttacttcagccatagtccagggaatcagtcctttaagatggacacttctccaattctttccaccagatgagaatatatgacaattaagtgaaaattgatgctagagtgaattgattcaatgataattttccacattcctcacagtcattctctaggaatcttggtaaaacttacatgtgtcatacaagagggagcatggaatacgagagatgtgagttaaaattttacctttcatttttattgggcaatatttacatattacttaattttatgcatattctcaatatcttacttgaagactttctgtctttattatgaaaattaag

SEQ ID NO: 6705 - DNA, 986 bp, mus musculus
actcacgactggagccacaatagaggaaggagaaaaggaaggtgtgcccctttataatcatgactgagaaatggtttaaatgttttcctttcatagacatgattggccaagaattagtaacaaagccagaactggctacatgggaccccgggaaatgtagttgttgctaggaagtcatatgctcaccctggaattctattactaaagaagaagagaagaatttgatttggagggactatgtccatatccttcacaagttcctttgtattttaagaacccctcatttcggaagagttagttttgtttcctttagttaaaaaagctactacatacttggaggatccatgacatttagaaatggagtttctgaaaatagaaaaataaaattgagaaaagttccagatgatagtcttctttcttttgcttaagatttctttttctttttcttttttttttggatggagtctcgctctgttgctcaggctggagtgcagtgatgagatcttggttcaccgcaacctccgcctcctgggttcaagcaattctgctgcatcagcctgccaagtagctggaattacaggtgcccacccccacatctagctattttttttttttttttttttttaatacagacagtgtttcaccacgttggccaggctggtctcaaactcctgacctcaggtgatccaccccccttggcctcccaaagtgctggaattacaggggtgagccacagcgcccagccttaggatttcttaataggtatttattagaagcttaagttatgtgaattatcctttgaagctgatcctcctttttattgctttctaatattgatatatttttaattcttgctatcaaatttttatttaatcccttaacttaatggaagatgaaggtttgttgtgttttcaaaacacacataaagctattattatatgttgactttttctaaaacttgctgggtatacaaattatagcaacta

SEQ ID NO: 6706 - DNA, 496 bp, mus musculus
tctgtggatagagcttcctgttgtctcaatccaactgaaagtcaaatggcaagggatcctgggtagtacagtccatagaggttaacctctctagcctctgcagagctgaggaggacaaacaaatcttagaaggacaaatggaaaataaatagcattaaaaaatgctcttagattcagttgctactttttttttttttagacagagtctcactctgtcacccaggctggagtgcgatctcagctcactgcaacctccgcctcctgggttcaagcaattctgctgcctcagcctcctgagtagctgggattacaggtgcccaccaccacgcccagctaatttttttgtgtgtgtttttagtaaagatggggtttcaccatgttggtcaggctgctcttgaacccctgacctcgtgatccaccttggcctcccaaagtgctgggattacaggcgtgagccacagcgcccagcctcagttgccacttcttaatttaaatt

SEQ ID NO: 6707 - DNA, 667 bp, mus musculus
ttctttaaaccatcatattcttacttgaatttatattcttagtcattttatttctagcaagatagataaatgcaaagtcttgaatgtggacaatgtttatttaagatgatgttctataagaaactttgaaaaataaaatccaaaaagaacaaattaaataatatgagcttattgaattagtgatatataacatggtgagaaaacacaataaatatcctcaaagatcaaatgccacctgctgtgattctcttggcagaagacccattggatagtcattgatctcttccatgtggtgtaaaagaaattctaaccaagggccatttccccagtggctatacagcttttccaataaagctttttctttatagccacagagagataatgcatttccattgggaagtgagtgtatgagaatataaatcacctgggaatctttgagcgaaggatttttctttaaattcactacagccatcttcacttttgtcactttctaaagcctgggttctcctacgaattttaactaactttttccaatagaaggtggatatattgtaatctaagtaatcttcccaactagctttttggaagagatgtcttaagagatacaagaaaaattcttagcaaaaatcactatttttatcaagcggtcaatatttttcacttctgt

SEQ ID NO: 6708 - DNA, 408 bp, mus musculus
gagagagggtcaccaaggacaagctgtaaaaggtgcaaaatttctaccaacctccatatgactcttagaatcaaaacattgtcatattagtgaaaataattactgacatagattcagacacttttcacaagctaagaaaaaatagtaatttttctctctgccatatacctcctgtcttctctccataatctacctgtatttttatgtactgcaatataatagggccaagctcttcactaagaaatgagctgtatttacatggtgacactgattttcataattttatatttaaatatataaaacatattcgaagtttacacccaataatagaattctcagtccaggaaatggactatagccagaataatttaaatggcaattagaaaaatcatttagtacattttaatg

SEQ ID NO: 6709 - DNA, 373 bp, mus musculus
agttcatttaaggcaaatgccatcttcatccatagacattctatctactctctaagcctgcaaatgatatattctgctcagatcaaaacacagtcttaaggccaaacatggtggctcacgcctctaatacctgcactttgggaggctgaggcaggaggatcacttgagctcaggagtttgaggctagactgggcaaaatagtgtgaccccacctctacaaatagtaacaataaaaaataaaaataacatattcttctccatttctgctacaaatgccttagagaaggacctgttacctctcacctaacttacctctccacctacagattcttctttccacgtcacctgctccacatcctcctgttttgctaaa

SEQ ID NO: 6710 - DNA, 918 bp, mus musculus
aggggaaagcaagatatgagcttgtcctgacagagaggtttggtgagctggcagattaattatggctttgcctaaatacatggaacttgaaaacaaaaagtgataaatacagggcacaataaagagtacctacctgagcaaaagctaactgttgagaagctataggagatgtggctagatcttaaaatgggccagtttgtaaatgtccataaaaactaagtgatgaattctgaaattaataaaaacaaccttttctttttggtgattttttttaacattttattttctctacagatatgatacttattccctttggcttcatagcaattctcaggtatgcctcaaatttcaattgaactgctttctcctccaggatgtcttctccagtatcttcaggcagagttaagcacaccatcttcttttctcccttggtgcttaacagggagagtgcagcaagtttcccattaatctaatgatttctcaactatttgtgttctccagtgagttgtggaaacactggaggacaggaaatatgttatatgtggttttttgtatcctaacattcatcttaatgtctagcacacagcaggcacttaatagatgcttgctgcttgaatgaataatcaaatgaatggttctgtagaagagaaatgatactgaaagcgctatctgataaaaacacaaagaatggactggaacaggagacatttacaggcagtcaaattgttcacgtcataaatgcatcaggagtatgatttggatgatatgtaggaagtgctctgttacatgctgatgctgaatcactgatcatacaagaatagcttaatcctgtgaccctgactctccaaagttaccctataaaaatcactaatgtgaaaaattactttagtttaaatagatttgacaaatgaggcaaat

SEQ ID NO: 6711 - DNA, 354 bp, mus musculus
aaagacacaagaaggaagaaatccctgggtaggttcctcaaacaacattgtgcaatatagttaaaggttttgaccataggtaatcatcatttgcaatatgttttcaaatagtgattactaaataaacgtgaactcaaaagaaatggttttccaaacagtgcacctcagttcaaatttcaataaaggtcttatcactcatcagtatgcaccattttgtgtgaattcaacgtctaaggaagataattttcctcatttttaatgtctaagttcttaaggtaaaaccatatattttggaacaacatcttaagaccacgctcaattatttataatatgagaccaccatatcttaagaaa

SEQ ID NO: 6712 - DNA, 3349 bp, mus musculus
agccctgcatattatcctgatacgatttctaaaaataatttaacatgaagtttcttttttaattttcaatgtttgtgggtatatagtaggtgtatatatttggggtacatgagatattttgatacaggcatgctaagcaaaataatcacatcatggagaaaggggtatccagcccctcaagcatttatctattgatttgcaaacaatcaaattacactccttattttaaaatgtacaacttattattgattatagttaccctgttgtgctatcaaatagcaggtcttattcatcctatttttttgtacccattaactatctccacctccttcccagcccccaactacccctcttagcctatagtaaccaacctgctactctctatatcattgagttcaattgttttgatttttagatcctacaaatgagtgaaaacatgtaatgtttgtctttctgtccctggcttatttcacttaacataatgatctccagttccatccatgttgttgcaaatgactggatctcattcttctttgtggctgaatagtactcaattgtgtatacgtaccacattttctttgttcattcacctgttgaatgaacacaggttgcttccaatttttagctattgttaacagtgctgcaacaaacatgggagtgcagagatctctttgaggtactgatttcctttcttctgagtatatacccagcagtggaattgctggatcatatggtagctcaatttttagtttctgaagaacctacaagctgttcttcatagtggctatactaatttacgttctcaccaacagtatacagggttcccttttctccacatccttgccaacatttgttattactgtcttttggatataagccacttaactggggtaagatgataactcattgttttgatttgcatttctccgatgatcaataatgttgagcaccttctcatatacttgtttgctatttgtgtgtcttcttttcaggtgtctattcaagtctgttgccccccttttttgatcagatcattacattttttttctgtggagttgtttgagctccttatatagtgtggttattaatcccttgtcagatgggtagtttgcaaatattttccaccattctgtaggttgtctcttcactttgttgattatatcctttgctgtgcagaagcttttcaacttgatgtgatcccatttatccatttttgctttggttgcctgtgcttgtaggatattgtttaagaaatctttgtgaggacaacgttctggagagtttccccaaagttttcttgtagtagtttcatagtttaaagccttggatttaagcctttaatccattttgatttgatttttgtatatggtgagagataggggtctagtttcattctcctgcatatgactgtccagttttcccagcaccacttattgaagagactgtcttttccctcagtgtatgttattggcagctttgttgaaaatgagttaactgtaggtatgtggatttgtttctgagttctctatctgttccattggtccatgtgtctttttttatgagagtaccacgctgttttgattattatagctctgtagtataattagaagtcaggtaatgtgactcctccagttttgttcttttgcttaggacagctttggctattctggatcttttctggttctatataaattttagaattgttttttctgtttctgtgaagaatgacattggtattttgatagggattgcattgaatctgtagattgctttgggcagtatgaacattttgacaatattgattatttcaatccatgaacatggactatttttccattttaggtgtcctcttcagtttctttcatcagtgttttattgctttcctttcacttctgttaaaccaagttcagtctaaagctgcctccttacatatgttaggtttggcctagaggtttctctgtacatcatgaactataacaagtggaggtgtaagtagaccatagcatacacttgtgcgaatcaccgaatttgggcccatcaaacgttgtaaccaatccagctgtttctgtacctcacttccattttctgtacatcactttcctttttctgtccataaatcatctttcaccacatggctgcgctggagtctcagagcctactctgacttcagaggctgcctgattcatgaattgttcactgctcaattaaactcctttaaatttaatttggttataacacttctttggtgaagttaattaataggtatataattttatgtgtggctattgtaaatggaattcctttttaaatttctttttcacattgttaactgttggcatatagaaatgctactgatttttgtatgttgattttgtatccagcaactttactgaatttgattatcagttttaatagttttcttgtggagtctttatcatattatctgcaaacaaggataatttaacgtcttcctttctaatttggatgcccttcatatatttctcttgtctgattgctctagctaggactgtcagtactatgttgaataacagttgtcatagtgggcatccttgtcatgttccagatctcagaggaaaggctttcagtttttccccattcggtatgatactagctgcggatctgtcatttatggcttttattatgttgaggtatgtgccttctgtctccagttttttgaggatttttatcatgaagggatgctgaatgttatcaaatgcatgaagtttcttatacaagtcacatctatacagctatacataaaaataggaaagtatttaaattctttaaaaattttattcacacaagtgaatgagtattcttgttgtttaataagaacaacaaatacatgctggaaccctatgtgtgttatattgaacattttctgaatgaaggaataaatgaataaaagagatagtagtagtagcaataataacaacgtcacttagtattttccaagtgcttactatgaaccaagcattgttctgaaagaattagaagtaacttaattcttataataagacaattaacagaaaaattttcccaaaaaaacacccatactttgcctacttgtgtttatctacttatttatctaagtatatatgtatctatctctctagaaaagaatttttcatatattaagggcttgtttccttgccatcgaggacaaaatccaaacttataagaccatatttcatgcctcagtgggcatatccaatggtgggtgaataattccatgattgaaagattatattccatgcatggaatctgactattcatgctaaggaagcaaggttccatgtctaggaaaaccaacttccatgaccaaaat

SEQ ID NO: 6713 - DNA, 1378 bp, mus musculus
gttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggttt

SEQ ID NO: 6714 - DNA, 469 bp, mus musculus
aggaacttgacctttcagagtcaagaactctccatgttaaagatttatcttttggtaggaggatttttttaaaagtataataatgtatacaagtagaatgttacaataatattttgagtctttagacattttaagagaggataattcatcttttctcatttgtgttgcaaggtaggttcccatgttttttaatacttgaaatggttgaattctttttatatcttgaacttcttctggactcttttgtttgtaactgttaaattgtggaaatgacaaagaagctgctactagaagatggtggtttagcttgaagtggtatggtaggtgacacttaaggttaggtaacctttttttcccaggcagggcaaatcatttaaccctctcagtaggcactggaatttaggaaacaagtggaaaacagaaggtaaaatgatgatggtctatacaaggcctcaagattacttggcat

SEQ ID NO: 6715 - DNA, 469 bp, mus musculus; identical to SEQ ID NO: 6714

SEQ ID NO: 6716 - DNA, 225 bp, mus musculus
aatataagattgaaaagatgttaagcaatcaaggctggagtgtagatttaggaattgtttgactagtggtagtagttggagcataacaaactgacgatttctttaggagtaagaataaaagtacaaaacattttatagaatgaaatttcaggaagtgggaaaaatatgtggaatgatgaaaaacaagaacttgaaatcaagtagggggtaactaccagtgccaaa

SEQ ID NO: 6717 - DNA, 116 bp, mus musculus
ataccgtctcatcctttttttttttttttctgtttgatgaaacaatcaccatctctcaagattacatcataagaacaggagtatgttgtgtttttgtttttaaggttcactgattt

SEQ ID NO: 6718 - DNA, 391 bp, mus musculus
ccactcttttttatcccgactgcctcagccttcattcagactcccatccctggatcaattcatctctgtttccaggttaagtcctccagtccttcccacaccattgcttgagtgatctttttaagaacatcagattcatcatgtcattgccctgtgatggcttctcatggtctttggtcatggtcaatacatccattaccccagtagggagatcctttctctacaccctcccaggcaaccgagagtctgtttgtgcacacgctcccctctcttcacctgagatttggcctgtgtacccataggccagcctgatcatccttttctttgctgacttagctcacttgccacccaggaagttctctgaatagttttaagttgcataccccactat

SEQ ID NO: 6719 - DNA, 349 bp, mus musculus
tctcattttcatctcataatcaggtggatccatttggactcagtgtcttcatatgcaccagtaacagaggggcttgtcctcaggctgctgtctgcacatctttgatttcgtccatctccactctcagacctacagctggcctgcaggtggatgtatgccgttgtcattctggttccttctcctagcaggctttcatccagtgcatttctgttcgactgcggtgtattcttcccctattcccaaggccctcattcccaaggtagtcagggctaatttagtctgcctcgcaaataacaaaccctacatttcaaagaactagagttcccattctgcctttctagttgttttg

SEQ ID NO: 6720 - DNA, 923 bp, mus musculus
caaaaacatcatccttgtgtttatattaggaagtattttaaaacatgcaatatgtattttaaacacttttcttttgaatcttgcgttgcacccaaagaatgctaatggtaaccaaattgttctttggcagagtagcctgacccttaaaaaaaggaacagaagtgttacagcatgtgattgtagcacaagacaattatgaatcctcaaccctgagcagatattaactaatcctatgatctgaccataagaggttaccttggagcattcctctacattgcattatgtatattacatggtaatgaatgacagttttcatggctcctaataatgagcagcttctctttatttagagaacaaaatagggggtttacagataatatctgagtttatcattgagctgctcagcctcctcttctatgtgcctcagcttgtctcaatcagtgctggttatctcagcaataaagcattcagcctctagaagttggtttcttcctacaccctataaacaagaggatgaatatcttgttacatgtgctaaaatgagttgggtgaaatgagcattactctgctccctgtcactagctataatcagcttttcaaatctatactgagtgtgtccccacacatagcacactaaggaataaggatgttcgtgacaatatattcctgagaagcagcagttctaacatcccagtgacagctattcattccagtttctttgtgcagagacattgtcccaactccttcaccatgtgctaacaattagataatgactccataaatgtagagaaaaagcagtgtcatggacggtgggtagtttgttttcttagttctttattgaaaacatatggagatgtttatatataaatagaaaacaataaaacgctgccatcatgtaagcagcaacttaaaaagttctacac

SEQ ID NO: 6721 - DNA, 975 bp, mus musculus
agacctgcttgctgctctgaaagagcatgcaatatggtacagttagggagataagatctagctgtgagaagcagtcacacatcctgcttctttttaaaatgaatgtgattacttgagttgtttgtttgttttgaaaataaaaatgcactcaaactgaaaaaaaggaaaacggatgtatttcttcctgggtttgcaaagccacttctgatttcaaagaaagctgctcgataatttcttacgggctcaactctgaaagaagctcttagaaaccaaagtacctaattactaagtcacccccatccaaccatcactactgtttgagttaaactgcctttttccagaagtagagagaggaataggggagaggttctgtgatgggaaaagaatgaggaccagagtgattgtatatgttgctgtttctcgctattcaacaggcaattgaaggcggctgctttacaacattggcaatagtgccttttcacttaccttcttttactcgcagtttcaaggattcagatttggtgttttgattaggaacatggtccaaaaggcctgagttcaggtatcagctgtgcgatttcagccaagttcttaacctatctacatgtcagtaaaatgacattactgacatttttcatctgtaaaatgagattaaaaacagtgtcactgagggaattatggtgcactaaaccacccagcactacacccagactttgcatgggctgaaaaaatcttgtctagtattatcactggtgatgcttagttgactatattagtttccttttgccactgtaagaaatcaccacaaagttaagatgacttaaaacaacaacaacaaaaaagtgtctttttttacgttctagaggtcaaaagtcagaaatctgcttcactgggctaaagttagggtgttagtagagatggttctttacagagtgtctgaggggagaatctatttccttgccttctagtgccttg

SEQ ID NO: 6722 - DNA, 931 bp, mus musculus
gtctgagatctgggagatcttgttttacataagccaagctacaccacttccttaagcccccaaaggaattcagtgctaaggacgtcagtgagctcatgttctctctcaatttggtgaaaatacttgaatgataaattctcattattttatttctcctttaaggtgcccacagaatggtaaaaaatatcctccccactccctagtccttcaaattaccatgtttgtcctagtccttcaaattaccatgtttgtcctcctcctgcttttttctttttgtgttttaaaactaactttttggtaaaaattttcaaacacgtacagaagtacagagaatagtgtaataaaccccccaaatacccatcccattctccagttcagcaatgataaatttttgccactgcttaatatctgcttgatactgaccttttctctctttccttttcttttttttttcagattgcaatagtatttaaatccctgtcatgtcatcatattagttaacctctaactaattctgatttgtgtgtctaaaaaataaaaaaggacattttattacataagctcaaaatcattatcacccctaactgaattaacaatacttttttttttttttttttgagacagagtctcgctctgtcccccaggttggattgcagtggtgtgatctcgactcactgcaacctctgcctcctgggttcaagtgattctcccacctcagcctcccgagtagctgggactacaggcgcatgccactgtgcctggctaattttgtgtttttagtagagatggggtttcaccattttggccaggctggtctggaactcctgaccacaggtgattcgcctgccttgggctcccaaagttctgggattacaggcgtgagtcaccgcacctgacaacaatacttccttaatatcgccaaatcccagtc

SEQ ID NO: 6723 - DNA, 1436 bp, mus musculus
actactaaaaccattgttacgctatgcctttaaaatgaaattttaaaaaggcaaaaggactacttagttatccatcaacctgccagcaaatcaatgaaatgtaaaattgataaacttttgctcttctcattgttcttttcctttggttacttaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggtaagctttctaatcatacattttgctgtaattgattagataagcgttttttttaatagattgcatttctgagtgaaaatttaataggtattactagtagctttattttaaaagtcttttaatggcatcgaacgtgtgaagaaaatttcgtgttataaaaagtatcttctgttgttcatgtataagaacgacagaatgatgttctattgatttttaaaaattgccttcttgctttgtttctgaaagttttcttgtatcatttgacagcatatttcaaaaatatccattaactgtagtttttaaaataacatttattttttgtctccttataaaagtaacaatatattcactataaa

SEQ ID NO: 6724 - DNA, 1436 bp, mus musculus; identical to SEQ ID NO: 6723

SEQ ID NO: 6725 - DNA, 630 bp, mus musculus
actagactggaatgtagaaaccttaagtcatttaaattcctttattttctcccttatctcataatggacttgtcttaaatattttctttatatatgttgaaaaccacatcagacaatgtatgttctgcactttaaatatcagaaacataatttagaaaactcaagaggagaagaaaacccatatttttgtttagtatctttatttcttcttgatactttcagattccttctttttttgtttctcttttgtttcaagaacttcctttagttatttttttaggatagatctgctggtgacagattgtctttgttttcttttgcctgagaatgtatttctcattcatttctgagagataatttcatcatatttagaattcaggttgacatttctcttattttagcaattgaaaaatattgtgccacttccttttggcctctgtttctgatgaggggttggctatcatttgaattgtttttcccctttaggtaaggtgttgcttttttcttggagcttttaagatatttcgtttttagttttagtttgattatggtgtatcttgtaacagatatctttgggtattgtttgtatagggttttacatagtttttcaatctgtaggcttatatcttt

SEQ ID NO: 6726 - DNA, 630 bp, mus musculus; identical to SEQ ID NO: 6725

SEQ ID NO: 6727 - DNA, 682 bp, mus musculus
actttttaggtgataaacaagaataatagttggtcatttattatttataaaaaggcaacatgattctatacaaataacacaggtcttgtaataaaaatccctaagttaaattcctcctgtctctttgggacgggtttggggtatcggtttcattttttgctgcttgtttgtttatttgcttgcttttgaaagatggagatactataatatgtcaaaaatattttgtgagcgtctactaagttaacaaacgagaatgattctaacatagttctggcccatggtagatagtaaacaaatgttaattttttgattactttatattagatggtaggtatgggtgctattctctagcagaaatctgattttttttccctaaatttaggcaaggtggaaacacagcacatccccctcttcttgaagcaaggggaggccttatgacttcttttggcaatgaaatgtgggtagatgtgatggttggtggaaatgccatatatcacttctggatagaagcattaaattgctaatattccacactctagtttatgcttcactctgtgaatatgatagtgaaatgtgtgttgataagaggtgttggaaatttaaagccacctaaaatgctgaaccaacccatgtgtatgtctgctgttgaatactacctggactagaaatagtctttgggtaa

SEQ ID NO: 6728 - DNA, 3658 bp, mus musculus
accagcttgcagctccctatcaatctgtctgtatcctacactggtctatatgtgatagatgagagtagtcatttgttttgtattctcagtgcccaacacagtgcctgggcctgaaaaagctgtgttttaatgaactaataaagaacactttgtatcacttctgtttaacagaggtgaacatttatcaattgaactggatcattttctttaagttctaatttttgtggtaactctgattactcggcaatgtattcttccagacacactcctttctattttttctcattattttttcttccaaaaatatgtaatttgcttaataaaatattttggggtagacttaaccatggtctcacaaaaattgggagagagaatgtctgagacatgagtgttgttatggaatgaataagggagaactcaaaagacccgaagtctgatacggtatgttcataggaacttagtcaatataggttgattactgtatttgtatcacagggtcatatcagtccccccactgaaatacctccagtgcatctcattgcagtcaacatgaaggtagaactccaaaattcattatatggcttcttcatggtcagtctctttttgtgcttctggtctctgaatttctatactttatgtcttaccacttggaattattcatgaactatctttattgtaggtttttatcagtggctactgctctcatgcatattgcctatttccccaactagattatatggtcctcaacagaaagcactgttttttttatttttcatatttctcattgtattttcaaaaatgtgtgagtaatgttaatgattgattgaattttgcatagcaccatatatttccaactgaaatgtaacagtaagatgcaggaaggcttactcctttgtgtgaatgtaaggacaatacagttaatacctgaatataaaataacttctctaagtggttctgcttagattttattctctgttatctgggcacctggctatataatttttaacagtgtggcctcatggttgtttgttaatgggttgctctggggttattattcaggtgttcatggttctctcctcaactggaggagagatgtaaagagaaaggatgttttggaaagaatgccagactagcaattaggagactcaaatttaatttataatcttgtacaaactgctgtttttggtggcctttatgatgccatagccctactatcctgcttgttggggaaaggagatttacataaaactgcttcaatctgccacccctgtgatgtgtgggaagcacttattgctggaacatgatatttgaggaagttccttatgcagaaactaatatggtagctgtaagaccatggataagttattgaccctatctgtgcatcaatttcctgaatagtaaattgatctaatttgggctacatgttttccaaagtcccctctggtgctcaaatccctgtgtttcaagattcataaggaataagaaaagtgcttggaaggagtggatattatttaaaaactgtagggtatattctctattctttaccattggggagaacaactccttttgtatacatccctgaattagctcccagagtgatactccatttagtctgtgaaaatgtaatcaaaaggtcactcacctaagtggtaaataattgtgtagattctagcttccatgaaaaattaagtattggaaaggtcaacgtttccccaaattgggtcaggtatccctagtggcactcaagaagattaagatggtaaactgatattttattaaatagccttgaatcaatggtaaaaaagttctcaagtttcttatattctttgtatatcagtgagaatgtctcaatttcatattaccatttatcacttaaatactcctctagtacttgctaccctttctaatacaaagcaatgagatagaaactcagagtctaaatagagatggtagctagcatttaatagtattatctgtatttttgttgaatctattttgtgattactttctatttttggcatgtgatactgattttccctttgtagtagtgataaagtttttgtttttcatatatgttgtttgtttttaaaatacatttttggttttttttttagtttatgaaatcagttattaaaaagtgagtcaatttaaataaagtagcacccaaaatattacatacatggtgactggccccaaatcataaaagtagcataagaagttgggaagaaatggggtgtatcagtaagagtccatcaggaaactgatgatgtggtcactgggtttaactaaaggcattttggtgaagggatagtgcacaaggtgtgggtgggactagggaaacgaaccagggatgggaagcatctatgggctcaccacagtaggaagctgttagcacttctggtctcaaaagacacgagagaagatgcaggagcaggagggcaccatagaacaggagctctaattctgcgatacagtcactgctagcaactgaagaccatcaagaaggaagggaataagggatgaatacctgacctctctctcctcctacctctgatcctctgctatgctatcagtgcctccggtggctgaactcaaatcagaggccaagggacgggagcggtggctcacgcctgtaatcccagcaccatgggaggctgaggcgggtggatcacgaggtcaagagatcgcgaccatcctggccaacatggtgaaaccccgtctctactaaaaatacaaaaaaaaaattagccaggcatggtggcgcctgcctgtaatcccagctacttgggaggctgaggcagaagaatcacttgaacccgggaggcagaggttgcagtgagccgagatcgcaccactgcactccagcctgggtgacagagtgagactccatctcaaaacaaaaacaaacaaacaaacaaacaaaaaccaaaaaaaccccttggaccttaccttgcattttcatttgtcaacttactctccttaattgtgtttttattttcaaaaagggactgtcattttctgtaactatcatactgtacctaccacagttccttaaacatagtagatgctcaataaatattttatggagggaatttcattggtattcattctgataatccgaacaggcaaaaggagtgaaaactctgtctcaacaaaaaaaaagaaagaaagaaagagagagagagagagagagaaagaaagaaagaaagaaagaaagaaagaaagaaagaaagaaagaaatcaaagcccaggggcgccccggtgttggagtctataggagttcaggatcccttggtcacaaagcagggccaagaaggaagagagcggattggggccagcaagaagggacaagcagagaatgtccaggagacattagggttctccaccacagctaacattgtgattccagttatgccagtttgctaattacatgacattagttcagtacttacatgtatgtaggggtgatattcaaagactactggtatggcctgggatctgaccaatccaaacggataccataaacctcctgctcaccaggctttcatcacatagtttctggattgagagaagcaggaggaggctcagtagagaagggccagagcaggtacagtcaggcagaagggaacttggttagttcagggctagcgtctatgta

SEQ ID NO: 6729 - DNA, 1228 bp, mus musculus
ttaaaaatctgtaatggaattctacttcagaccagtcttctgaacatttctattagggaatgagagtacctcacagtgtagtatgagctccctgggttagactgaaaggtttcaaagtaatgcttttatttttcccttgtcatttattcatctgtcaaatcattctgccatcctttggttttataattttgtgacctaaaaatcacctctccactcccagctggaacctcctgaagatctttacttccaggcaaaactcattctaatcacaactgaagtctaacaatatttacctgtcaaagcttatcagtatatttcctttcatctccaactatacaatctcatcatgttacaatacatgaccatatcttggtttgttatagatatcaagctaacacaggatctagcacgtctacaaacaaacaagtatatgtgattgttaaatatcagcaatgacttgtgataagttctaagtgaattatcttcttctaaattaacgacagcagcctatgaaaagcaggcagttttaacagactacgtgttgactaaataaataaataaatgatgttgattgactaaatttagtgccataaatatcaatgagttctattgatgttctttaaaaattatttcttcctatcttgtcatcggacaggatcaatagttgatttttatcttgtttcttctttggagtttttcctcctggagaaaaacacaccttctctgacctgtactcttcatggacggacctttctgtggccctccagctggtagactgacttttagctgctgcacattccactgctgtttcctgtgcttgctagccaagtcctcttacttccaagatgatacccccactaactggagctcccaaaacataaccttcctctgtttcttcacatttggatcaggaagtagtatcaggtcagctgtgacacgggatgttgtctagaaggtcagggaaggtttctggcagcaaagaagcacactgtgccaggcttcttgagcaaaagagtggtgacctgctccctcccactcaacttccagcagctgaaaagtctccaacgaccacagctccaccttctaatgacttttccgaacatttgcaagagctagtcacactccaggtgaatattttcagacacctgggatgggctgtttcttcctgtttctttgttcatataaaaagactttagagcaaagggcagaatatggcaatttctttctc

SEQ ID NO: 6730 - DNA, 376 bp, mus musculus
gcggtcaaaatccagtccctaaactatccttgattttataaagaccataattaaaagtctttcttcttgccaaattcctaatctttaacactgcatgaataatcctttagggtaatggtatttaatactgttagaaagaggtataaaatgctataatttcagaaagattatttaggcaatatcaaacaggaaaaaataagcacactttgggtccctaaacttagaattgccaggtaatgtgaaaagaagttcatatggtcaagttccctggctctggattttagcaaactgaagtagtgttctataggcccctgacgaaatttagatgatcaaaggcagcatttctcatctgcactttctggattgggtctctcaa

SEQ ID NO: 6731 - DNA, 364 bp, mus musculus
ataccacgttttcaaatatgatttttctgagttctgtgcttgcaggcgatgccatcagtgctctcccagatctttaggggcagtgtacccagcccccaaatgttctcagtgttggcaaataacaacccatggcttttcagaactttgctcttagccaaatagaactagccgtaggagtccaaagtgctccctcccaccagcctgcagtccctgtaaaatgactgactgattcaggagtacaagactggctgctttgtcttaaggtggcaaaaactctgctgtgcggttcatatgccagaggttttcatgggatcagattatagctagtggataaaccacttctcttctcccccttttgagagga

SEQ ID NO: 6732 - DNA, 770 bp, mus musculus
attaacataattccttggtatgacagagaatgatgaaatatcccagattttctcaaaagtgcctatttgcttccctggtatcatttaacccagaaatcaacaaactttttctataaagcgccagatagcaaatattttttatttcattggctagatggccactgatgcaattactcaactctctgccattgtagccttgaaagccaccatagacaatatataaaggattgggcatggctgtgttccaataacaatttatttacaaaaaacagtggaccaaatttgccctgcaggctgcagtttgccaatctctaatttaactcattattctattttctatatatttcataaggtgaacattagctttaaagccttgattggatttgggggcaattgtgtgtttgtgtgtggcaagaattcttcatagggagtgctgcatgcctcatatcacatcccatcagaggggttttcccactgttggcgatgggaagaagactcgatgggtgcatttgggtaaggcctgatccctccactgtaaactctccattagactttgtctagtggttttatctattacatttgctgcctaaatcaattatttcattcgaggttgcaaaatagcaattttctatttctgttattccatctgttttcattaaccagaatgcttttgtaaggacaaactttccaataacaatgagggatttcagttacactgagatacagtttatataggaacactttttacaataaaaatatatgctaattct

SEQ ID NO: 6733 - DNA, 770 bp, mus musculus; identical to SEQ ID NO: 6732

SEQ ID NO: 6734 - DNA, 770 bp, mus musculus; identical to SEQ ID NO: 6732

SEQ ID NO: 6735 - DNA, 770 bp, mus musculus; identical to SEQ ID NO: 6732

SEQ ID NO: 6736 - DNA, 770 bp, mus musculus; identical to SEQ ID NO: 6732

SEQ ID NO: 6737 - DNA, 770 bp, mus musculus; identical to SEQ ID NO: 6732

SEQ ID NO: 6738 - DNA, 1604 bp, mus musculus
gtatggtagtatgtcccgaattggtgggttcttggtctcgctgacttcaagaatgaagccgcggatcctcgcagtgagtgttacagctcttaaggtggtacgtctggagtttgttccttctgatgttcggatgtgttctgagtttcttctttctggtgggtttgtggtctcgctggctcaggagtgaagctgtggattttcgtggtgagtgttacagctcttaaggcgccacgtctggaattgtttgttcctcccggtgggttcgtggtctcgctggcttcaggagtgaagctgcagaccttcacggtgagtgttacagctcataaaggcagtgtggacccacacggtgagcagcagcagaatttattgcaaagagggaaagaacaaagcttccacggtgcataaggggaccagacgggattgccactgctggctgggcagtctgcttttattctcttatctggcaccacccacatcctgctgattggtagagctgagtggtctattttgacagggtgctgattggtgtgtttataatccctgagctagacacaaaggttccccacgtccctaccagattagctagatacagagtatcgattggtgtattcacaaaccctgagctagacacagggtgctgattggtgtgaatacaaaccttgagctagatacagagtgctgattggtgtatttacaatcccttggctagacatgaaggttcaccacgtccccaccagactcaggagccccgctggcttcacccagtggatcccgcaccgggccgcaggtggagctgcctgccagtcccgcgccatgcgcccgcactcctcagcccttgggtggtcgatgggagtgggcgctatggagcagggggcggtgctcgtccgggaggctggggccgcacaggagcccacggagcgggggaggctcaggcatggcgggctgcaggtccccagccctgccctgcggggaggcagctaaggcccgagaaatcgagcgcagcgacggtgagccggcactgctggggcacccagtacaccctccgcagccgctggcccaggtgctaagcccctcattgcccgaggccggcagggcctgccggctgctccgagtgcggggcccgccaagcctacgcccacccggaactccagctggcccacaagcgccgcgcgcagcccgggttcccgctcgcgcctctccctacacacttccccgcaagctgaaggagccggctccggccttggccagcccagaaaggggcttccacagtgcagcggcgggctgaagggctccttaagtgccgccaaagtgggagcccaggcagaggaggcgccgagagcgagcatgggctgtgaggactgccagcacgccgtcacctctcggtaggatcccatttaacaagacacaatcaatgagggttgaggtcattatggcattatggagagtttatgagaggcagggggatggaaatacattttataagtacacaaaagcttctggtggctagatgtggcagattcatagggtgcctttaatacttaaaatctcacctggccacttgcaaagttgatggccatggcaggatagattgctgccaataaact

SEQ ID NO: 6739 - DNA, 188 bp, mus musculus
tctattggagtatgggaagccacatggtacagaaccaagaagcaccacctcagccacgtgaattgctggacatatgagtaaggacacctggaccttcctgaatgcagcattatgaatgaatccatgaaaaatcattagaagtaccacccaccgaacccaacaagttgtgagaaataataaatcatttt

SEQ ID NO: 6740 - DNA, 325 bp, mus musculus
tgacagtaataaggatggagaagagaaggtggatttgagagttagaggacactgaccaaaacaaaacagttgatgatgaagtgttctgcattactacaatacaaaaatgtaaatacaatacagagagctaagaggtgagaatcaaaattaactaatggaaactcactttggtggttttacagtaggcattttaaagcataattttcaaaattttcttttgtttataaatttgctgtaatttttcttatagggaccaaaacaacaaatcaggttgaattcctgcacattaccctccctagacataccatatcactattattataaa

SEQ ID NO: 6741 - DNA, 257 bp, mus musculus
tcttcatgactaaaggaaaataaaatcactagtatttaatttaaacttacctgttatttgtgcaatttatattgtattaatagtgcaaactcagtctcttgaattttagaaatatatttatgcaggatctatttttaaagacacatttctgcaataatttagactcccgttttgtaacatagtaccatctggaaataaaatataatgcagataatttcccttttatcaccatagcacttttgtgctaggcaaacagc

SEQ ID NO: 6742 - DNA, 468 bp, mus musculus
gttatggttcataaataatatcatcaacaactaatacttattaagaagtatctgcatttaaagctgttagatacattaaataggcatcctaaacaggatgaaaatgccttatacaaatagaaaaattcaaacaacacaagctataaaatagagtataaaatacaaccaatatttatttacattaaacatactacttttctttccgtggtttgtgttctgtgaaattatgtgggagaaaaatttcatattgcttttacttaaatgaaagaaccagacaaagcctggaaagtttgctgaattttatcaataacacgtatttgtaaatatattgtgtgcttattatttttgcttgtctttcatttttgggcacagcatctccaaattttggtcacaaatgatgcataaccctccagaaatacagcttaaaagaagaaaatgaagatggaaaaataacatactaaaaaatgt

SEQ ID NO: 6743 - DNA, 468 bp, mus musculus; identical to SEQ ID NO: 6742

SEQ ID NO: 6744 - DNA, 2294 bp, mus musculus
taaaatttatctttaataagacaagatatatttttaaaatagtaccagtagagaacaaatagtaattatcaatgtgtacaagacatgatatttctccttaccctcaaaatcaacattgtcactcctaaagtctaattaaaataatacttcctgatgctagattattaaataatactattaggaattactggctatgtcagtgatttttttttattttattgtattttccagcaccatacagttatctgactggtaaatcattatttaaatgccaccaacgactatctgaatatgcagaaaattaagttcccaaacttacaggctgaattatacaaatggtcccggagtgctattgctgatagtattgagcaattgatgtttcatagcatttaataaaaatagaactgtaaaactggcatatacataaaagtcattggcaacaaaaggaaacattgttattttggaacatattagtaaaatacagattttattaaattgtcattccagattctgaaataataagctggctgtgaaaccatgacatgtttccctgtccccataaatttaatttatttctaaaattcaaatttatatcatttccttacatcttgcactatggcaatattattatttaaatcattgatttttgcataagttacatttctattttgattagctaattgagaagattataatcatcgttttaacttggaatttgaagtgcatttgtttataagaaagatcctggacagaaactcccagagacaaagccatttaaacatcacattgctttgagaatcccacagagctgaacttgataggagttgctggtaatgcaaaccctggggacatccttattagtctgcccactgagtggactctgtgtgtgtggtgtgctccccgggctagcaatagctaataatttaaagctggtagaagagtcactccagacatttaaaatgcaatcacctacctttgctgacatttaaaataaaatgaaccagtgtagttcctgaagttaacttgagatcctccaaagggatccatgaagttgtcatgtggttttgtattcccaactttaagttccatatgaacctttaggccatgaggtggcggacaggagaatgtactataccatcaaatgtttattaagtacttggtctctagatgtagaaagttaaaggatttcctgcctaaactgaatcatttctgaagataagtcatcctctaataaaataactaccaaatgcctgctgctgctgatgatgatgatgataaaatatttaaaatgtaaataccaaaaaaatacaaatagcagaagagatctattaagataggatatagttgtcagagttcaaaacaggtggactctgaagactcctgctcttatttatgacctcaaatttgtttttctcctctcttcatctgagttagggtgtgttaatagtgctttaatgaaatcacttctactaacttccactaactaaaaagagagcaaggccaaattgagctttctttcaatctgttcctatttgttctatagatagcagagtttctaaatttaaaaagtcacatagaatttaaatttgtagtgctttagagatcaaccccaaattactcactatttttattctctcagttgtttcattggagatcttggaaagcataagtaaacctaagttttccaggttactatatttcttgaaaacctatgcattaaagttccccatcctccacaatggaagattactataacatattgtaagtctaggaatctcataagatatgaattacataggatcttccagtccaatttgcacaaaattcacatctcttaatcaagaacaattaagaaaagtctgacagtggtgcctatattagtctgctctcatgctacttataaagacatacccaacactgggtaatttataaagaaaaagatgtttaatggactcacagttccaaataactgggaggcctcaaaatcatggtggaaggtgaaggaggagcaaagtcatgtcttacatgacaacaggcaagagagagagtgcagggtaactgccctttgtaaaaccatcagatctcatgagacttattcactatcatgagaacagcacaggaaaaacccacccgcatgattcaattacctcccaccagctcccttccatgacatgtgggagctatgattcaagaagagatttgggtggggacatctccaaaccatatcagtgccattagaagaagcataaggcaaaaactcattcacatcccaggtttgtttacaagatataggc

SEQ ID NO: 6745 - DNA, 469 bp, mus musculus
ttgaattagagaaaataaattgttatgaaaagccaatcagataggaaaagacatatttatgtttcattggacagatatgtatgggaacaaaacatcatccaacctaataacaaatacgcactattttattggcataatggtgaatttagcttaaactaattcaaaatgatattattataacttctgccacattttatagtcaacttgaaacttaaatttgtactcattgtagttattccatcctcaccacactttttttctcccattctttatgatactgctgtaaggttattattattattttgggtttccacaacattttcagaaaattatgtttttcaaagtcctgtgaaaaaggcaaatggaatcattttgcaggaaacttaaataaaaacattgaagcatcaaataacaataaagtttcatagctgtgactcttgataaattgtttagattctaggtgactttt

SEQ ID NO: 6746 - DNA, 437 bp, mus musculus
tcgatcattttctgtgcagtattgggtctccaggacattatgatcatctatgtgggctttttctgttttttgtttctttaactgcttatgaaagatttggctggctctgcactgcttgcagattatattctgcacacagggacataccattaattcctgttttatttgtctatattaaagccaacacctgcatcttgtttagcaattaacctgcagagtaggataaattgaagtgattaaaaggatgtgtgagattcagtccacattgtctttatattttcatctccctaatatctcaaatcaatcaattttttcttagtatcactggtatttgagtgtaatgcatgcacaaaactttactattttggtgatttgtgatactgttctgttcaacaatatctattcagtttctgctatatgttagacgatttctatgt

SEQ ID NO: 6747 - DNA, 12137 bp, mus musculus
tttcaaatttgaaaaaattctttatgttaaaatagtggcaatttaagcaaatattagtttatggaaatttacattttatttatttcccttctctttgttagaaaacaattacccattttacttatttaaataattaacaggatagcagtacatttgactgcctctttgagtaatttgagcctctttaattttatgttttttcaattcatattagaatcagaaactacattgacccagagaataactggaaaattaacaatgctctctttcactgcctttgtgagttaatcagtcattatagaatgaagaaaagaatacatgaaatttttgacaaagtatcacaagatgccttatgataactggcataagatgtattgagctttcatggcaatatatcagtcaaatacattatgccaccagatagataggttgatagatagatagagagacagacagatagatagatggcttaaaaggagaaatgtatatatacgtagcatatatacatatagtgtgtgtgtatacatatatatgccttaaatggagaaaaccctccatatttcctatctgaaacacagtgagtgacataacatagattctcaaaatgcctactgaatatagttattgaataaaatctatttgaaactgtatgttcaaaataattttatctatatatctatatattaaatattatctatagttagatatggtggtataatgtatttgactgatagcttggcatgaaagctcaatatatatatatatttatatatatgtttctgagtaatataaaggatctagtaatgtgattatatattacatgaagaaactgttctattttgaaactgcttcttttacaaacttagctgtttttacaagtatgcctatttaatttcatgggataacaagaaaacatgtatataggtcataggaggataatgcttaatgaaataacagatatagtggaattaagatttgtatatagaaataataattctattataaactaattggtgatttgaaactattaaatatcattatgtgtgtatgtgttcattttattatttctatctcatgatcatttattcactaaatcttagtatttggcatactgagtgtccttatcctctcaggagcatcttccatttcaaaggcatgaatcatagtggaaagatatcagcatcattgaggcaaaatattgaattggcagtctggaatgaaggtctgaattgggaccaagaaaaaaaatgtccaggactatgttccataatgaaatatattattaactaaaactcgttacctaagatgtttccttggtccatttaaaagtatttggaaataatttttctcttgtactatcttgtaagccttgttgtttcctaagtccatgtttaaggatgttcataaatgatataatacatatttatgactaacaatttcaattgatttatatttaaacagggataaaggatctatttctacttgtttatttttgaagttacactggaaatagtcacattttattttaggtaaatcttatgctttgctgagcattaatgtttccactaagccatacaagtgcaaaacaaacagatctatgtgcatagttacacttgtctgattttagaattaaagatgaacagagtcagcctaaggcaaatttgtgatgaaagagataaagttgaacatcagctcacctacttccttctgtttactttcagaatgtaacatcttttctaagctttgagaactctctattcttttctgtgctccctgtcatgaagtatgctgaaatatttatggcttattgggtaatttagtatttgaaatgaaagaacataagtagaataatgaatagagaatctctgtcaatttattcctgtctcctacattgtacactactaacacaagtaatcaaactgataaataccatgtcaaagtctgtcttgggaatgagaggtcatgagagtggactctagattgttataaagtttgtatgtgtgtgtgagaaatatttgttaaggatgtcaaagacctaaatttttccttctcttatcttcttacaaattgccctgtggtaaaaagcatgataacaccaggtctttatgactgttactgcccaaactaagtccctgttacagcatatttcttcaccgaagtgggtcttaaactgtggtctccctacaattgatggtcctagaaaccttttcaagatatctagaatctcaaccctatttctataataatactaatgattatttgccttttccactgtgctgacatttgcaccgacagagaaaaaacaatggtgtataaaaatgctggcagcttaataaaattaagtgagtgcctgaaaccgcactcattaccataatgttcttcactggcaggcaattgtggttaaaatgaggaagaagagtcaggggtaagatggccaactagatgcacgtggaaacggtcactcccacacagaaagactgggatttcgactaaatcaacaaaatttgaacagctgttgggagagaaaatgctgaatgtggatggagaaaagatataaatgaggcttaaatgggaggcacctgggaatgtctcacggagtgcctgaatctcagggctggttcctagcccttaatagtccttgaagaaagggtgaatgaaagggctgggggactacttactcttgccatggacctttgatattctagctgcaggcgaccccacatccccatgggcgtttgagctggcagggggattttcccagaaattaaatggaaatggagctgtaggaagcatggagccaggaaacttttagtatgggatagctctggcggagcctagctataagtgcccacccccgcctcttcagggctgcccatctccctctgagaggttctggccccaactagtcactgtgcttgcctccttgcaggactggggaatgcctgtcctgcaggcccccctatccatcagtcccattccgggcttctgcctggccacccgcaggagaatgtacacagtgcagcctctactgctaacgtgggcgcttcgtttctacagagtgcattccattagcctagaagtgtttggggtcacccagtgcacctggaaccccaccctgagggcctggaggaaatagccatgagcagatcttggagcttgagggctgtagcctgtggttcaggagtgccatgacaggatctgtgcctggctctcgatgcggggaagagcagacactcttacaaaatgagagggttaagtggcacaggtccatgggttggtatgggacctgggcgtacctccctccacagggtttgtccagtaagtgtgtgactcatcttcttactggacctctccccaggacagccctctggtcagaaagacctaacaacaacaacaactttgggggcacaatgccagtgtttaaagatggctcccccaaaacccaggagtgggagtattgaggggatcacgtctctcccggtcacagggcagtatatagctacaaaagtgagaatacacaaaaagccatggctgagcaagagcttatttactgcccattgctttcaagtgccatctgcgggatagcagcctaaactacaacaccaaaaagcactcattctcacccctgtgtaggcaagggtaagaattcaataacaaagaccctgtacatagccttagccctctaaaaatttccaaaacaaagccacctgactaaactcaatttacaccacagttaaaggaataccaaacctcccagatgagaaagaatcagggcaagaactctggaaattcaaaaagccagtgtccccttacctccaaaaaagcgcactagctccccagcaatgatctataaccagtctgaaatgtcttaaatggcagacatggaattcagaatctggataacaagaatcctcatcaagatccaggagaaaatagaaagtcaatccaaggaagccaagcagtccagtaaagtgagtcaagagctgaaaaaggaaaaagccattttaagaaaggctcaaactgaactttttgagctgaaaaatttactataagaatgttgtaatacagccaggcatggtggctcatgcctgtaatcccagcattttgggaggctgaggagggtggatcacctgaggtcaggagttcgagaccatcctggccaacatggtgaaaccccatctctactaaaaatacaaaagttagccgggcatggtggtgggcacttgtaatctcagctatttgggaggctgaggcaggagaattgcttgaacccagggggcagatgttgctgtgagccgagatcgagccactgaactccagcctgggcgacagagggagactctgtctaaaagaaataattaaaaataaaaataaaaagaatgttgtaatacaattggaagtatcaacagccaaacagactaagatgaagaaagaaattcagagctcaaagaccagttctttaaatcaactcaatatttttttaattagagaaacgaacgaaacctacaagagatattaatgtggtgtcattgtctggggtaaatacctggggcttgttgtctcgcaccaagaagattaaagacacgaacacgcatgaggagtgggtttaggagaggaggtttaataggcaaaagaaagagaaaggagaattcagctgtctcccttgtgagagagaggggcttccaaaaggaaaacccagcccatggcagactgcattagaatttataggcaggcttcaggaggtggtgtctgatttaagtagggcacaacagattggttccatcaggtgtgttgtttatatagctcatggggtaggctggtcaccccacactaatcttattatgcaaatgggctttccacttggctggtgccatattatctgctctttactgtacacatggttggcaatgagaaggaaacatggagctgtcatttcaaacatgcctttgaacatcccaggtagcctttcctattggcacaactgccagcattcatctgtgcaagcttccagcttgcttgtctatgtctgcagcttgtttttacaggcttctctttgttagaaaagaaaatgatttgggggctgcttttcattaaaatgcgaacctttctgaggactcctgtaccctcactgtctacctaagtaatttcttcttaactcatatatcaatatgggattatatatatagagatcaaatctacaactcactggcattcctgagagaaataaaataagaacaaaataaaataaaaatgttattttcctaagaaaataagcaatttcaaaaatatattttgaggatatagtctgtgaaaatttctctaatcttgctagagtggttagcgtacaaattcaagaaatgcagagaactctgaccagatactatacaagataaccataccaaaggcacatagatatcatattcactagatcaaatagtgatcaaagtcaatgcagaagaaaaaatcttaaaggtagctacagagaaggagcaggtcacttgcactgggaaccccatcaggctaataacagacctcttagcggaaatattacaagccagaagacatagaagagattgagaacctattttcagaatccctaaagaaaagaaattacaacaaaaaattttatcctgccaaactatgcttcacaaataaatgagaaataacatccttttcagacaagcaaatgctaaaggaatagatttcaactagaccagccttataagtccttaagggagtgctaaacatagaatcaaaaggatgacacctgctacaacaaaaacacccttaagcacatagcccacaagcactataaagcaactacataatcaagtctacataatgaccagataacacaacatgatgacaggatcaaaatcacatataccaatactaaccttgaatgtaaataggctaaatgtcccacttaaagacacaaagtagcaggctgaataaaaagataagttactgttatcttcaatagatccatctctcatgtaatgacatccacaggctcaaatttaaagagtggagtaagatctaccatgcaaatagaaaacaaacaaaacaaaataagagtcactaatattatatcaaataaaacagactttaagccaataaaaattaagaaggatactgaagatcattgcataatattaaaggatataatccaacaagaagccttaactctcctaaatatatatgcagtcaacattgcagcactcagattcataaaacaaattcttcttagcctatgaaaagacttagacaaccacacaataatagtgggagactttaacaccacactgaaagtgatagctctttgaggaagaaaactaaaaaagaatctctagagttaaatttgacacttgatcagctagacctaatagacatctacagaatattccacctaacaaccacaggatatgcattcttctaatctgcacacaggacatattctaagattgaccacatgctcagtaacaaagcaaatatcaatgaattttttaaattgagatcacataaaggatacacttggaccacagtgcaaaaaaaatagaaatcaatatcaaaaaaagtcactcaaaactacacaaatacatgaaaactaaacaacttacacctgaaaaactcttgtgtgaacattgaaattaaggcaaaatttttttaaaaaatctttgaaattaatacaaattaggacacaacttatcaaaatttctggatgcagctaaagcagcgtcaagaagaaagtttatagaaataaacaccttcatcaagaagttagaaagatctcaatttaaatatctaactttgcacctagcggaactagaaaaaaaagcttgcagaagaaaataataactaaaattagagaagaacctaatgaaattgagatgcaaacatccatacgaaagatcaatgaaaacaagagtttttaaaaataagattgatagaccacttgctagcttaacaaagaaaaataaaaagatccaaataagcacaatcagagatgacaaagggatattacaactgatcttgcagaaatgcaaaagctcctcagagaggactgtgtaaaactctatgcacaaaaattagaaaatctagaggaagtggataaatttctggaagcacacaatctcccaaggttgaaccaggaagagattaaaccagaaaacagaaagataacaacttctgaaattgaatcagtaataaagagcctaccaaccaaaaaaaaaaaaaaaaaaaaagccctggaccagatggattcacagccaaatgctaccaaatctagaaagaagaactaataccaatcctactgaaaatattgagcaggaggagcaggaggggctcctccctaactcattctgtgaagccagcatcagcctgatatcaaaatgtggcagagatacaaagaaaagcaaacaaaaaaatataaaacaccccaggccaatatccctgatgaacatagacacaaaatcctcaacaaaatattagcaaaccgaatccatcagcacattataaagttaatataccgcaataaagtaggctttattcctgggaggtaaatctggttaaatatatgcaaatcagtatatgtgattcaccatgtaaacagaatttaaagcaaaaaccacaagaccatttcaatagacacagaaaatgcttttgataaaatctaacatcccttaatgaaaaaagtctttaacagattagaaatggaaggaacatacctcaaaataaaataaaaagccatctatgataaacccaaagccaacatcatactgaatgggaaaaagctcaaaacattccccttgagaactggaacaagaaaaagatgactgctctctctcaccactcctgttaaacatagaactgaaaatactatctacagcagtcaggcaagagagaaaaaaaaaaaaaaaagcatccgaataggaagtcaaactatctctcttctctgacaatatgattctatacctagaacatcctaaaatctctgtataaaaagcctcctagaactgataaatgactaataaagtgttaaggtaaaaaataaatatacaaaaatgagtagtatttctatacatcaaaaatatccaggctgaaaatgaaatcaagaacacaaccagatttacaatggccacaaagaaaatgaaatacctaggaatacagctaactaaggaggtaaaaggtctctacaatgagaagtaaaaactgctgctgaaagaaatcagagatgacacaaatgaatggaaaaatattccatgctcatggattggaagaatcagtatcataaaaatggccatactgcccagagcaatttacagattcaacactattcctgtcacactatcaatgtcattcttcaaagaattagaaaaaaaaaacctattttgtaattcatataacagcaaaaagtagcctgaatgccaaagcaaccctaaacaaaaaacaaagcatcacctaacctgatttcaaacaatactctaaacccacagtagccaaaacagattttaaaggtacaaaatcagacacatagaccaatggaacagaatagaaaactcaaaaataaagctgcatgcttaccaccatctgatctttgaccagacaataaaaaacaagcaatggaaaaaggattccctatttaataaatagtgctgggataactggctagccatatgtagaagattgaagctggatccctacctttcaccacaaataaaaattaactcaaaatgtatcaaatatttaaatgtaagtcctcaatttatacaaatttgtaaatttttataacatttataaaaatcctggaagacaacttaggaaatactcttctcaacattggccttggcaaacaatttttggctaactccccaagagcaaatatgacaaaaaccaaaaatagacaagtgggacctaattaaactaaagaacttccgcatagcataagaaactattaacagattaaacagacaaactagagaatgagaaaatatattcacaaactatccatccaccaaaagactaatatccagaatattcaaggaacttaaactaatctgcaagcaaaaaacaaataacctaattaaaaatgggcaaaagacatgaacagacacttctcaaaagaagacatacaaacagtaaacaaaaaaaatgtgctccatgtcactcatcatcagagaaatgcaaatcaaaaccacaatgagataccatctcacaccagtcagaatgactattactaaaaagtcgacaaacaacagatgctggtgagactgtcgagaaaaaagaatgcttatacactatgactgtgggatggaatgtaaagtagttcagccactgcaaaaagcagtttggagatttctcaaagaacttagaaacagaattactatttgacccagcattctcattactgggtatatatccaaaagaaaacaaatatttctaccaaaaggacatatgcaattgcatgttcattactgcactattcacaatagcaaagacatggaatcaacctgggtgcccatcaatggtagatcggatgaagaaaatagatacatctacaccatggaatactatgaagccaaaaaaaaaaaaagagaaataatgttctttacagcaatatagttggagctggaggtcatacactaaagtgaatttatgcaggaacagaaaaccaaataccccatgttctcacttataagtgggagtgaaagattgaacacacatggacataaatatgggaacaatggacactgtggactactagagaggggaaggtaggggtttggaaaactacctgttgggtactatgttcactatctgggtggtagagttcattattcaaatctcagcattatgtaatatttccatgtaacaaagccccatatacaccctatatctaaaataaaagttgaaattttaaaaaatgaagaaggataagtaggagaaagaacaagccaatttaacttaggattgttctcatggaaaaaaaacctaataattaacctcaatccttgaataaatgtgttttcaatattctgtgttacaaaaagacatgtatacctgaagtactgttgatgcatatgtaaaaataatgactcttcagaaaaaaaaaaaaacaaaaaaaacacttgttagagttgtgagctgaatttgccatattttagtggaagaccattttcatttgagaaagtttggaagaacaaactttgattattcacatttgggcatttgacaaacagctgaaaaaaaatgaaatgagactgacgctagagaaaaattgcaatatgtatggccaataataaggttcaagctttcaagagaaaataaatttgggggaaacttatttcaccatgagattgatagtttcctagatagagtctaggaagagtctattgatgagatcggaggtgatattaatgattgcgattttcctatcttgtataatgaattttgtgaaactatggcagatctgaataacttaatgaaccaatatttttcctatgagcaaatcatgatattgcattgcatgaagttaagagaatcaaatggcaaggcaaaatattataaaattgcacatgagcatactatattatgctgagtgaaataactagacacagaaaaatattgcatgatttcacttatatgtggaatgtgcaaaaatattcaaacatacaaagagaacaaaacagtgtttatcaggagcagttggggggtgggatggggagacatagttcagatgatacaaagtagtagatatgaataatctatagatcttacgcacaatatgaagactttggtaaattgcattgtatttgggattcatgctaaatgagtagattttagctgctctttcaccaaaacaaagagagaatggatagctatgtgagatgatgaatatgtgagttcacttgactatagtaacctttctgctatttatatgtaatcccataacaccatgttgtaaaccttaaatatgcacaataaaaacatattttaaaaataagattaaaaatataggcaataaaatatattttaaaaatgatatttaaaaaatgatctgttcattcattcatacatactagaatgtaatgagaatgtaacagaatataaaatattccataatatagtctgagattctaaattgcaaaaaacctttaagaaatttctactagttaagttttggttagtgtcaaagaggatatttgataattatctttaaaagatattaaaatatgtctccttttccaactacatatctatgtgaagccagcttatcctcatatatttcaaccaaaaaacacattaccacatattgccatgcagacacagatatgagaaaccaactaccttccattaagccatatgtttctaaaaattgcaaaaatgttaaacaatgcttttctgaccactactttattttaatttagaaaatagttacttttcataaaaatgattatttattttaccttacaatggatttattcatatatatagtaagttataaatcaatattttaaaataagtattttgtttctaatacaataaatattgatagattgaatcttctgatacaaaagttctgtgtggttctcaaaaaatttcaacagcatgaagaatgccccagaataaaaatcgtgaggaccacagctttagtacatcctcaccacgatagaacctatgaaatttctctatatttggcctgccactgagccagtttccaccagaaaaaaaatctaatgaaacactgcttaattgtcattcttcatgtataaattttgtatcactaaacatgatactttaaatgcaggaaaagtgatatttgaaaagtttatcttctgagttcagtagatactaatatttgatggtaaatgtttatgtctttgatgcagttttgtaagttttttttttaactctgaataagtcatttaatcttgttgtattttagtttccaattataaaaacagcctctactattttttattaaattattatgtcaggagaattaattaacaaataattgttaaatcctttttcatctgtaggttccaaaacaagcctaaaggataacagtaacaaaattctataccaggaaaacatgtgaaaaatgaataatgaaactactaacaggatatggaaaa

SEQ ID NO: 6748 - DNA, 749 bp, mus musculus
gctttaaaaataacaacggtgagttttaaaatgtcacattcaccataaagaactttaaggaagagttagtatgaatgattcttacatcatttaggaaaaaatttaccactgtgaaagtgaggtaagataacatataactaagacaaaggaatatgtcatgaataaattgttcctaatttttctaaaaatattctgtcaccagctgattgcaaacacttttgaggagagccaaagtttcaggaaacaccaagtaaagttagaagaaagtaaatgtactaacagatattacatttcattatcttaatcatactggatggtgcccaagaaagtatgttttctttataatttgttaaagtgaaagtcgtgttcactgaaaattgctcatgatttagctcatcctgagataaatattcttaaaagcaggaaaatattttacacttcccagaggtaagttatagccatatgcattggacacatgtaagaaatgtaaatattatgtaataaaatgtatttcaaaaatgtaggaaactatttctatttctattaaattatgtttaaatattctcgccaatcctatgtcctcctctaaccacaattgtttcttcacatcttcagagctaaactcttgaaaagatgactttcattaccattttcatatcctcacctattatttcttatttccagctttccagtctcatatcttttttaccaatgcactaaattgtctctcacaaatttacctttagtta

SEQ ID NO: 6749 - DNA, 269 bp, mus musculus
gagaagatttatagtggttttatatgaaaataaaatatagcttcagaccagaaagaatcatgggaaatcactagccattcagaaagtcttctgaaggcggtatgttccaatatattacagctttacgggaggttatgccaggacaaagttcacgccatactgtcccatcagagttctaatattgacaagttataaatgtcaatctttgaaaatgtcctgctgatgtacacagatgctcattctctctactttgttgtttacagattttt

SEQ ID NO: 6750 - DNA, 1025 bp, mus musculus
attccagttttggggtgttaagaatattgcatttctttctacctactatattgcatgagtaggtagaaaattcaggtgcttaaaggctattaaaaataaaacaacccttcagaacgctgtctttgcagtaactgttttcttcttctccaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacgggtaggatggtttcatttttaaataattcatttgttttgaagggcaaaaggaggaacacacattctttctctacaggattgtgttgtgtgtgaagtgaaacttaatgatctgtctcaatctggggatttatactcctaaggccaaagtggcagcaagtaactcatgtgtgtttgtgtgtgctgtgcacttacttgatacagtgttaggcagtcacttgtttgtctttgctcttagctcagattgaatgttggttaatcattcctggtgacta

SEQ ID NO: 6751 - DNA, 1404 bp, mus musculus
aattgggcaaaaatatattttcaggaaagaataagtaatagggagggtaaacctagtaataaaaataaatccttcattattcctaaaaccaccttaaaataataaatgagccagtcttggttacaaaagtaattctaaatgtaaattgtttgttttagtctcaactttttgctgtttttagaatgggtttttttttttttcctagaggaagcatttgattatgcaccttaaaaaactcacataagtaaaatattccagattcaactgtatctctgtaactttcagataacactgtatctgccttttccctttatctttgcagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtttgtactttgtattgtctctttgtacagaaaaagttattagaaatgaaatgtgaattcttatattcatgttaaaaccaaggtcccagtaccagacaggtagcctgctagatctagcagaagagatggacacactccatagctacttcatac

SEQ ID NO: 6752 - DNA, 1242 bp, mus musculus
aggttttgtcttccagtatgctttccttcattctcttgactccactttgcctttattctccccataatttccagaatctttgttaggctcctacttagcactccaaacataaaggggatatgtttggccttaaataggaaaaattctgtgatctcagaggcattttccatatggactcttacagaggcagacactggaatgctttcttagaagactccagaatgtttccagagagacacaggcatgcaaattaaaacttcggcaagtgcagggctgatttactgtaggcatttgccagtggctttaccagaatattttgcagtataaattgtaaacttttttttaatagcaagaacacaagtaggacattatgaaccttgttgttatatagacaaggaagtgagaagagaggcagatggataagttttaacgtatgttcatttatgtccaatatgtctgctttcatttcttttattttaaaaactggttagcaaaagtaagagaagagaaaaggttttcaacacaagaagaacacaattctgatgaagaggagaagagtgttatttgaatgacgttttttggagggggcagttctgtagaacgctgtaactggcatcaccagtgtaaagagaggcacttctgcagtcttctcacattgcttattttgaggttggcatgtttaccgtgtttacaatgcaccgtaaaaagacagcacagcatcaccgaatgcaagaaagcattgctcgcatttcccactggtaaaaagtctgcagaaagagattaagagaacaagaccagcaaagaacctagagaagttcaagcaggtgctgacgttttaatgaaacttaaatttccagagctacaagtctcagagaagttagcaaattgtgttatacaaaaagatataaatataaatcatcacctgtcagttccaagaatacaaatgaacaaagagttgatcagcaaggaattctttccccgctatcctccagcctatctcctaataacccacaaacgttaattctttatactcaaattggttgcctaaataactgttttcaaacagctatttgaaattttactacataatttgtttattatgcaaatgtgaataaccccccagtgatactttttgactagcaacaatatagagagtgcacaactttgcatattgtaaattcacataaacatttatatttttaagaatccaatgaattagagaacctgtgggtagatgacatt

SEQ ID NO: 6753 - DNA, 391 bp, mus musculus
tggacatctttgggtaagggtgaggggtgcttattattctgcctatcacaatgtctcctgtgataacttggacatcagaacccatgctaactgaacccactttaggaatgcgttgatttttttcagaatatcagtgcaggatattgttgactgcttcttgtcatttttagcaaagtcctgtaagaacgggctgaatcctagctaaagtcagcctatttaaaagtagaggtagaaggtaattcagttccatttgggtcatttttttctttttcttttttttgggggggggtggggtggggaagggtctagatagttggaaccctacagggttggaaagttaatggcttctctattctggtgactccgaagaagcagccttagctggagacaa

SEQ ID NO: 6754 - DNA, 1216 bp, mus musculus
ctaatcacttgtaaaaattcccgttaatcagattaatgtacccagatccaagcagatgctcagagagcacataacaggagaaaggatgtacgaagtatcacttttcgttgcatgaccctacatgattcttttttattttctgattattgacagtagatgtgagataatatttatactctgcatattgcaagaattttaaaaaatattttactttttatgttttcatccttctgcttttactaagaagttaagttcctgtttatcccaccactcagtccctcttacaaatacagttttgtgtgctggcctattcataaattattaatgtcacactgaaaaataccttttggaaatggaccccctgacataaaactattggtgattgaggagcttcagggcacgtgaagcactcccaacccgactggtgaagaaagctgctgaagctcttcttcctctggtgaaacaattaactttatgttccatttgctgatgacgccgcatgcctaaattgatcatgttttttaaacccatgccagtcttttcagcctgctcagctcaggggaaagtcaggatgtacagtcaggctccagtgcttttgggtagaagtgaaaagatttgcactcattgagcaagaaaatggcattcctggctgtcagtgtggaaggaagggcttttctctccagtgctgcatggcagactctctgctcttgtccctgaatgtcagctcatgcctcattgctaagtaagtgttttccccacctaacctgacaggtaggtgtctgacatgacagcaggctgccatcacactggggagcaaggataccccaaacttggagccagttctgctaagctaagtcagttttgctaaatgttactttgatttcagtgtattattagctttgagatatgccttgagtgccttagagatccagtgtgagaatggttcgctagagctggcttctgtctgatgactggtaaggggtaccacatttttcccactggcattccaaccccttcatctcttcctgccacatcttatccatcaatgggaatcaggttttgccaacagactggttatgaaaggagttgggattccttgaagaagtgagctttgagccccgagagtaggggatatcactttgagaactatgacctgcctgtacattgggggtattggcattttgcatcttcagctggcttctagcaacatacatct

SEQ ID NO: 6755 - DNA, 1769 bp, mus musculus
ttatgtactccctgtttttataaataagattttaaaaacatgaaattcatgatacattaaaaagcttatattaaaaaccaaagatgaaagactagataaaccatactttatgtatcaaaaatagctctctcttccaatatatattttgccatctctaagaaatggccaatcagattatgttgtcaaattagatggaatgtctgtggtggaagataaaatgatgataaataatgattttcattaacaatcataaagcacaaaaatggtttgaacagagaggctttagggtaagaattgaccaaggatcaaagagttgtttttgttttactttaaaatagacatgagagcttagtttaagcttcatgacaatactagggtttgggtaaaacaaagagaacagatttcagttgagcaaggcattacttcctaaatggactaattctgataaatcaccaagacatgtggctgctagattccagacaatgaatttatacaaaaggaaacaaagccccatagacatttttattgtggatgttctcactatgtcagtaccaaactataaaacaaggaaagaagtgagtataattacagcctctctcaacagagcgaggagaattggtttgagaaaagcccattgtaactcgttgcactggggtgttctctcagcaggaccataaatcaggttccagcacaggaaccatatctatgctatgtgtagctttggatctgactcacagatgttaagctggcttatcccatggacaggcaatagaagaatagttgtaagttctgagactagtgttttgggaatttgtcttaactctctacataattctggattgctttggggaacttaattggcttctctgagctgggtttctcattcataaaatatggcggtgtgactgcatgaactgtaaggacctttctaacttgagcatgctttatttctgtttcctctaaaatgctaacttgtatgattttctccaacttcagggaagtattataaaatttaatttcgtttcttttttttttttttttttttttttttgagaccgagtctcactctgtcacccaggctggagtgcagtagcacgatctcagctcactgcaacctctgcctcctgggttcaagagattctcctgcctcagcctcccaagtagctgggactacagacacccgccaccatgcctggctaaatttttgtattttttagtagagacagggtttcaccatgttagccaggatggtctcgatctcctgacctcatgatccgcctcggcctcccaaagtgctaggaatacaggcatgggccactgcgcccggccataaaatttaatttctaacaaatgcaaagggaaaccccaaatgtgcagaacagaagtttgtagcctgttgatttctgatgtgatgaatcatattactgtttctcaaaaattcactttccttccttgaagaacctctttttgtgggggaattatatgtctttgccctgttgtactcaggagtgaactcgctcatatgaacctactttattcagtggaatgtagatggaaatgatgttacttcaaagatgaacgaatattttagatttgtcatgtctcttctgtttgttttgatggccaaagatcatatctgagatagaagatattccatcagcctaagtcctggaatgacaaatatttggaacagttaatggtcatgtattatggacaagaaataaacctttgctttaagcctctgcaattttgggaatcatttgtttctg

SEQ ID NO: 6756 - DNA, 227 bp, mus musculus
cagattgtggaaaataaatgtttgttgtttaagcaacccagtatctgatattctgttacagcagcccaaactaagacagcagttaacgacctctctgtctttgtggagcttatatttaccgttagtaatataatatataaataacaggtcttgtaagtcaaatgatagtaactactgttagaatatttcaaggcagaagcaggacagggaataatgagtttaaaaaa

SEQ ID NO: 6757 - DNA, 147 bp, mus musculus
tgtcttttattccatcccagttcccttctttcttggtccatcagtcaactgttctgtttcataaaccatcatcatctctctcacccttaaggattcttcttatatctataattacattcagaaaatctttatttgaaaaaccttttt

SEQ ID NO: 6758 - DNA, 1134 bp, mus musculus
tgaagtttagcaatttggacttggctcagttcagtggtacttctggtctcatgaaggctcactcatgcatctgcttttagccaccaggtcaatgggtaggtaactaggctggatggctacatctgggaaaattcatctctattctacatatctttcatgtagcagctgtctggcttggaccacgttgatatggcagaattccaagagaaaaagcaaaggtgagcaaagccacttgaggcctaggcttagaagtggtaaacctttacttccttcactttgtgttggtcacagaaagtcactaactagctgggccggatccaaggagtggagaaatagattccactgcttaaagaaaggaagtccaaaatctcattgcaaagggtgtagtacaggaagatgtggacaattgaggttgtttttataatcaatctaccacaaaaaaagggacaataatgaagaaccccgcttcatagccagtggggacatagtgaaacaatgcccagaaataaggtcaagagtgactttgggtgatttattgtccttaatagatctatttctgattatgctgtacacacttgagcaatggttctgaacacaagaatttatctaacattcaagtttagtggggtcatcccaaatcaaatgaacaaggatccattaggcctgggaactaatgggcacagccaggtgccagcaagccaggcgttcagggagccgggcaatccgttagaagagggaggggatggctttgtacaagtcaggaggagcagggatgggaaatggaatgacctaagtggaccaacagtccaacctctctccatagctatgacttaatgatttgataaatgaaaaaatgtacgctagctggcaggtcactaacatcaccattgtgtgtttacctttaaaccacaagagtcagagaggagattccttatgctgtttgcaaatggaaactaatgatttttgttctcacacatgaacttgcaagcagggactgcatcattgctttgcaaattttaagctgactgatcaagtagctcagcaggagttcctggcatagcatatgcctgtttccagcctctcccttgtatgtttctgctatggtgatttgaggtcatttatattattaaaaat

SEQ ID NO: 6759 - DNA, 1000 bp, mus musculus
aagcaggatcctgactgatgtgagcatctgtgccggtgcccgggagatcccctgccaccgcaacgtgctggcctccagcagcccctacttcagggctatgttctgcagcagcttccgggagaagagtgaagccaaagtgcagctgaaaggcattgaccccccaaccctggaccagatcgtctcctacgtgtatacgggggaggcacatattgccactgacaatgtcctccccgtgatggaggccgcctccatgctacagttccccaagctgtttgaggcctgctcctcgtacttgcagagccagttggcccccagcaactgcctgggtatgatcagactctcagaaatcttaagctgcgagaccctcaagaagaaagccagggaggtggcactgacgtccttcccagaggtggccgcatcggccgacctgaaggagctctgtgccttggagttgagggactatctcggagatgatgggctctgtggggaggaggaaaaggtgtttgaggccctcatggtttggatcaagcatgacctccaggcccggaagcgatacatgcaggaactgttcaagcaggtcaggctgcagtacatccacccagccttctttcaccacttcatcgccaacgatgccctcctgcagtcctcgcctgcatgccagatcatcttggagaccgccaagagacagatgttctctttgtgtggcaccaccgtcccagactgcaaactcctgttgcatgtccctccaagaaactcttaccaagatttcctcatcctcttgggcggaaggaaggacagccagcagaccaccagggacgtcctactgtacagcaaacagaccggccaatggcagagccttgccaaactcccgacacggctgtacaaggcctctgccatcaccttgcaccgcagcatctatgtgctggggggcatggctgtcagctcagggaggagtctggtcagtcacaatgtctacatcttctccctgaaactcaatcag

SEQ ID NO: 6760 - DNA, 3176 bp, mus musculus
gctcttgacccaaaggcagtgtcttattcatcattgccctggatttcccacaggacaaccacagtgctaggcatctaataggcactcattaaatgtttgttaaattacgataacaactgttgtgagttctccaaggaaacactctgtgactaaggctgtaggtgggataacaattgtagacactgaaatgcattccctctggcaggaggcagagcatgggggagggtggtggtggatttgtattgatataatctgcccttgtatctggatcctgtgtagcagttcatggtaagggcattattcctggaagagggacgagggctaggggaagagttacagaacttttttttttgagacagcgtcacccaggttggagtgcaatggtgcgatctcagcttactgcaacctccgcctcccaagttcaaacagttttcctgcctcagccttctgagtagctgggactacaggcacgtgccaccaagcctggctaatttttgtatttttagtagagacggggttttgccatgttggccaggctggtcttgacctcctggcctcaagcaaaccacctaccttggcttcccaaagtgctgggattacaggtgtgagccactgcacctgctcagagtttcacatctttttgctttgtaatatgatctgtcttttgcatctctaaaataattctgatgttaattgaattgtaaagaaaattcccaaactttatcctagataattgtagggcatcaccccctactcctgaagcttatttcccagagctgttggcattgaatgctttaagttttaccaaatcatcctttctctgctttgggaacatcctagtcagggctaaatgtttaaggaacaagcacagggaaagaggggaaggaaaggcatggaggagatttgtaatggggtaatttctcaaaaggttgactgtagcttttctgtttggctctaatctcctgatgggtggcagttttgtctgtttctttttgtatatttatttataccagctcagtattttgttcaataaacgtttgtggtgtgaacctaggaatgaattacacatgtctactacatgctgggtgctggggtgataagggtaaaccaactcaagccctaatgaaactttttgtctaataatgaaagtgaacagtaatggaaaaaaatcacataaataaaattacaaactatgatgagtgatgaaaggaaaaagctctgggaacctggagagcttagatagaaccagggtacctggttagtctggtggggaaagcacagaggtcagggaagacttttctgagaatgtgatgttaagtggcccatgaaggatgggacagtgttaaccagagaaagaggtatgtgaggggcatttggattccagcagagaggagcacgtgcaaagatctggagggagggagcatgttccagtcgagtcactgaaggaaggtggtgtggccagagcaaaccacagggatgcagtaggagaggaagcagagagatttgagtacagggtggtccatttggtattttcctgtgctgtgccatcaataatccttattactggatgtctactgtgtagccagatgacttctgttgatatgtgtactgtatctggatcacacacagcaggatcatggtaaggatacaattctgcagaaaaataaaaggagaaataaacttaaattctgggaagaggggtttgaactttagaaagctttggactccgtggagttattgaactctgataagagttgccatgagatcttgtttttgtgaagaatttaaagaacagagcagacgagggaaggaggcttggctaccttgaaagggtactggattaggggttccagctcttgcagtgccatgatcagctgtgtaccctcggaccacctcatcttttaaataatcacttcccccagtggtaacatgtgaggttggaattcaacaactctgaccatctttgattccgagtggaatcaactctatcatgatggaaaattgagggagggatgcgctagggaacccactctgtctgtgaacccctgagcccaggccccttcctttgcatgtctttttatgatacatagggagtggaggattgcagctcagttggggatgtttacgaggctgccttgggagctactatttaactgcttagtctgtacctgcagaaccttctccccaacccctccccacacttcatgctgcctccttcctcagtgctctgcactttagaggctcctacaccattgccagcccacaggggtggcctctcagccctcaccgccaggtcctcttcttgtcccagcaccatacctaaaacacaaaggtgcacaatggagagggcccagcatttccttttccatgacaccataaagacgtgctagaggaatggacaaggggcagtgtattcctttcctgggactgccttggccatgtgccacaaacatggctgcttcaaacagcatcatcctctcacagttctggaggccagaagtctgaagtcaaaaatgttggcaggatcatgaagacgatgggggagaatccttccttggctcttccagcttctggtggctcctttgttccttgtcttgtgactgcatcactctaatctctgcctccatctccacagtgtcttcctctctgtgtcttctccttttatgtatcttaaaaggtcacttgtcattggatttagggtccactgggtaatccaggagagtgtcttctcaagatccttaattatatctgcaaagattctttttgtaaataatgggacactcacaggtttcaacatgtggatatatctttaggggaaccactattcaattcactacaggtggtttcagaggtatttgacccatccaaatgacttattttattcatttttctccctgacaaacttgacctttttgaaatagcctcagaatacaggtcccaaagatatgccatagagtggaggcagcaggctggagggctggagagcacaggcttctgggccaggtggcctcagttcaaatcccagcacgtaccaatctctctgtggctcagttttgccatctgtacattgagtacaataacaatactgcctttgaagactgttgtggagcttgtataggataacacttgtaaaggtagctagaacttaccaaaagtaaagtgctcaataaatgtta

SEQ ID NO: 6761 - DNA, 1431 bp, mus musculus
cctcacgcgcttgttgagatgacagatgagtcacctctgggaaactgcctgagagctggatgacaccactctgtgggattgcatttcatccacagagacatctggaaaaggaggcagagcagagcctgacttttgattatttggggagggagcctggagctggtggaagtgagggcatagagcacattcctttcaggccaggcagtgcttggctgctgaggcaccggtggagacctcatgatctggtggtccgcctccctcttgtgctgtgtgtgcctggagctctctggcttccttggctttccactgtctttcccaaagcctccatgtattctagaatctgctatggagtttcagggggatctctgtatagtgtgaatatctagctctgaaacacaaaagagaaagctacaaagggcaacgtaacaaaagccgtattcccacccaaggattagcacatgctcatgaggtggcatgctttgctttggatcattgtctttattttattttattttgtttatttatttatttattatttattttttgagatgcagtctcgctctgttgcccaggctggaatgcagtggtgcaatctcagctcactgcagcctctgcctcccaggttcaagcgattctcctgcctcagcctcctgagtagctgggactgcaggcgcgtaccaccacacctggctaattttttatatatttagtagagatggggtttcactgtgttagccaggatggtcttgatcttctgacctcatgatccccccacctcggcctcccaaagtgctgggattacaggcatgagccaccacacccagcctggatcattgtctttaaagaaatttaaaaaaaaaaatagataaatgggaagtctatgagccttgtctcccattccccatccttctcttcatacaagtacctctcctgaacttggggtataacaggtcatgctcttacaatttcattacaaatctatttgaagatcactggtagcaccattttgtgtgtttttaaattcttaggtaggtgacataacgtataagatgtctgcactttcctcttttctcccggcgctatgctgggcagatgatgctactatgcttgttcattcattccctgggccacagagtcttgggttgtttccagaattttgcttttgtaaacaatgctgtcatgagcatcctagcacagggctgcaggtgcatgtctgggtgtgtcccaggagtacagggcacagagcatgcacatttgcagcctgactggaggttgccacatcactctccagttggcactatttcctaggttccttccctgagagcctgggaacttctggaaggcaggagtgggtggtgttcaccactatatacctctgccagtcagcatgccccacaccatgtaccagctcatgacacgcctgaatggggt

SEQ ID NO: 6762 - DNA, 693 bp, mus musculus
taaaaatcaaatgttatgccctctatgaagctttctctgaatgtcccaggtaaaaacaaactctatctctgtatgaaatctttttatactttatacctctaccatgaaatattttataatgtggttgtttgaatagagccagacacatagttggcccttaccaagtatcttttcttttgaaaggaagaataaagaaatgaaggaaagattcagaggtatcttttcttctccctgaataattttgtgaaacggcaaccagataacacatgcatggtctgtgaccatcagaatcctgagcataaattgcagtttacctccacgaggcttgtgtgttctgtgccatttttcccccttcctttttggagaatgatgaatcagactcatcatggtattcaattaatttcacacagctgactcctgagggagtttgtatccaatgccctctaaccgatgatcaatcatgctcttgtggttggcacccaaggcagcgggaagcaggcccatgacgtgatccaggttgtcgaagagaatgtgtcctcatccaagcaggaaaggttttggtgacctttgatggcatttgagataagtcatttgctctggcttttctgaggccatattgatcttgcccaggattcaattttagacaaacaggcgacataatttatgtaaactgggcaggtaattaaactcttc

SEQ ID NO: 6763 - DNA, 328 bp, mus musculus
cagcttgaaaaaaaaagttctgggggtatcctttgagcccttgactgagccatgtctgaggcccctgaattctacactggacttgagtgcaagttaataaatcccctttctggttccagcctggcggagctgagttttctttcacttgcaagtataagagtttaaagtgatcaaactgtcttaaagggttgtattgaggatgaaattaataatgatcaacagcactaatccagaggaggtgctcactaaatagaagcaattattgcaatttcattttcagcttcctttaaatactatactctttccatgataacgattgcagtggtct

SEQ ID NO: 6764 - DNA, 370 bp, mus musculus
cataaatagacctttacacaatccttcacatactggccctaccaacatctctaacctcttctaagtaacatttatgaaacaatcccacattctcaggcacactcctgagaatattataaaatctagctcaggaaccatatgagcacaagggtggtccccagaacttgttataaaacttgtccaaccctcctggaaaaagattattggagtacttactcaaattgatctaataatagtgctttttttaaaaagaaattggattggaatccattattcttgcctcatcctgtctcttaaagagagacaatgtaagctagggagtcatttgtagtcctgacgactgagaagcaggtaaatcagcctgcagtga

SEQ ID NO: 6765 - DNA, 1102 bp, mus musculus
cgctttatcaccagaaaaagatcctgtaaagtattgctgactttaaaagcaaggcaggaggagacactagatgtgcttgcattgcaatagaaacccaatatccagtaactacagaattcaagaaccacgcctttgtggaaacctaaggtctggaaattttcatgtcacctttttttgttcctatttcttgacacccatcaaggaaagcccagctcttgttgatttcacagtcatcatccagcctcagcagggtcccttcaagatgtgtactctcccttcaccatgcacagggccagaagctgcctgtggtcccacctgtggacctgcctgtggatggctacttgctcccaggagaagctccgatggggtgctgccttcctagaggatggaggtgcgagagggcaccttgagagaagggctgagtgcctcgaaggacctgagcaggactcagcttgaacatgaaaggccctgaggaagtggagggttcagagaggctggggaaagccaggtatgcaacgtggtccaaatctcctgttccctgagtctggaagcagctccacctgacacttgtgccctgagagcacggtcagtttcattccaacaaactaaacccaggttgtggtgactgaaatgggggacagaaacaaaatacatctaacagaggtggttttggaaattgcctttgagccccaaagcctctcctccaaatgctgttcctctgatcttgtcctatacctgacctcagcctctcgcacccaccatcatcctgtagaacttcactcccccatgatcttaatgtcatgcattctggcatctgaccaccgtccggttcattcctacctgtgccccaaccgcagcggtgctctggcaataggaactcttgtgtttaaagccattccccacccgattaatgtcctctcctccctcctttccccagggaaattccacaatcactataatcccttttgcataattttaagtctccttttctctctctctctctctctctctctctctctctccccccccccccccaattgtattcacttggaaaaactctaactctagtaaaattcagctgccattctattcctccccagca

SEQ ID NO: 6766 - DNA, 952 bp, mus musculus
gttacatgttgagagaggatggatggaaaagggagatttttcactgtacccatttttatacactttgattctgaaccatgttaatatattacttattcaaaattaattagactatatgattaaggttaaaatgcagcactcaatttatatcttctattataattattaatattaaaattgatattaatattagatatcctgagctctagccagactctgacacaagctagcagttttgattctggcaaattctaattactctctactttcctaattcataaaatgttcatttatgaggatgcttcctcctttaacatcatagtgacaaagaacaaacggtcatttgaagaacagtatggcataagctgggacttttaaaattatctccatttctctcatataatgtatattctctcatatcacaatagtaatgtgaagtatttctttttctccatttcagagatgagaaatttgcaatgtagagcacttcagcagtttgctcatagtcacaagtcccagtggtgttacgaccgggacatgcacctgtgtcccctgtgattccaaagcttgcggtattaccactatctgagaaatgctttctatcttaaaagtatctgatgaataagaggccggcactgagttgaagataagggccacagttgtaggctttgttcttttgttagtcctgctcaaattagaagactgaaaatggtcaggataagtgagacctgctaggtctctgtgccactttattggttatgccaatttgttgaccagggcaatagagctcacatttgccgttgaatagcatatggatttagtttttctttcttgaatcaagtagctcctactgctgtattccttgggtctggaagtcatttcatattggtccaatgtttgccattacattcttggaatcttgtttatagggctacaatggattagctagaaa

SEQ ID NO: 6767 - DNA, 1299 bp, mus musculus
tgttcatcatgggttcaagttcctgccaactatctgatggctcttggaccctgcattctgtttcttcatctgtaaaatttaggttcttgtgaggattaactttaaaagaaacacataagcaattaactcctgaaatgaaccagctgtggggccttaaataagttacgtaaggttcccaggtcttcgctttgtaaagtagtgtggaatcattaggtgtgcagctctatcaatctcctatcattacaggattgcagtgtgactaggaggttagttgttgtgtacttgggtaaattacttagtttctctgtctctttgttttcttatctaaataggaggatgataagaccttatagagttgtgagaattaaataagattttcaagtaaaggatttactacaatgcctggcatacagtgagcactgaatacatgcttgcaatgatgatgatgatgatgtgatgatagaatcaacaggaacgtaaaaggaatccaattccatttattcctgttgcctcttcaatacaaacatgatacagcacccacttgcaggtgcaactgtgaaggccaagaactgtggcagctgccaagaaaaggagatggcctcttgccaggtgcagagctgctagcatggctgtcaggaagtgacagagcatttgctgagaagtcaacatttgctgacagctcacacatcaaagcatttttccacagctttcagtactgttaccatatgcgagtgttcatgggaacagccatgcctggataaaccagataaactgaggaatcaaaaggcatattcagaccaagactaaagagaaccttcttcacctcctccatacttcttcaataagaccactcaggacaccttaactgccttgctgcctttctgggtaagtcactgagaaccttgttcaaccttatctgtccatgtctatagctgctatgctgactcaggccacttgccaaacacttatcatgccaatacaatgtcaatgaccatttcaacaccctcagcagcttcccattgctcaggaatggtgacaaatgagattgggaacaccgaagtaaaaaagctaaaatatcataatgatgaaattttgaccaaaagacacagagatatttttgtaagtgtctatatgatctgctattcctcttcccatatctgctaacattccaaatgcatttactatcctgctccccattaatgaatctgttccaaccaccctggcctccttaccctttccctagcaagccaagcatattcctgcctcacaaacttttcacctggtcttattgcctaaaat

SEQ ID NO: 6768 - DNA, 554 bp, mus musculus
tgttttgacctcactctaggaggaaacttttttttttttttttttttttgacggaatattgctctgtcgcccaggctggagtacagtagcatgatctgggctccctacaacttccgcctcccaggttcaagtgattctccccactcagccgcctcagtatctgggattacaggcactcaccaacacacccggctaatttttgtatttttagtagagatagggtttcgccatgttggccaggctggtctcgaactcctgacctcaagtgatctgcccgcctcagcctcccaaagtgttggaattacaggagtgagccactgcgcctagccgggagaaagtttttaagtgaagatccaagatattccaaaagcaaagcagcatattagtaattttcatggcaataaatatgatacactagctcatcaaaatatataaagagggagaaaacataagtgcacactatgagaggttggtgtttcaactgtaacacaaaaaatgtctatacctaaaatgtataaataatggcttcaattccacaaaatgtcaaccacgca

SEQ ID NO: 6769 - DNA, 1179 bp, mus musculus
gatacaattaaaattgtgataaatgctaaaactaagatgagcccttaagaatgttaaggatgaaagtagttaaccaagtttaagcaacaaatccacggtgccataaattttattggaccttagatttaaaggatacttaggagagaatgtgataaaagagaagtagagggaaaatagttgggggatgtagccacatcctaggtggtatgtttaagaaaatacaagtaatcagctaaccaaagctggcctctgtgaaagggatgtgaggaataacagtgctgagaaattatactgcaaaacatgctggaggctcaggcacagaggtgatattaccacaaaatgtgaccaatgtggattttaaactgattcaggaggcactaaaatttttgagtgagagagttgagttggcatcaaatataaggcctgtagcccaaaagaagatgtgcattaataaaaaacaaggcagtcttaacatagtacattagatatcttaacacactcaagtatgcttattgtaaagtaggtattttgttgtaattggcatgactccctaaaatctggtgcctttatctggtgtctctagggagttaactggctactaaattgattcttcagatatctgttcaggtgtgccagtaatgaggtcattatagtaaaatggttaatgccagtgataattaatttttttttgcttgaattatctcctaagaataccagagaaagcaaagaaatttagagtaaaagctctctgccttatattgaaagtcacaaatgtaattttgtggtcttacctcaatgaatgcctgttgcagaaagttatccaagtagctgttagctaagaaaaaaacaaaatgtcattctgttatgattagtggatttattcaatagcctttataaaaagatgcaattgtcactattctaccacacacaaaggtattgcaactctgagattactcctcccaccaacactttatgggattatttcattctcttatggtagttatcatttccactgtaatttagcaccaaattgatgcaacttctctcactaagctgtagggttggaagaacacaatcatgcctctacaacttcttgagaaggagtactgctgggatgggtcgtctgcagaaaaagatgctgacaggcattaaggtggcagattctagaaggaggattgt

SEQ ID NO: 6770 - DNA, 1510 bp, mus musculus
tctcctgttttcttgatttgtctcttttcctacttcctcccactcacatggaagtgccacgcaggcaggggcttggcctgtgtccaccacccatccctagcacacagatcagtgtatggcatacagtaggtgctcaagaaatatgtgtgaccagatatgcgttggttctgtttattttgtatatttctaacgtccctctagacatgcagcctttagtggtgttgggaaggccaggggtccaatctcatggtggctcagggttgacagatatctgtgagttcctgtccctgagtgaggccctctggggtgagcctttggccatctcctggtgggccaagagtggtgacacccgggacgtttgttgcagggcacagaggggcatctgatcctgcctgggcaggaagtacagaggggaagccatgggggagctgtgactgtcccttctaggcagccatgagtgacccgtcaagaggcagcctgacctggaagcctttggtgacctagaagggggagtgccctcactgcagtggcaggacaggaatgagctggcctgggtgaagtgtgcatagtccaagtcgaggcccatgtgagtccatgtgtggaggtgaatccactcttccagtcttccagcgatgtatttttttttttttttttttaagacagagtttcgctcctgttgcctaggctagagtgcagcggcactatctcggctcactacaacctccacctcccaggttcaagcgattctcctggctcagcctcccgagtagctgggattacaggtgcctgccaccatgcctggctaatttttgtatttttagtagagaatgggtttcaccatgttggccaggctggtcttgaactccctgacctcaggtgatccacccacctcggcctcccaaagtgctgggattacaggcgtgagccaccgcgtccagccccagtgatgtactttaatgaccacccgcccctcaaattattgatcggtatttgtgtctgtgaagtgttcatttacctggtgggctgtgtgctggtgagcggccgtggccagtgctgctggggctgagctagcttcggtctgcctccttccagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcaggtacgtgagagaacattcccagtgtccatgaggaggtaaccagccagccatccattctatggggatcgtgcaccccgccccagagggcaggccattagtaccatttgcctggcaaacatgagtggtccccgccccctgccaaagcttttcttgtgactgtaacaatcagcagttacagggagtttgttcttttgattctgaccttgcctgtgccttcctaacaccctctcctgctggtgactgccttcctaacagcttctcc

SEQ ID NO: 6771 - DNA, 3397 bp, mus musculus
gcggactcgggagatggaggaaaaggagatattacggcggcagatccgcctactgcagggtaggtccggccggggccgggacgcgagtccccttctttccccctcacctcgcggcgggtcccctgcccccttgtcgaaggggtcgctcaccgcccgcgtgttctgggtggcggctggggtgggggacggtagggtccgccaggacttgtgggccggctcagggcccgggtcagtccccggctccagctttgtcgagggagtggtgccggccctgctggggctgcagagggtggaggcagggccgtcgcttagtaacccgcggggggcggcggccctccccaccaccgcgggctgtcgcgtcccccggcgcccactctctccccgcgccccactgcggggctgggactagttcatggctcatttcggcagagcaggctaagggcgcacgcgggttccttccttgacgcccggttttttttgagacagagtcttgctctgtcacccaggctggggtgcggtgacgcgatcacggctcactgcaatctcctcatcctgggttcgagtgattctcctgcctcagcctccggagtacgtgggattacaggtaggcgccagaacgcctggctaatttttgtattttgagtagagacggggtttcaccatgttggccaggatggtctctaactcccgacctcaggtgattcacccgcctcggcctcccaaagtgctgggattacaggcatgagccaccgctcccagcctcgacgcccggttttgatgccccttttctccgaacagtcacactccccttgccattccaggcgcagactgaacaggcttcagcttccacacttaaacattaaaaaacccaaattggtctttctaaacttaaaaagaaaatccatgttcggacgcagtggcccacacctgtaatcccagcactttgggaggctatggcaggaggatggcttgagcccgggagtttgagaccatcctgggcaacatgacgagagcccgtctctacagaaaaattttaaaaagtgagatgggcgtggtggcttgcgcctgtagtcccagctactcagaggtggaaggtttgcttgtgccctggaggtcccggctgcagtgagccgtgattgggccactgcactccagcctgggcaacagagaaaaaccacatctcaaataaaaagccaaaaccaaccaaacaaaaaaaagctttaaaaattaaaaatcctttttgcttttactctcacaaagggaagacttaaggattgggaaagtgtgtatggataagaggccaggtgggctgcctcccacttggggacacttcttgagctcccatcacacctgctctggggcgtcaacacgtctggacgtggctttctgtgcccccgggggcagggcctgtggtgggggaatgctgataactgggaggctggctgctgccgcccttgcctgtgttcctggccctcctgcaccggggtagctatccagggacttatttggaaagtcctgtggttgtgtcagttcactgcagtaggactctagcccattgatgtttcctcttctgcagggaagactatgaatctggcagagcaatggcctctgctcctagtattcttttttcctgttgtcaggcatggggtcctcgagagtgtcagttctgttacactcagtggagtgactcctttccatctgtaggcaagccagagggcctgtgcggccacttgtcccctctgattcaaacagtgcagaggggatcattgcgattctcttcagactgagtgacacgtctcagcaaatgactgtggactcagtagaccagcaaataaggcttgttacaccacacggttcatttctgtgtgaagcaggcagaagtaggactgaagtggagctgatggagaaaaggctcatagaagcgacaggcccaggtgacgcgggctgagttgtcagtgagtcccaggctctgggggctgcccctcctgaaactggcaggggctcagaagtgagatgggatctgggggtatcttgccagctgatgcccttccagggtagtcatgattatcgcggttaccctctggctaactgggcctgtggttctgtcttctcaggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggaaaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagc

SEQ ID NO: 6772 - DNA, 743 bp, mus musculus
aagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatata

SEQ ID NO: 6773 - DNA, 1096 bp, mus musculus
gttttaactccagaatctctaccaggctttcaaagtgaagatcagggaaagatcccctgctgattctggcagtgggagcagaaaagtaactagtttgaaatactccggagcattctgttcttatgagcatgggctgccttcaggagaagctattttatcagagccttatatattggggttttatcaggtcccaactgatataagagaagaaaaatacctgattccagcttcctctagctattctgtcccaaggagacagattgtggacacttgtgaagagacacttgtgaagtccacagtccaggggcacaaactcactaaaagacagagattatagaattataattataggactgttatttgtcttcccctaacatcttaccaccacatgctaaaggcctatttactataatttcttttacctagtacattatatctgtctatcaagaaaaggttacaaggtggccgggcatggtgtcttgcacctgtaatcccagcactttgggaggctgagacgggtggattgcttgagctcaagagttcgagaccaacctgggcaacatggagaaactcaaactctacaaaaaaatacaaaaaattagccaggcatggtggtgcttacctgtaatcccagatacaggaggctgaggtgggaggatcacctgagcctaggaggcagagattgcagtgatctgagattgagccactgtatgagaaaaagttacaaccaaaaggcaggaaaacacagattgaagcaattgaataacatcagatccagagtcaaatgtggcacgaatttggaattattagaccaggaattttttaaaactttgaataacatgctaagggccctaaagaacaacattaagacaatatgcaagaacagttaggtgatgtaagcagagagattgaaattctaagaaagaatcaaaacatcattgtagagctcaaaaacactgtatcagacatgaaaatgcatttgattcactcactagtagactgagaatggttgaagaatctctcagcttgaagatgtgccaatagaaacttccaaaactgaaaggactgaaaaactgaaagactgaaaaaaaaatac

SEQ ID NO: 6774 - DNA, 1096 bp, mus musculus; identical to SEQ ID NO: 6773

SEQ ID NO: 6775 - DNA, 473 bp, mus musculus
ctgaggggaaagcagagggaatagaaggtactaaagccctagagttgatagcatgtttggcgtttagtggagatgcaaagaggcaagtgtaaccagagcagagcgagtgaagagaaatgtggtaacaggcaagagtcagagaggtaaggaggaaggaagccagatcatgtagatctttaagaattggagtttttacactgagttaggtgagaagccattgaagggttttaagcagggaagggacatgatttgatttatgttttaaagcaatcactctgttgggtggagataaatgtaataggacaaagatgaaagcagggaaaccagtatactatagcagtaatccaggagaaaaatggtagaggcttggactaggatagtagcagtgcagataccaaggagtggctggattctggatataccttgaaagtaggattggtagaatttgcttaaggattggatatgtggagtat

SEQ ID NO: 6776 - DNA, 577 bp, mus musculus
ggaaataaatgcaatcagattaatagacgttgtcattggtaggacttcgggtgagttttttcttcttcctacttttctgtattttccagttttctattctaaagttatattaatgtaataatttggagaaaagctctagttttcttttcttttcttttttttgagacagagttttgctcttgtcacccaggctgcagtgcaatggcacaatctcggctcactgcaacttctgcctcccaaattcaaggaattctcctgcctcagcctcctgagtaactagaattacaggtgtgcaccaccacgtctggctaatttttgtatttgtagtagagatggggtttcaccatattggtcaggctggccttgaactcctgacctcaggtgatccactcacctcagcctcccaaagtgctgggattacaggcgtgagccaccatgcctggccgaaattgcaagaacctttaaggtgatcccccacaaactggagctaggattaaggtggttcctcaggcctttgttctgcctacaatgttcatgagagttgctttctaggtttgattgctgctcaaacattcaa

SEQ ID NO: 6777 - DNA, 797 bp, mus musculus
tcatgtgtgtatttgagtccccagctggatctgaatccttggagagaaatgtctccgagagggctgggtcttttttgtctctgttttctcagtgctgagctcagtccctggcccagaggacacactcagagggaaggagaaggcaggaatgcagagaatctcttaccagtgggttagaactgctgctcttgtgcccacattgccttcctggtccctcccctgcaggcccttttgggtgtggtcaaccccgcagtgtcaaccctgtttctagttattggcgtttgttatgcttcctcacttcaaaggaaccagaaaaataatttccaaaaacagctgcctttgtactttctaggccttttaaggtttttgcatgccagaatctcacctatttctaatatcataaagatgtggctgctttggaaaatatacctctgaggcttaatgctataataacttccagaataataaaacaacctccgtctctgggacctcagtaccttaaccaagcatcgtgtccactttgggctcatcattggagggaaagtacgtactaacaaagcagcggaccaggcactgtggctcacacctgtaatcccagcactttgggaggctgaagcaggaggaccttttgagggcaggagttcaagaccagccttgccaacatagtgagaccttgtctctataaaaagcaacaaccacaaaaaactagatggccttcaggaattcaccaaataagttttagtgcttttatttttgtgaaaataacagacctatcttttagaaaataggtatagctg

SEQ ID NO: 6778 - DNA, 797 bp, mus musculus; identical to SEQ ID NO: 6777

SEQ ID NO: 6779 - DNA, 689 bp, mus musculus
aaaagagactttgcacatgtgattaaggttgaggactttcagataaggacattatcctgaattatgcagatgggcctaatttaatcacttaagtcattaaaggaaaagaacgtttccctgctatggccagagatgtgatgaagaaagaaaggccagagagaggcaacgttgttggctttgaagatggaagaaaggggccatgagccaaggaacatgggcagacccaacaagctgagaatggtaaagcagaattctcaagagcctccagttcagagtgcagccttgccaacagtttgatttcagtccatcaagacttctgtcagacatctgacctacagaactgtaagataatacatttatattgttttaagccaccaagtttgtgctaatttgtttcagtagcaacagaaaactaaaacaacaagtaagagaggctacctataagagctgtgggcccacataaggaaatgccgccactgcccagctatattccagcagttagggagggaaataaatgctctgacctctcttttttcccctgccctggcagtgtttcccattagctgaacccattagccaaaagctatagggcaaaacagcctagatgatgcaattcctaaagtttagtcctctagagtacagagcagggtagaaaagggcagagatggatttataggggcaaataaaaa

SEQ ID NO: 6780 - DNA, 215 bp, mus musculus
ctttcaagtgtggactattccattctgatccaaggtgtacctctctttcatcttggggtaaatcccagtgaattgaaaagaaagacagccacatcagatctaggccaggctccctcaagaagcagtcattcaaagctcactttcaggtccaaggttgtgactttcctggcttttgccctgtagtgttgcctttctgtgtcttgcaaaatggctta

SEQ ID NO: 6781 - DNA, 604 bp, mus musculus
agatgaccataacatggattcaaaatatggtatattagagtgacttcctaaaattctgatgaatttttcacaggattcctttaaataataagcatccttaatgcattcaaaacatgatctacaattccaacagactttccagaacttaattctctgcatgatggaagtaaaggcaactccaaggtcaacaagccacatcccctcctcagccttttctgtctttcctctcctatttcctccttctcctacccctgctagatactgggattacaaagaaaagctccttgctcctgctcaatgtcccagtcacttactttagtttacccttcatgatcccttcctactccttccatcctgctctataactccctcttctccccaccccggcaccacccactgtacccaaccaccttccttaccagggagaagacaagaagggtttaatgccagaatcaaactatgtacaatgaacctctgaggaggaagacaggggtgattgctgggctgagcctgctgtttccttgccattctttctccaggtcctcagatgccatatcatcgtgggtgtgctgccgggtgggcatcccacctccagcccacagtg

SEQ ID NO: 6782 - DNA, 1209 bp, mus musculus
tagagagatgttctttgatagtaacagaatccataaaatacttttaaaaaaaataatgaaggcatttgttaggcataggctgtttcatcagaatatacctagtttattttacaatggtaaaattgccaagacttagagagcattctgattgaatcatgaatattccaaaggggtagattaatctgtgtgaactagagaactctgctgaaactgctgtttaacattctaaagtgtggaattcatcttcttacagcacaaaagagcttcctataataaagattttttataacagcaataaggcagctcagtggggtgtggttttcatgaaataatcacacttctgagagattagacattgtgccttatgctgtacaatcccctcaagtattatgatgacatgttgatgccacctcccccacacagctctattcctcagttactcagtgggcccttccaaaaatatctgcccacttagagctatattataaacaagctggggatctataatactgtattagtgctttatcacatcacagttttctttatgtttctcataagtagaaattcttatacctttccattgtagttcagatttaaaacacacaaaccaaaaatatagttacagtaagaaaaagtcatagtttagtaatatggactgtatacttgttgcagtttagctaataattatgcaagtcatccattattaatctgcattgttttttaaatgaggcatccattaagagttctggcataaatttgaatattgtactgtaaaattaaccaagaatatatgttaacattaaaatatattccttcaaattttcaaaaattattacatggggaatatgtcacttttattcgcagttcacttcaaactgtaaacaacatctattgatattttcagtgatctcctaatgctaatagtttgaagactgataatagggtgtatctgttgtttctcattggcaaagataattgtattcttttgcatatttcatctgttttcgtgtttagacagaatattaagaaaatatatggtagggacctataaatgccagttataagtagggtttttgatttattaagcacttttctagaactatgccaaaatattaagctttgtgggcataactctacatttttgacattatggaataaattttttaaagttgctttgaaatgctacataattgaaaattccattataag

SEQ ID NO: 6783 - DNA, 406 bp, mus musculus
atggtaaaagccttagtgggctcacctttaaattttaagttggctcctcatgtccagtggcactcttgtcattgctaagtttgtgccctgttcaaaggtatctagcagaggatggaaggtgagaaactagccatactctacttacctgatactacatcctaggatgacactatattagcagtgaaaggactgtcatattgcaatttatgcttctgcaaattgggtgactttttgcattttatctgcttgaggaggcatttttaaaatttcacacctacatcaatttccacaccttcattccttactttcagcgagtcccatagtaaatctacttttacttgctttctaggctaacacctcctctgcttcttggggttcctctcagtcatgagccaagcagtttccc

SEQ ID NO: 6784 - DNA, 1041 bp, mus musculus
tagtctttcatctcagagctttgactctctaattgctgttagacagtaacatcaggtggccaaaattaaaacacagcaattgtttttcttagagatttgctccatcctcactctctttattcctcccagaaagcacagccagttttctgtgacctcctctgcagcccagcctccaacaaatgcaattctttttgttcttgttttgtgctgcttgacactagtatcaccttatacttcttttatcttgcatttgatggtagcttatagagctttagggatctattctttcctttcttttctgaatgttctgtgctcccagtctcctctattctaagaagtgctgaactactttgcacatttctttgtaaaggaaggtctgagagccttgtttcccaggtcacttcaatttccatttccagtgcctctgcctaacgtaaagtacaatttggctctgaggaaatgatcatatctgcacactatagttccagcttattttttttcagttttctctttagcataataccctttcttgttcagaagtgttattacttgtactatttctgtcattcagtaatgatttactagattagtttttacttataatcgctaaatactttcttctattttaaagtttgcaactgtatgctcagaagacagacctttgtgtttaatgcagttcagttctgccaatatttggttgatgactaagtgttatgccctgtatttggtaagatgaggtagacattgatatttgacctcaaaaaacccacagttaagtagaaaaaatattttcaataactatagatatggcatcattatcactctaaagagagggcaaatatgacataggttaatggggaaagatcaatgacaaagtgggctttgtactaaaatttggcacaatttttgatagaaggaacagaaaaaaatggtatgttattccacatagaatatctttgaaaacagtcatagatactgaggtaggaagctcacgtatttgtatggttgttgaataagctatctcaattggaatgtgaatat

SEQ ID NO: 6785 - DNA, 971 bp, mus musculus
tgcaatgtacagctgcaaggacccaaatcttgttctttcaaataggtatcaaagaatagacctgggttcttcaggagccctggaactaccagacagccctgacaggagaccttctcaaaaagtttggcattggtttgagttctagaaattcttgtcctgatgtaaatgactggaaaatgagtattcacttttttgtactttcttcctcaggaggtttggaaagtggaaaaaaaatagtttcaaatagcacttcttgtaaatctgaggttttgccactgaaatgcatttcttttccttcaaacttgtctaagaaatgttttaatatatatttaatttatgcaagagctctagattttgttatgtttctccaggaaacggtttccaaacccaatgatataatatagaatattctagagattggtgaaaaattggtagttatttttattaaatctttctggtacacacacacgtgagaccttacaataattcctttaattagcaattattgggaagtgatagataatagtatgtggaaacacatacattttatgatcaatttatctcaaatacttatgttagcccaacaaatgataaatgatctggtcgtttctattagataaatcaactgccatgagagtaagtattttatttagggttcgtattagctctaaataaaattgattgttttctttttcatttcctgctgaactgcaagatttacagaatagtatgctatcatatatatatatatatatatatatatacacacacatatatgtgcacaaatgcacacacatatatatctgtaatatatttatatatgtaatgtacatgatatatgtgcatgtttaatgtcttcagtgcctcttaattgtctagtagagaatcagttaatttatcaaacaaattaaacaaccacaaaaaaattacaagatcgtttgaacatagattgtcagatgtgcagatgtttc

SEQ ID NO: 6786 - DNA, 1135 bp, mus musculus
taccgtaaactttcttgttgataattgcagttcatgaccaattccaatattcattttactgctaaaattccatggtaatttaataaatataatgcaatatgatttagtggtattcaatttactgctttggggattaaaactctactaagaaaggatgcttccgcatgctaagaaagattttgtgtcaaatagatatactgaacacctgaacaccttgtgtttgtaatttactgtgtcatgagccatggaacccaaaggccatgatttctggcatggagctctggtatggtctagcagcaaagacaggcaacaaaccaattattaggattcattacagaactacaagtgtgaaagtgatgtgaaggaggttgtgagggaagagaaacaatgaagatctgacaaagccatggagcatcaagaaaggcttccctcttgtagggtcttttaatctgagaacagaaggatgggtatgagtcagtagatagagctggagggggatacctccatgcagaattaacagtaagtgctgaagtctagagagaggagagatcatgggatacgtaaaacattttttcaaagttctagtatgactagaaagaagatgatgaataatcattgcaccacttattggcatgtgaccataaactagtcattgaagctttctgaatgaagttttctcttcagagaaacctggggattgccctagagtttgttgaaccacataaatagccctttatgtggataatgaaggtcaaataccagtaaacttacatggcttatcccaatgtaaatttaagagaggtgctgccagttttatattcatgtaaaggtattaaattcctgtaattaaaccacatcaaaagctgtccaaaaagtgtttaatacaaaagtgtttaatacaaccttcttttgaactgaatgttttaaaaatcacacttttaagcttttggcagtgcttagctttaacatcattgcaaaacagaccttgcccctcaaagacacttgtctgatgatgtgtgtatttaaagctgctggtaactgactgttgctgtttttagcactgctttggctgtctaaatctagtcaagacaaattatacctgggcggtgttggcaatagttggagcacttgagtg

SEQ ID NO: 6787 - DNA, 298 bp, mus musculus
taaagctactttaaaaatacctcattaatccttacttatcaacttctgtgcttaattgtatggagggagggaacaatggcaaattcacctatgaaaacaaaattcattatatgaggtgcaggtgcaagcaaactaaggaaaaccaggactcttaaaaaatcaatgaagatatttaagactatatttcctagaactcatgataaaaaagcatcagaatcggtacaccgctgtccagttaagttttaattaaaagcataggaatggattttctatatataaaagctgcctacaccattgc

SEQ ID NO: 6788 - DNA, 244 bp, mus musculus
gcaccacaaacgttcttaaagcagttttacccacactaaaatgaaaaacaaaaggaacatgggctctagtcccaagagagccatgttttctaatgtttccattagaaataaactctgcatttgactccctaaagcaacattattatgaacatgattttatgtggataaattactactgtatttcagctgcactgtgggttaaataggcttttgtgggctacactatagatattataacctcata

SEQ ID NO: 6789 - DNA, 270 bp, mus musculus
tttacatttcctgggttcctttgatcagttgtggtaatttgacggtttccacctcactctgagaataagtaagtctcattcttaaacctggcctaagaaaacctcaaaccatgcagtcatgttctttccttttattggctggattacatagagataaccgtcagacttaccatgaaatttgtgtgaataacagtagagtgattatcagcattggttgctgagtaacttcatagatcagaaccctctcctgtctgcgcagaatttgtcttt

SEQ ID NO: 6790 - DNA, 267 bp, mus musculus
gaactcagctctgtgacaaatagaaaaggataaagctttgtcagccatgcctattatcttacatagccccaaggtagccatcaataaattcagggagcgagagagagacaccagggaagggagcaaggaaataaaacagggttaagaactagcctcagaaagaactttgagagttctagagatggctgaaatcaaatgaaccagatatctgaaatgtttttgggaaagttcactggaaaaataaaggctagaacatcacttgattgt

SEQ ID NO: 6791 - DNA, 1183 bp, mus musculus
gctcctcaacgtggagccatgggaggccttgggaagaagaattatgaacgaggctcagccaccaactacatcacccagaataaagcccagaagaagctccagctgagcctggctgactttaggcagttgtgcattctgaagcgcatttatccccatgaacccaaacacaagaagaaggttaacaaacgttctacagcagcccaaactttttaccttatcgaagacatcaggtttctcctccatgaacccattgtcaacaagttctgggaatacaaggtgttaatccggaagctcctgaaggcctataggaagagcaagtggaaacactgtagagtatctaaaggacaataagcccaactacaaacttgaccgcatcatcaaggaatggtaccctacgttcactgatgccctgcgagacctggacaacgccctctccatgtgcttcctcttttccaccttcccacggactggcaagggccatgtgcagaccattcaccatggagttcatgcactacatcatcgctgctagtgccctgccacaaggtcttcctgtccatcaaaggcatttactaccaggtcaaggtcctgggacagcccatcacgtgaatcaccacttatgccttctcccatgaccacccaacagacatggactacagggtcatggccaccttcaccgagttctacagcaccctgctgggcttcatcaacttccacctctaccagtggctcaacctccactacccactgaagctcgagggtcaggcccaagaagaggcaaaggccagtgagggcacccatgcattggactctgagagctccatggagaaaatggctgccctcactgccagcctggcccgcgtggtggtgcctgccacagaggaggagcccgaggtggatgagtttcctgccaatggggagatgtcagcacaggaggaagaacgcaggaaggagctggaggggcaggagaagcacaagaagttttctgagggcctaaagttcttcctgaaccaaggggtgccccgtgaagccctggccttcgtcatcagtttttggggggaagtgtcctgggacaagtctttgtgcatcggggccacctatgacatcacggactcccgcatcacccacaagattgtcaactggcctgggcagcagacctccatcattggcaggtgctacatgcagc

SEQ ID NO: 6792 - DNA, 1094 bp, mus musculus
acaatcttgaatacttttcaagtctagaactagtctgtctttgggattattggtttagttattgcattcgctattggcatgggggaaatcttaaaatcagaacttcagttggagcttcattcttctttaacttttctattggaagatggttttggtggcttgaagaactcatgggtcctgctttggcaaactgaactgattagtctctgctgagaaatgtctttttatggtttggaacattttcagaaatgtggaacacccccccgccccgacttaacttcatagaagttcagtaaaatgcagtatatccttttctctctcatactttataattcacgaacacattgtgcaaattcgttatgataggcaatgaaggaaccacgtttcccaaattttatctccctgagaaaatgggaactatcaatcagagtgttggatgttgcttaggaaatatagaaattattttataattcagtctaacaattttagcatggatgaataataagagacaacttacttgaattagcaccagtttcttatctggtctacctcatagtgagttgctaatttcaggcctctttcctttgctatcatagaaagtttggtagtattaatacaagagaatctggctaatttgattatcaccattacatttgagtctaaggtcataataagagcctaaattcttactattgtacatcaacatatatttaaaaatctcattgtaagttggaaataaaaagtttgcagctaagaagcttcttgtttagaaataaaagttcaccattcaaacaagccattgaagtacatattaacctttgatgtatatttgagatttcaactgaataaattaggagctcacttttgccttccctaagtgagacaataaagtcaagtaaagtctagtttataagaaatcggtcttattttcataatctcaaaattataatctcctgactatatatatattacctataataagagctaatgaatcagtggcctgatcaattcaggtctttgcattacttctcacagttgcatggattttattggtgcttgggcttcagcatgttacatctcttgcatgactatat

SEQ ID NO: 6793 - DNA, 1094 bp, mus musculus; identical to SEQ ID NO: 6792

SEQ ID NO: 6794 - DNA, 880 bp, mus musculus
ctgcaaggccgccaacatggccacagactctcacttcacatattaaaaatgtacagaaataacggggtagaaatgctgaaaattagagcaaggctgacaagagataaagcaatgcaattagaagtgaagttgtgagtcagtagggccacccatgaaggtgggcatggaggcaatgcaagtcgccatcagccagaagccacacaggcctggcctgccagcacagaggtcagttcctattttgaatctgtaaaaatacaattgacagggactcctgatgcccgtgcagcagccaagctaagggtttctctttttcccaatgaatattttcattctactgttattatttgaggtcccttcagataaatcatgtatgagccaacactatgtcttccttataccaacatcatttctctttgaccaactgttcatgaactaattcacatttacacacaatagcaggcctgaacactgaggaaaaagaactgggcttagaatcaaaagaacctaaattcaagccccggctttgccattcactaactttgacaacagcacattatcattcagcctctgtacactgcagggtcctcgcctgcacctgctcctgctgtgtggtgctggcgggaggtctggatgaagacgctgtggagggctgcacaaatggaagggatttcccaggaggatggcatttgaacaaggtttctgacaggctgtgcttcagctttcaaagtcccagtaagctgtaggaagcacaggtgtcctccttcactcccatctccctgcatcaccaaggtactcagcctcaaacgccaccaccgctgccctgttcttgctgccttctagggatctctgtagccttggaaaagtacaagggatgcttatc

SEQ ID NO: 6795 - DNA, 999 bp, mus musculus
tggtgcattgtctgaggcctgtgctaggcaagctaccccagtcttacagtaggggttttccagccatggtagttttcacactaaaatgctgatcattcttgtgccttgtctaactaaagtaagttaaattatttgtcctgaaagtacatcaaaagagatttgctactgtgttgttgacacacattctgttaatcctgagattttcctctgcttcaaaagttgcgctcggttgattgacgacacagatacaatatctgctatccagagttaaaactcagctgcatgccataatgaaagaaaagctgtatttatgatgctgggacacaattcatcagagtccagtaatggatccccagccaatctgtattgttttagctgactgaagtgcaccatgggagtgctgtctttcactaataatgctgtcttctgtagatcgaggccccgaaagccatggcagcagaccttctcagaagtttttggcactcgttggaagatcctgtggttcattcctttcaggcagaggcaaccactgcgagttccctaccactttgccaatcatgtctaaacagatggatggtgggcacagatgggtcctccatgctggcaatgcgttacaggttttatgataatagaactatgacagtcttcaagtcaattaaaatccacccaccagtcttaggcatcataatgtgccccaggctttattttaatagtgatcttgatcctgttgtgggactaatacaagatctatatttaagttttaaagcatgtttactttcaaattagctttccacagggatttcttgaaatgcttttgttattaaactcaaaaggcagtgattaggatgaaataattgtacataatttattttagtactgacagtgttacagattctaatttatggtaaatttcagatgtttatttaaaattttcacttttaaacagtaaccaaatctaaatttaattattcaggttttacaaaagttgatacaccttct

SEQ ID NO: 6796 - DNA, 1622 bp, mus musculus
gatagttagctgcattgtttacatgtagatctttttacattatatggtaatgtacactgctgatacatatagttcacaaaataagatcctttggaacaattatgcacaagacatacgatattggatttacacactggatcccaggatgtgactgactgggaaaaaacgttggactaggcatgttcagtgaaggagccaggaagttatataacacacggtaaacatccacctggctcaaggggcaaatgcagcatgtacagcattggcagtggtgcatcagaggtggcagaactacttcacactaaccagtttaggactacacaagattaataccatccagcatcaggatatagctgtggattttacaaatcattcctatttctaacttgaggagttgatgtttttcccagtccatcttaaaatattactgctttaatcacagatcagataaaaaggacagcatgtacaacctccaactagaatcctgttgtagcctagacagtaaaatgatatgacatcagaagactttaaaattgcagctctttttggatcccccaaagtgtatctgcactcttcttcaaacaggcctcttcctcaggagtcagagtcactttcacaaggtctgagattccattctgtcccaaaatgcaaggaaccctaaggacgacatcatcctttattccatagagacccttaatcatggtgaaaactgggtgcacctgcctaagattcttcactgtacctctgccaaatctgctacagagagtccaatggcccaggatgtgtagcctttgagtttgatcacctcataagcactctcaaccaccagtttgtgaacctctttccactgttccttatgtttatcagtctctaaatctgggtgcggagtcttcagggagacaccagcaacattctttccactccatacaggtgcactggaatctccatgttccccaaggacccacccatgacagcttaatgggtgaactcccagcctttcccccatcaggtaacggaattgggctgaatccagattgcaaccacttccaataacatggtttttgggaaaaccacttatcttccaagccacgtaggtcaagatatccactggatttgaaacaataagcaacttgcagttcgggctgtattttacaacattaagaatgatgaacttaaagatgttcacgttacgctggaccaaattgagacggctttcttcctcttgctgacatgtcccagccatgataattaccagtttggagtttgcagttccattatagtctttgccagagacaatctttggtgttctaaggaaaaggctgccatgttggagatccatcatctctcccttcaatttgtcttcgatgacatcaacaagatcaagttcatctgccaagtccttcattaagatattgatggcacaggccatgccaacagcaccaaccccaacaactgtaatcttattctgggcggtctgttcttcctttagaagattatgaagcagctgatccttgagagttgccacattggacttggaaccaaaaggaatcaggaatgcacatcaggcagtcgtcggggcgtgtggcaatgagatctggaatcagcggcagtggctgcagcac

SEQ ID NO: 6797 - DNA, 1475 bp, mus musculus
acatatagttcacaaaataagatcctttggaacaattatgcacaagacatacgatattggatttacacactggatcccaggatgtgactgactgggaaaaaacgttggactaggcatgttcagtgaaggagccaggaagttatataacacacggtaaacatccacctggctcaaggggcaaatgcagcatgtacagcattggcagtggtgcatcagaggtggcagaactacttcacactaaccagtttaggactacacaagattaataccatccagcatcaggatatagctgtggattttacaaatcattcctatttctaacttgaggagttgatgtttttcccagtccatcttaaaatattactgctttaatcacagatcagataaaaaggacagcatgtacaacctccaactagaatcctgttgtagcctagacagtaaaatgatatgacatcagaagactttaaaattgcagctctttttggatcccccaaagtgtatctgcactcttcttcaaacaggcctcttcctcaggagtcagagtcactttcacaaggtctgagattccattctgtcccaaaatgcaaggaaccctaaggacgacatcatcctttattccatagagacccttaatcatggtgaaaactgggtgcacctgcctaagattcttcactgtacctctgccaaatctgctacagagagtccaatggcccaggatgtgtagcctttgagtttgatcacctcataagcactctcaaccaccagtttgtgaacctctttccactgttccttatgtttatcagtctctaaatctgggtgcggagtcttcagggagacaccagcaacattctttccactccatacaggtgcactggaatctccatgttccccaaggacccacccatgacagcttaatgggtgaactcccagcctttcccccatcaggtaacggaattgggctgaatccagattgcaaccacttccaataacatggtttttgggaaaaccacttatcttccaagccacgtaggtcaagatatccactggatttgaaacaataagcaacttgcagttcgggctgtattttacaacattaagaatgatgaacttaaagatgttcacgttacgctggaccaaattgagacggctttcttcctcttgctgacatgtcccagccatgataattaccagtttggagtttgcagttccattatagtctttgccagagacaatctttggtgttctaaggaaaaggctgccatgttggagatccatcatctctcccttcaatttgtcttcgatgacatcaacaagatcaagttcatctgccaagtccttcattaagatattgatggcacaggccatgccaacagcaccaaccccaacaactgtaatcttattctgggcggtctgttcttcctttagaagattatgaagcagctgatccttgagagttgccacattggacttggaac

SEQ ID NO: 6798 - DNA, 125 bp, mus musculus
taatacctgggcatatattctgttataatgtcatggttgatattcttgggtgttgctcatttggtttttttttttttaataactatttcaaagcacctgctacgtactgaattgtgtccccccaa

SEQ ID NO: 6799 - DNA, 1805 bp, mus musculus
aaaacaagtggaattacctctgaaattgcagctaactattgctacctctataccagaaatattttttcatcttttcataccacatgtgaaaactttgttgttgttgttgttttttgttttgagacggtcttactctgtctgccaggctggagtgcagtggcacaatcatggctcactgcaaccttaacctcccaggctcaagtgagcttcctgccttagcctcccaagtagctgggaccacaggcatgtgccaccactcccagctaatttttgtatttttttttttgtagagacggggccgctctgtgttttacaggctggtcttgaactcttgggctcaaacaatcctcctgccttagcctcccaaagagctgggattacaggtgtgagccattgcacctggccctgaaaattcttaagtggggataagggataacagaacttcttggttcattgttacctacttttcttttttctttctttttttaaagaaatgctgcagcactcattattttttcccctgtttccctctcctccccaaatttcctgtcagcaactttgttttctgttcattagaattcaaacacaatttaaattaatttcccttgccaccttctctgtggttagatacacctttggtgagttcacaaatgactcattggactatgatgatttttgttgatttcttacatggtccaactgggttatccttagagatgccttagaaccagtggaggtgttggctgtaggattagatggacttaacgcagattactggggatctcctggtattcatatccctgtagttgctaaccaggcttggatttatcctggattggacctttttttcactatcagggcctaaggagcctttttaggcattttatccaacctcctcccagccaggccctcattacatcctaagaataagattttgtctggcagggttgaactttaaaggaccataaaccgttgtaatatctaaattttttcacccctattgaaaatgcatgatttagacccaatatgtggatgcacaaattattaaatgacttagctatttatattccacccaatagtgtgggtacatttttctgagagttgctgaacagcagtggtattttgaaaaatactactcaccttgaggaggttacattgaatttgtcttttttggcttagttttaaaatgaagctgattacttggtggtatacttagatggtctttgataggaccctctcctgtcctgccttcccccatggaagtatcattatagctatttcctatacattctcactgcaaataaaattcagaaaatacttagctcgtaagagtttctgtctctggccccgcgcggtggctcacgcctgtaatcccagcactttgggaggccgaggtgggcggatcacgaggtcaggaaatccagaccgtcctggctaatgcggtgaaaccccgtctctactgaaaatacaaaaaattagccgggcgtggtggcaggtgcctgtagtcccagctactcgggaggctgaggcaagagaatggtgtgaacccgggaggcggagcaggcagtgagccgggatggtgccactacactctagtcagggcgacagagcgagactctgtgtcaaaaaaaaaaaaaaaatagtttatgtctccaaaaattgaggtattctatgatatttatgtgacttctaccttcagttgtgattgtagaatgccttcacagatttaaaatagataccaataaaatggaattatatataaatggcatggttaagaatgattgttctcttgatttgttttcaag

SEQ ID NO: 6800 - DNA, 6771 bp, mus musculus
gaaagaaaagactggccaacttagagtattttcatatccctattcctagtaggttttatttatgcaatatgcatttattgagcagcttattgcaagcactgtatgaaacatatactttaaaagtagatcatttctgcttgctgcaattcctattttaactttatatataatatacacaggaactatctaaccagagaaataaacgatataaggaatacttcaaaaaaaatgtgctgaagacattaagagtgtgatgagtgaccatggagtcaatgtattagatctagatttccttttccaggtttttttggttgggctaaataaataaataaagctgctcttgtttgggtttcccattcctctcagaactcatccccagcagattcaaataactttcaagattgtattcaaactcaagaatcactacaggtgtgtcaagtcactataagattcaaatcgttttgaaaagatgaccctgggagtggtgagatcaacatagaatgcaagttgactaggaatggggaagaatcatatagaaattatgtttatggcagccacagtgggaggacatgataacatggaatatgcaggggaagaggaggaatcgggaacagttacagtaggatccatggtgcctctgctagcaatggagctgttcagaaaagctcctttgccttggaagaagcctttctctcctcttctggctctctctctcttcctctggttctctccctccccactctttttcctttatctattaaatttcagagattgctttgatgtccaaatccagatgtgaggacatgaaaggaagagaggaaaatagaataaaagagataatggggaaatggaaggaaaaatagaactacaatttgtcacactcatcaaaagggaaaggacaggccgtctgtttggacagcctactcccatagccacataattttcctttcactgggtccctgtatggactttgagaagcagatctctctatgccataaacctagggttttttggggcaaagactgactgcccttttctttatcctcccagtcccttattatttgaatccctgtattaaaattgtttgcacacactcatgttttatcagattttcttgtaaggatgggcaaaatgcattacaattctccactgtatacatatactaatttagtgctatttagtagcttctttttgttgtaggtaataataacaaccatgatgatagcagaaaagagctattgaatttggcggggagaaatgtgactgataaacctactgaagaggacagttggagtgatagtgaaactgtaactggaaaaaaaatagggttctgagaagtaggatgtgtaggaagaaaaaaagaagagcatttgtttgaactcagtgctaaagtgatgaccttagtctcctcctttgaccgtggggggagaaaaaagcatattaaaccctgagaataaaaaagtggctaagtcaagttatttttttaaataagagatttgaacatatttacaggcagaaaggaagacaccagtagagaagacattgagaaagttgacaggggaacacatgattattatagcagaaaatgaagaggacagaaatttaacaaaagcaacatgcaccctccaagggcactgctgtctctctctgacccctgtatctcatggtcccctgcgctggtcctcctagttgtgccagtaacaatgttaacccgtcttgctttcccattccagcttgatgaagtcatagaaagcattctcttcagggagaatgagttgagattcctaagagcaagaatcttgctttcttgctgcagaggtcaccctccagcatctttttcttcttgctttttcaacagtcccagcagtgtatatgcctcgtggcccagggtctaggactgtacaaattgatatttgtagaaccccagtgctggaaccaaaatggcagaggagaagcagtgctcccctgtcctgcttctcttctttttcctcctccttccctcaagcctgcctagactttctgtacacccacattctccaagttgtcccgcctttattcctggccaagtctgcatttgctgtgactatcctttgattaaggtacttgacaccaaggagtgggtgacacacaagatacatcttttcagaagttattagcttctccaaaaaatggcattgctacctcttcataatgcccagtttaagaatgcatgaaagactagtaatcagtccttgtttcataatagttcctataagatgaaaggcttaaattaaatgatatatgggaacccttaatatggtacctgtcatacagtaagcactcaataaatgttggctgttattatttatattgtttgttttgaggaatgaggggtcacagccaccagtgtccatcaaacagtaaaattcgtagtcagttcactagttcttcaatggaagtggttctacccttgcgcagcctgtgtgtagtcctttctgtgggaacagactatccaattgctctagtggtgtatcctccaatgcttttggtggcaaggatcaaaactgcctccgggaaggccatctgtgtgccaggctacatgttaggcacttttatgattttattttatcctcctaacatcctaaaagacaggttattgtagtcttatctttcttatgaggagctagggtcaaggctaagttccatgcttgtaagcagcaggactgggaacaaacacaagttgtctgactccacgtctcatgctgtttccagggacatagtcaaaagttttttaaaaattattctctttgaagaagtaatgatacatttgcaaggagacatttcttctagtggtgttttctttggccttataatctgaaaagagctggtactggttgacctttgatagttaaatccatcactgtaaagcaatttgtttacaagcaaatgccatcagccataagccctattggtaatggacataagacattagtgtcacacttgaaaacttgtttatctcatggcccttttaagtgacttctgtttactttgctaaaattgtagtcatatgttcatttggtaagatgtttagcagatttttaattagatggccatagtgagtgatttcgtccacacatttttctctttttttggaaattattttagctgattcacgtcctgtgaaaagttaaaaactgtatttttgaaacttaaaagaaaaaaaacaattcatacatcacttcctattttctgttaggactggtcaaataagtttgtatattttagaacattgtgccattccacgggtggacgttttgtaacacagcttcattccagggacgttgccattcatctactacatagagcttcagtttgtggtaccttatatgaagttagagaggtctccagatttgcattcccctttcttcctacccactcctaaacaaactgctaagataaatccatttggctgggaattagatgagctactgatgtgaataatttataaaataacatgagtttatttgcattttaaggcatacgtgtatgtgtgtgtgtgtgtgtttattccttacctcatcgtaaaagaggagtccatgaaagttgtagttctggaaaacttagctcagagatcttaatggaataaatatattcaggcttaattgtaaaaatgtggctgttgcagccaaccaaccagagtagatgggcctcctccgggattccttgatgaaatttgggaaaaactacctggtacggcagggatgcagagagcctgagcttggcctaatctctgctggccttttcagcttttgatagtctcagtagatgaggatggctttatttgggggtgctcttcaaacccgatcatctatactcaacttttcaagttcttattttcttccaaatcctgatcacagcctccagtctccatgaatctgattccgtgaatctctccattctcatctcacacctctcactccttgcttactaaccctagtccttcagttcctcacaccaaactcctttgcaccttagggactttgcccaagctgttccctcagcctgaattgctctctattcctgccctcaacctgaccagcttcttcatgccctcaggcttcagcacaagtgtcccctcctcaaagaagccttccagaactgtactacctagagtaggcccctatagcttcactccctcacacacatgctaattctctatctttgtctcatgttcgtttccttcaaagtgcttttaacacatctggcaactgcatttatctgattgtatacttttgttttcctctttttcttctaccagtgaaagctaggaaagtagagattgtgactgtcttattcagagtaatgactgagtaagcaaatgaatgagtgaaggaagaaaatgcctttaaaagtacggcttctttaaagtagttttttccaattctgtgaagaaaggcattggtagcttgatggggatggcattgaatctgtaaattaccttgggcagtatggccattttcacaagactgattcttccaacccatgagcatggaatgttcttccatttgtttgtatcctcttttatttccttgagcagtggtttgtagttctccttgaagaggtccttcacatcccttgtaagttggattcctaggtattttattctctttgaagcaattgtgagtgggagttcactcatgatttggctctctgtttgtgtgttgttggtgtataagaatgcttgtgatttttgtacattgattttgtatcctgagactttgctgaagttgcttatcagcttaaggagattttgggctgagacaatgcggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaaataccaaaaaagagcccgcatcgccaagtcaatcctaaggcaaaagaacaaagctggaggcatcacactacctgacttcaaactatactacaaggctacagtaacgaagacagcatggtactggtaccaaaacagagatatagatcaatggaacagaacagagccctcagaaataatgccgcatatctacaacgatctgatctttgacaaacctgagaaaaacaagcaatggggaaaggattccctatttaatgaatggtgctgggaaaactggctagccatatgtagaaagctgaaattggatcccttccttacaccttatacaaaaatcaattcaagatggattgaaggcttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaaggagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaacagcaaagacttggaaccaacccaaatgtccaacaatgatagactggattaagaaaatgtggcacatatacaccatggaatactatgcagccataaaaaatgatgagttcatgtcctttgcagggacatggatgacattggaaatcatcattctcagtaaactatcgcaagaacaaaaaaccaaacaccgcatattctcactcataggtgggaattgaacaatgagaacacatggacacaggaaggggaacatcacactctggggactgttgtggggtcgggggaggcgggagggatagcattggaagatatacctaatgctagatgacgagttagtgggtgcagtgcaccagcatggcacatgtatacatatgtaactaacctgcacaatgtgcacatgtaccctaaaacttaaagtgtaataataataaaaaaagaaaaaaagtacggcttctctgttaggatagtctcactttccctaggaattgaaatatgcaggtcagtgtgtattttgaaaataaaaataaaaaatgaatatattattgaaataatgaacccatcaaatataagacaattgatcactaaatggagcaatgcattttccttccatatttattcagaagtgttagcattttcacaagtaatatagggcaatgaaagaaaaaacaatctttttgaagtgacctaagattatgaagttatttgtattttgacagtttt

SEQ ID NO: 6801 - DNA, 686 bp, mus musculus
atagaggattacacagaaaatctttgtataatatcttaatttggctgtagattatacattcagaaaacattcttctttggggattgtaaaaatctaccatagttcctggttatttgatttgtattttatttgtttcttgagacagagtcttgctctgtcactgcccaggatggagtgtggtggtgtgatcacagctcactgaagcctcaagctcccaagctcaagtgatcttcccaccttggcctcccgagtagctgggaccgcagacatgtgccattatgcccagctaatttatatattttgtagagacaggttctccctattgttgcctaggctagtcttgagctcctgagcttaagtgatcctctagcctcagactcccgaagtgctggtatttgggagccactgtgcccagcctgtttttttggtttgtttatttttaaaagaatttttttgcttcattttctttaagtcatagattacaatgacagagagtgcaaatgaaggaacaaattagctttgtagggaataatgaggtaaaagttctaattcctttactattagatttaattattatttttatttttattttttttcgtggggggtgcgcgagaaggataaagaagcccaaaatagtatagtaggcttttgtgttaagatccatttcagtatatatatgttttctt

SEQ ID NO: 6802 - DNA, 686 bp, mus musculus; identical to SEQ ID NO: 6801

SEQ ID NO: 6803 - DNA, 686 bp, mus musculus; identical to SEQ ID NO: 6801

SEQ ID NO: 6804 - DNA, 1048 bp, mus musculus
ttcctatgatgtattaaggcaaaaatgttggaagcttttgaaatatccaaaagtcttcatgtttttgtttaatgactgattataattctattaccaaaaatatcacacataactaattatgtccttccagatataacatttatcatcaggtaagagtgaaatgagcaatacataatcacttcctatttctaaatatttttcctaatctttgacaaaaggcccatttcaatttggttcagcatcctttgagtgcctagcatgtgccagaataacaaaattagattagagacaataaatgcttgaaggaaatcagattatattttacgaaatgatagtaaatggaaaacttgaggggtttaaataactcagttaatatgttgcataatacatattcacaatgtgtctggtttatgttgttgttattgtttatccttataaatttttgtacaatatcactttttaaaataatataacttgtcaaaaaattactcctttatataggaacatcatagaagggatattatccttctaggagctacagttttgcaaattgttaatggcttgggttttgacttcagacacatggatttgaacctgatttcacgggtccttggacaagttactttattgcttctaaaccttgattttctaatctataaaattgtgataataatgcctaatttagaatcactgtgaggttagatgtaatcataagtataaaatactcaaaacttcctgacatggaggaagcagtcaatagatggtaactacaattatgagaacaaaaatggtaacctatcacatttatttgatggagccagaattagaattcctgcctttgcatactgtctcttaaatattttcattagctctcattaatgtcccaactgacatatttcatgataaatattctctcacatttctaattgcaaccaagtttaaaaggcgccaaaaggcataaaatcatctatctgccctgttatgtgacttcaatatatttcccaatacaatttcatgattcacccataaaaagttgtgggtcttcaaa

SEQ ID NO: 6805 - DNA, 946 bp, mus musculus
agcactatatttttcattgggaaaagctgcctcaggctcctgtggggctgcaactgggtagcatcttctaatctcttctccagagttgaacagatggcagctccctgattggaaacttgattcaatgctgcatttagtgtgattaaaacaaatggtgagcctggagctgggtgtatacaccccacagaacaggtggcaaaatggaaagtgaaggtaacctgtttatttgtctacacaacactaaagaaatggcttgatgagtattctccttactagtgtgaatctttttttttttccttcatcaaatgaattgaattgaccagctgtattggtgtcctgtagacacagcctgaaaagtctcctgctctaacaggcttcaagctagtaggggtctgtagtgacgcagcaggtgcagagagatctaagcccttgaatgtaatgtatacacagagctctgcagacagccccatggagctaccacataagatggtttttcatgtgtaaatgagaaggtcttttcatttttcaagctattgcattatatccccttctgctgaaagacaaatacaggaaatcaaccaacactgagttaattacagagtgaccagttctataatcaggattgcagatttcagtcttgaggtttaagtgcacaagcatattttgcactttggtactcatagttcaagccatcttgggaagtcatggttttcatgattttgctccctaggacatcagtgctgggagcctattggctttgaatgaaatgactaccagaatgggggttgaaaacaggaaatacttttagggtgaagaattacgaagagctcaatggctgatttacaatgtgagaaattacttggagtggtgttttaatagaaatttatttccttgaaagttgctgctagaaagcgatgttgaagtcttctagaatgaatagaagaaa

SEQ ID NO: 6806 - DNA, 188 bp, mus musculus
atatacataaaatatatgtttcaatcatatatgtttggaaatttgatctatatatacaaatatattttaaaaatttatattttgtttaagtttttcttctgaatttaaaaaaagtagcaccataatttcttgcctttctcacattaaccacagaataaaattttgtttatcagatggcgggtttcttg

SEQ ID NO: 6807 - DNA, 291 bp, mus musculus
gagcagggggatatagaataaatgctttgtggaatacagaatgatgtaataattatgtttcccagaaagggattgtactatgaattcttcagtttggcgccttcctcagttaacaggtgttagaacctttatatgtcactttatgtggattcataatgttcctttgaaaagcttcataaaactctgttgtataaatacactatacaattttatctaattcctttttgatggatattaagactacatccatattttcactattatagttatctcaaaaataagatattctta

SEQ ID NO: 6808 - DNA, 806 bp, mus musculus
atcttgttatatccttccctgaggagttctataacatgtccaaaagagcaaagaactcaaaagatgaaaataaggaagaacaaatcaggatattagaatgacagagaagtcctctatgacattagatgtaacaggctgcgttgcccaagtctgagtttttccacactctcacagcatgttcaagtcattttattcattttataagggtccattttacgtagagtagaatggtatggctaccatgccttctttctggctcacgttgttgcatgcaatgacaaaaactacatttcagatacagttttcaaataaacaataaaatgttgctctcctcaaaaaaatgtttttctgtattgctacataagtaaagatttagaaacatatcaaatgcagatttgattaattaagaattaggaaattctgctcaaagaccccagatgaaaaatagtaataactgactgttgagaacctcaaagaattaataaatacaagagattattatttaggttataagaaataacggggaatcaaaaagaatttggctgtggatataaagaagcaattaacacagatgggcaacaaaatgccagtagttatatgaagaggtacttctttcactggttatcagaaaagtcacaaataaagcaacaataggatatcttttttgcccatctttgtgaagaagtctcaaaggctacagcccttacttccaaattctcagagatatctatgtggctagtctcatttgcagaacaagtatgatgccccccacccagttgtcagagattcttattgttgcagtcttc

SEQ ID NO: 6809 - DNA, 516 bp, mus musculus
gctcctctaataagaagaaaaaatcattttccaaatagcagttgggtgtcttggaaaagtaagtggatctccaggatgacaacaaaggaaaagattttcttttcttatattagaggaaagaatatacttctttttaattttataataactttttgaggtaggtattacctttttacacctaaagaaattgaagaactagggtgggagtgggggatcataaagcaagcaaatggcagatccaggatttgaactcatcactgtcagatttcaaaatccctgttctctttattacagtagtatgcattgtgtagacaataactatgggctgtaggttctgcttcttgctttgaaatgcattggtgtcatattacttgtggtttcataattactagaagaaaagaaggacatggtaggaaatgcaagaacttctaactgaatgaaaagatggcagcagatttgagaaagaattcatagagaatttccagaacttagactaaattaatagagaaaggaagc

SEQ ID NO: 6810 - DNA, 1266 bp, mus musculus
tccatccatccaatggaataaaaggtttacttactcatattggctgacttgctttgcaaacagtatcagataatatgaaatttattttgaggtttaacttacataaagtacatatatcttaaatgtacagctcagaggatctttacatatgtgcgcacacatataaagccaccaagataaagatataaaacattttcagcatctcaaaagacatcctcatgttccccaccattaatattccccaggactaaatattattctgacttctatcactttaggttagctgtgcctactttggggtcttttatacatctttcatgtctctacttatgttcagtattccctctgtcttcttaagtacatggaatatggttataatcactgtttttatatctttttatactaattctataatctgtgtcatttctgagttttaattgattgatttttctcctcattatgggttatactttccagcttctttacatgcatgataatttttattagataccagatattttaacctttagggtactggctatttttttctataaatattcttgagctttattctgggacatggttcagttacatggaaacagttgaattattttgggtcttgctttgagctttattaggtggaaccagagctagggctaatattttgcaactactgagttagtactctacccaattctctgtaaattatgaggtttttatattcggggtgatgggaaaaggagccagtctggtcacacagtgatctccaaggattattctcactaatctttttggatggttctttcccttacatgcaagcaccaataagtatttggctgaagtctcaaaggagtccttctcaagaatctttggatttctctcatctccagtacttggccctgagaactctaactaccttgacttcctagactggcagcttcatctcctgtactagagaagctgcagaccttcagcagaccttcatctacattcttcctctgagcactgcaatctagaaactctctccaggcttcacctactttctttctcatctctcaaagatcactgtctgttgcctgctgtctagtatcttgaaaaccactgtttcatatattttgtctgaaattgtttgtttcaggaagaataaatctggtcccaggtcatcgcccttggtcagaagtagaagtcgttgttttgcctgtttttgaactttatttaaatgcaatcatattgtatgttctcttttgcatcagacttcatcaactc

SEQ ID NO: 6811 - DNA, 339 bp, mus musculus
attttaccaaatgagtttgtggtaccatttattttgtctttactgttgtatctgtaattacatgaatgtttcctttacttctccatgtaaataaccatactagtaaatttataggaggccaaaatccaagggtagagtgcactgcaattgccatttgtctcgttctaattcttcaccaaactcctgtttctgttttctacatggcagtagttcttcatattctggattatagtttctataaactgcccaagtactaatagccttcatttttattctttatgctccttagtaaatctttgaataccttgcagtctgtgtgtatgtgtggtagtagttgtg

SEQ ID NO: 6812 - DNA, 914 bp, mus musculus
ggatataagtcatcgatgttgtgttatgtgcaaggcttccaatattaaagtctaacttagttggaaagaagatttcatgcttgttgatattcctctcaaaggcaattatctgctgctatcatgtctgagttcccagaaggcccagaactgtagtattttattaatgatggtctgtaagaagatatatattgaattgtgttatttcattaaaaataaattccacacagtttccaaggatataccagcttccctaataaatccaaaatgccatccctcctttctctctgggtccattttcttttgccttctctgaatctgtgcctaagcctagatgtagttatctggaaaggtatgctaatgaaggacatgcacatatatttttccattatcatttcctggtttttatggaaagaaacacaattcatagagtatttagtacatttgagacttccagggcaagtttatgttttgaatatttatcttttgttcgctccatttccttctgcttcataattttccctaagctgcatataccttctttccagccacaaagcctaattttatttgcccagaaagaagaaaataggattatgaagcataacagtatccgtgccttttctatatttcttaattcagagcagagtcatgaagttgaatacagcaatccctccccactgacacacctgattgtgagttctccttatataaaatcaacctgtatgtgaatttgcttttcaacagctgtgagaaaatggaatctagtctaggtaagcccagtgaattttaaatcacttcaggtgaggttaattatattacagaaggagcagagctggaagtagcaacttaggtaaggttaaatgctacaggaatagagattataaacactgaatctttaaaagaatgaaaggaaggta

SEQ ID NO: 6813 - DNA, 914 bp, mus musculus; identical to SEQ ID NO: 6812

SEQ ID NO: 6814 - DNA, 395 bp, mus musculus
atgagagaggtaaatgcacagtgagcttctgactatgtcttatgatagaacaaaactcatgatccagtgttttgtcattatttctgatggttggtgtgtgtgtgtgcctgcgtgtgtgtgtgtgtttgatacagcattattttctaggattttgtcattataactctaaacgtcattagagggatattgtacctccagtgggctaatttaattagagaacaccaatgggacattgtctctgaacttaataagatcctatatacagacaaaagttggcacatagatacattaaaatttattgttttcagtattaataaatccttatctaaaacattttatttttttataccaattgaaagattttttaaagaattaagagaaattatctatttatt

SEQ ID NO: 6815 - DNA, 2210 bp, mus musculus
taacaatatatcaatggaatgtacagaatctggaatatggaacaaataaactaatttgttttggcagtaacctgtgggacaaaataggaaagggagaaggaaactatagattaaaagagatttaagagtacataaactaatgataatgtatagatcttgtttggatcttaatttaagcaaaccaaatattagaaaaatgttttaaagactgggaaggaaatttagacttaaagtaaatatttgattgtcttattgttaactttttaaaagtgtgtgatggttaatattgagtatcaacttgattggattgaaggatgcaaagtattgctcctgggtgtgtctgtgagggtgttgccaaaggagattagcatttgagtcagtagactgggagaggcagacccaacctcaatctcggtgtgcatcatctaatcacctttcagcattaaaagcaggcatgaaaagagcagactacctgagtcttccagactccatcttcctctcatgcaggatgcttcctgccctcaaacgtcagactccaagattttcagcttttggactcttggacttacaccagtgtttaccaggggctcttaggccttcagccacagactgaaggctgcactgtcagctttcctactgttgaggttttgggacttggactggtttcctggttcctcagcttgcagataacctattgtgggacttcactgtgtgatcatgtgagtcaattctcctaataactcccctttgtatattcatctatcctattagctctgtccctttggagaaccctgactaatacaaagtgtaatggtaaaaattaattatgtatttttttaaattttcctttcagttccgggatacatgtgcagaacatgcaggtttgttacataggtatgtatacatgtgccatggtggtttgctgcacctatcaacccgtcatctaggtttaagccctgcatgcattagttatttgtcctaatgctctccttccccttggcccccaccccctgacaggccctggtgtgtgacatacccctccctgtgtccacgtgttctcattgtttaactcccgcttgtgagtgagaacatgcggtgtttggttttctgttcctgtgttagtttgctgagaatgatggcctccagcttcatccatatccctgtaaaggacatgacttcattcttttttatggctgcatagtattccatggacccagcaatctcattagtgggtatatacccaaagattataaatcattctactataaagacacatgcacatgtatgtttattgcagcactatttacaatagcaaagaaatggaaccaacccaaatgcccatcaatgatagactggtaattatgtttttaaaaatattacttatctttagagatatataataaaatatttacagatgaaatgatatgatgccttggatttgcttcaaaataatccagcgagtaaagggaaagcaggtgggtttagaaatgaaataagattaaccaggagttaataattgttgaagcttggtaatgggtacatgaagcttcattatattatttgctgcacttttgtatatgtgtgagagttctacaataaaaataaaatgttaaaggaaaataaatatatttgtaaattgcatgtgataccaagaatataattaaaaactacaccagaaacataaagaaaaattttagtcagtaatatggaagataaatttgagatactttcagagggacacattaagaagattaaaacaaataaaagtaagttagtgccttaataaaccacccccaaacaaagtggcttataatagcaataatttacttttgttcatggaactgtaagtcatctgaaagttggcttagactgacttgagtggcttggcaaaaagtccaggtctgctgaaatgtctgccttcctctgtggactaacaggctctctggggtatgatcgtattgttggtggcagaaacacaagatggcaagcccaaccatgccagaacatttcatgcctctgcttttgtcacatctactaacctcccttccattggacaatgtaaactatacatctggactgaatgacaagcagcgaggtgtactcttcttttactggaaagaacaagttcacatggaaaagcgggtggttacagggtagcataaggaagtggggtagatagttatatatgtttgccaccttcatcacatgtt

SEQ ID NO: 6816 - DNA, 697 bp, mus musculus
gatttttacctgaatgattcttagcctctgctgattgaagtgtccaggacctatcatgactcctgggatagaaatagagtgccagggcttgtcattagacttgcctaccctaggtggagggtcctaatcacacatactgaaagcaggaatttagtattcagcaaggcctgatttagaaatcggcaagacctgatttctgcaaaatattgcaaacaccagtccctacatttcagaaagctaaataacatgattattaggagaagcagtgtatcattcaaaatgagaaataacatagaagacagaagactgtcaatgagcagtaaaaatcaagttatcatttacagtttcataaatagagttttatggagagattaagtggtagtgaagaaagactacctttacttttaggttactgaagtacaaatgatggggtgtaacaaacagaaacccagaacttgaactgggcacacaatgatgacccatactgaagtgtcagacagtaaagggatgttttgatagaggggtgagcccagcagaaggactagaaggctgtgtcttggagaacaaattcagtctagtgacaagcgcaatacctgagcaatgattcagtgttacaagttataagagtatatctcaaacaagcataatcatataggaaagctgagattccatggatgcttggctggttttcctcata

SEQ ID NO: 6817 - DNA, 287 bp, mus musculus
gttatttttgttgttgttgttgaagattttctaggcttttctttatttgtttgcatttactctctgtaaaacaatatgctgttattggactttactatcttaccttaaaattccatacatcgtcttttgcctttcaattacttttgcaatcaaactggcatttccatcatatattgattccccaattatttttaaaaaagatttatatgttcaatcaccaacttttctaattatggctctagtattaaatttgtaacatgaaactttcaactgctgagttatttcat

SEQ ID NO: 6818 - DNA, 349 bp, mus musculus
atataatattggtattaatgcttgatgttaaatcaaatgtttttgatttttttaaatattcataccagttttactcatgcatacaatttctaaattaactaatgttttttaaaaaaattcttgaaataagaattctaatacatgtagtaaggttgaatgacttgtgtagtaaagtaaatcatacttaaatacaaaaaataaaaactaagtagctttaattttgctcatgtcatgtactatgctcttttacatatttcgttttgttattttagattaaaactctggaatttagatattcaaactcataaataataaaactgaagctcagagaatataaactaagtgtaga

SEQ ID NO: 6819 - DNA, 337 bp, mus musculus
gtctagtgactgatacttagattatgtttatatttaacaaatttttatatttctctttattaagctactgttaggttagttcttttttcattgttgagtttttaagaactaagttgtgaaaatttacctatatattttctatggatagtatatatatatatatatataacacttggcttaacttggccaaaagaatgccccccaacccactccccctaaaatttgtcttatatatttaataaagggaatatatttaaaaactaatgataaaataattttaatgtttaaaattagccaaaatacagaataatttgtttactaattcatctcatttatg

SEQ ID NO: 6820 - DNA, 1045 bp, mus musculus
caggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactgtgagtgttggcatctggattccagaaggcagtgtgggctggggagccttttcaggggtctggcccaggcagttgagcgagaacatagccccaaattttctcactgtgtctctgcctctttttcagccatgctgacatcccagaaacctgtgtccactatgtggggggccccctggatgcacttatccaaggcctgaaagaggtaagggtcttggggtcaaggctagtgattgtagagtaatcaatctgcggggagagagtcctctcagccttggccagcttgcacttcctggcatgtccagcaggcggcggtgctggctctgctgcagcctgagctggggcagaatccaggtgaagctggccttctgtagggtccagcctcctgaccgtcttctccctctcagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgaggtgcaacggtgcaggtgacctttctgcttagtggccccacctctgctccagtcacccagtattccccacttccaactcctgactctgggcactccctcccagtcctaggcccattcctcagcccctcttcttccacaggtgttcccaccaactccagtccgtccagccttctccttctatgagactctgcgggagcggtcctcactgctgccccggctcgataagccctgtccggcctacgtggagcccatgaccggtaagagggcccttgggagggagtgggagggatagttccagctccaggccacagtatgagacctctgactcttcttcctcagtggtt

SEQ ID NO: 6821 - DNA, 301 bp, mus musculus
cacactcccttcaccctcagggcctgtttgctctcgcctggtagagtttccagggcaggagatgctcccagcttggcaggtaagagccacagaggggtacggtgggaatttcagctcaagggctgggctagttctgcaacagaatttggagtgggctgggccctataggcctgtatatccgacaagggtcacagagtctgggggcatggctgttcctgggttcccaggtgagcattgagtcttcccaaacaagatgccccatggactgtgcagctgttattgaaagatctcctgagctcct

SEQ ID NO: 6822 - DNA, 195 bp, mus musculus
cacactcccttcaccctcagggcctgtttgctctcgcctggtagagtttccagggcaggagatgctcccagcttggcaggtaagagccacagaggggtacggtgggaatttcagctcaagggctgggctagttctgcaacagaatttggagtgggctgggccctataggcctgtatatccgacaagggtcacaga

SEQ ID NO: 6823 - DNA, 1838 bp, mus musculus
ccctgagaggcggtaagtgtttggtttttttagactctaatctttagtatatgtaaccagatttcctttttcatgtattaatagacctgattaaggtaaatcatcacatagattctgttggagagtaggaatatctgtttatgtgtggatgacctgtggccattcctggacctgtagccactgccttcctcatggggtagaatcatgaaactgatcagcagtaggacggcaccttaagtacaacaggctgggaagacagtggtcctcaccccagccaactagttacctctctgaggcccatcttacccttctcttctgccagtaaaatacagatatcctctaacagattgtagtcctcccaaatcgtaaagatactgttgtttcaaagaaaatcctctgtatgaaaagttctgcagcataggtaactcttcaagttgctattcttttatagcaatttcttaaaggcattgtctattttcaagacaattggagaattagaatgtggacagggtattagatgatattatggaattattattaatttattgatgaagaaactgaggagatcaggaataaaatgatttatcaaagctatatagtacaaagctggagccagaacccaggtcttctcattcctaatcttatggtttttctcccacagtctggaagtgctggagaactacctagaaagccaactaacaccacagtagtttctattgaaaaatgcattcaggttccaaaatatttacataactgaccatttttagaacattatccgttagtatttggtaactgcttagcttctcaataatgtgtatatatgtggttgaactagtttccttaattttatttaacatttttcagtgcaatggtactatggtttttttaaatctcagtgtcagtgcttgaaatacttaactatctccaaccagaaaaatttcagaacaaaaggataaaatatgcctaataaacagccatatgtaacgtaaacttctcagcacactttatggtgttgtctttatggaagacaacatccttattcattggagatgtatactgaagtgtttcagagtaaagtgtcatgatatgttcagatgagttactttcagatggcttagcaaataagtaaatttaatgtattatctacatacattaaatttatgtgtatatatagatatatacattgatgtatatatatcagtgtatatctatatacatatgtacattaatatattatctatatccaaatagaaagcaaatgtggcaaaatatgaacaattgttgaatctaggaggatataccggtgttcattgtactcttctttgaacttttctatatatatgaaaaaaggatatatatatccttttttaaaaaggaaggggataaatagttttgctgagtggcagttgcctggtagaagtgtgacagctcctgtccagggggagatggctttggtgcttcctgaggaagagagaggtgatctggccctggcatacctgagtgaggcatcctaatgtgtatgaagggacaaaagttcacccttgtggaccccacaggccggaggcccagctctacttgtgccttgttttatgttttgtttcaggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaaggtaagcaggctggaattctttcatatggagcagaagctgactgctaatggactgcctttttttttt

SEQ ID NO: 6824 - DNA, 477 bp, mus musculus
ttcttttttaatttgaagaaaaaagttgggaaattattatgcttttacttttatgttacaaaagggtgttacttgcaactagcatctatgtatctaaataacgtttagtgacttaattctctgcaacagtaaaaagtactcaatttagattttagtaagttgactgttagatggttgctctttggcagaagtttaaatatatatattcatagatatttttacatctagcaatcagtaaatatttatctctttttcttgcactttgcatttaataatttaaaaggaaaaatttaacagatgataaatatcaaaccaaaaaagtcaacaaatcttaataatctcaaaatatacaagggcaaagtgatacataaaccaatacagaatacatttgtctgcacatttttgcataaattttaaaaagcatataattctgtaattttaattttatagagctttccctaaaatattttttatttt

SEQ ID NO: 6825 - DNA, 828 bp, mus musculus
tgtctgaacaaaatgctggaagccaggcatctcactgttctgctttgaaaaagtgagagtcccatggaatggattaagtatgaaacttcccccatgtgtgataaagtcccactgggaggtggtaacacacgctttccacgttttcaaagtgttccatcccagaacgtcaggaggattagggggtctgtgtcaccacagacagcagtcacatttgttgatggatcttcagtcttggccaatgttatcctgcctgctgatggcagaacaccctccaagacagtttctttgtaaagcctgaatagatgccttccctggccacttctctcagttcctagaaaaaatgcccaccttttttttttttttttttgagacggagtctagctgtgtcgcccaggctggagtgcagaggtgcaatctcggctcacagcaacctctgcctcccaggttaaagcgattctcccacctcagcctcctgagtagctgggattacaggcatgcaccaccatacccagctaatttttctatttttagtagagacggggtttctccatgttggtcaggctggtctcgaactcccgacttcaggtgatccacccgccttggcccttcaaagagctgggattataggcgtgagccaccgtgcctggccaaaaatgcccaccttttatgtcatctgagacaagcagccctaccaggtctagctaaaatgctgcaacagcttcaccatgccaagaggcaaagatgattccttgggaccatctgatacagagatggaaactgtccttcatcactaggcaaaggatcaaatggacataactaatcttagag

SEQ ID NO: 6826 - DNA, 487 bp, mus musculus
agtgaaacaaatttagattctggaaacatggtggacaaagtccatgcagagtctcctttaacctcaaatagaaaaattggttaaaatatactttttaaaaagtcataataaagatcaaaagaaagaaagagaaatcaccaaagtatgaaaaaagaagtggcagttcaaaagaaccagagaagaaagctgaaggcatggccttggcagctgtttgatttggagagtcccttgtgttaatgtccacgcatgcaggggcagttgatgtgactaaacctgggcaagcagggagctaaaacttaatccccatatattgctgacctcctcaagggctgcccctttcgcaagaaggggacttgagaaactccacccatcaagctctttccatgtcctggtatactggtgtgggggccaaaactactctagtgatgcagatgcttgggggagattgtctcaatggaaagatgtatgttggattgatgaagcacat

SEQ ID NO: 6827 - DNA, 153 bp, mus musculus
tctaaaatcagagcaaaatgtgtttctaaaatcagagcaaaatgtcttacaaatgtggtatgatcagagaccctgctagggtgaacaaaatcatgtgattttgttctctgcttactcaaacatttaacaagaacttgctatctgccaagcagg

SEQ ID NO: 6828 - DNA, 153 bp, mus musculus; identical to SEQ ID NO: 6827

SEQ ID NO: 6829 - DNA, 515 bp, mus musculus
gttctgaatatcactacaagacagagttacaaaccatttctattgttttatatattttctgagttttctctttttttaataagcatagagcatttttataaaaaggaacaaacaaacattataaagcaacccatcctagagtctttctgacagcaaaccatgaaagctgccagagtcgggaaggacataggaaaccgctagtgttgcctgggcgctggccaaataggtcacaggaattggtttcttcccccaccttcttctctgaagcaccagcaattttgagccagggtgatacatgtgatcaatgaaatgactgccatgggatgatcagatagactccagcagctgttctagaggtaaattctgattatttttgaattctgaatttttatgttcttgcaaatagtgccaaatagtctgttcccattcactcacagaagcttcagaaacataaatttacttgaccaccactgttaagtggatgtggaagttaatgtttaattatgaaggactgt

SEQ ID NO: 6830 - DNA, 732 bp, mus musculus
ttaagttccttatgcagcttattaaatttattgctcatagtatttgcaagaggaaatcatttggatgagaggtggaacaatacagtaataagactggtttttaaaaaccttctttgaaaatggtgacacatattggcatgtaagtgaatgtatttgctaaatagctattgcttttctgtcccatctgattatatacatcaagtcaaccaaattaataggcttctgattccagtttcactaactttatttccaatacctccttatcctgtcacttgttttcaaacatctgttctcaagagttgttcaagcctatgttaattgcttacactcctccatgatagacagcttagagctattcataagcctattataagtgttgagcagcaagggaaaatacccttaaaattaacaccagcaatatctattgtatgtttacattttcctttctaatatccagccattagctgagtcattagactactgtcatcacctcacctaaccagtgactattctttctctcacctcttttcctctcatattttaagttcaagcaacccactcaattaaaattcagaactatcactgtcattatcaatgacatcacattctgatatccctttgaggatgaataacctatcttgccactgagtgtcaactagtttgttggcttgtttcctctctggctggataaagataacaggtgtctgtctccagttccaacaccaggagcag

SEQ ID NO: 6831 - DNA, 762 bp, mus musculus
ctctaaagatcacccttctgtatgcatagcttatttttgagccaaagattggtcagaggttgtgtccaaatatttcaagccagaaagtcttcctctatctgctgattgatcagtgtgtgggccagagagcacattcaagcttcaggctatttgtaagttcacatctcatttcactttcagctggactctctggcgtctcctctgggtattgcaggctccttcttccaaggatgtgcaggtggttggcacatgcacacagtgtctgcagcacatacacagcatctggtcaacctggaatatgtgactcctggccaccctgttctttattagtcttttggtctcttactttcatcaagcaggcccataatctcagaataagtgccattaacccttcttgctcctttgtcataaatgttgccacttcagatgtcacaatccaaatcaaatctgcctctttggtttatatttaaaccaaagtttaaattaagttaaacttgtgcctcaaagtttatattcgcagcatgcctaccctggttgaactactatatgggctgagttgagggacacaggagattctctgggcaaaaatgctacagactatgttgttcttacctgaaattcagtggttttcatgaataaatgcttctcatttgactgtatacctttgattgattccagagcatcaaaataattataatttatagttttgtccaactttacaatggtcaaccaccttattcaatcatgctggatttcaaaatt

SEQ ID NO: 6832 - DNA, 1950 bp, mus musculus
ctttcttttttttattttgaaaacttattgaacttgcatctacactttaaaatgaagcagaacttaaagaactcaaagattatgaagaagactcagtacctgggaataaaattgagaatagggctgggtgtggtggctcacgtctgtcatctcagcactttcggaggctgaggcaggcagatcacttgaggtcaggagtttgagaacagtgtggccaacatggtgaaaccccgtctctactaaaatacaaaaattagccaagcatggtggtggtcacctgtaatcccagctactcaggaggctgaggcaggagaatcacttgaacccaagaggtagaggctgcagtgagctgagactgtgccactgcactccagcctccagcgagacttcctttcaaagaataaataaattaattaagaatagtaataaatatgaaaataactaaattttagcttccttttatgactatataaccaatctcaaccattattttttgcttccccaaattaggagagtttaaaatgcagattctccccactctcctcttcccattcaatagaaactgagaaagaaggatcttattcaggtcttcactccatttgtgattcatattcagtggctgaaaggttagaaagcattcactccaccaataatgatcaagcacccataaagtaccaggagctcttacaaactctagggaaatcctggctcctgttgtcatgaattttgcattctcaggtaggaaatgtggctctgatgcctgctggggcagtggtagcaacctttagtccatgtgaatgcaggcatcccttggtatgcacgggggattggttccaggacctcccaccgataccaaaacccacagatattcaagtttctgctataaaatggtgtgtagtatttgcatgtaacctatgcacatcttcctatatactttgcatcatctctagattacttataatgccaatgtcaacactatataaataattattatactgtattgtttagggaacaatgacaagaaaaatatctgtacatgttcagtacagacacaatttatttttgctctgctcttggttgaatccacagttgtggaacccatggacataaaggccaactgtacacttagagctacagaggatcttggaggtaatctagacaatttctaccctagtatagaaatctgtatactagagcatctctaacagaacctttcattcaacccttttttggatgccttcagcaacagggaactcagtacttcccttcccacttgtaaaaggtttgaatgttaaaagttcttacatttttctggcttttctaatatttaatagcagctttatatctctttcccaattttcacagccacacagctccctaaatagagttaaacataaccaatctttcagtcattcctaaaagtaacattgttatcagtattgctaatgtccattcaagagtcttaattatttaaaatattccctgaccagtgaatattctgacttatcagctcagaataacatgaactatgacttcctgtttaagccttttaggattgaaataatcctaaatgccatggtcaccctacctggttggcttatattaaaactttgcctctttcaggatatttgttgtcattcctattctgtggtacagctcaacctgaggggtgctaatgtgtcagaaaaacaggtaagcaggcaagcctaagtggaatctgatgtcaattcttgagattgaggacagtgctatgtgactgattgtcatttaaattaatcaacatgcaactgtcaacttagaaaatccttcaggcccagagtgaaaagcagagtttcaagcttataggaaaccagacataatcattcaaataaaattactgataccgtacttcatatgagctaggacattacagtaatgtattattattatgccacttgaaatatgattatt

SEQ ID NO: 6833 - DNA, 7013 bp, mus musculus
gggtgtatttcatctttcctgcaaagtcaataggcagaaagggtaggtgtcagttcttcccccaggctgtcagctggtgtgtccctggtgtgcctttgggagagagagcatggggaaagaggatgctttttcttctgttaacgtgctaataaatactattttcattaatgagtgaaatgcaagggttatttaaatgacattttgtctcaaagtagtataatgattacaagaaaaaaattctgtagaacttttcatgtcattaattcaggcatggagaactgatattttttcttctgtatgtaaactacacagatgaaacctaattttatttaatttcatctaacttagaggcatcaaatttcattatgtattttaacattttttatataattataaaatatgttttaatataggattactcagaaaaaaaaaatagctgggcgtggtgtctcacgcctgtaatcccagcactttgggaggccaaggtgggaggattgcttgaggccaggagttcgaaaccagcctggctaacatggtgaaaccccatgtctactaaaaatacaaaaattagccagattggtggcgtgtgcctgtaatcccagctactcaggaggctgaggttgcagtaagctgggattgtgcgactgcactccagcctgggcaacagagcaagactccgtctcaaaataaataaatacatatatatatatgggattaaatggtgagtggaattgtaaaaagaaaataggaatggagaaaaggaaattcctgtaccccttctgcttgatcaagactttaggacaagcttgtccaactcactgccaaggatggctttgaattctgcctgatatacatttgtaaactttaatacatgagattttttttgtgatttttttttttttaagctcatcagctattgttagtgttagtgaattttatgtgtggccaaaaacacttcttctttttccagggaataaggcccagggaatccaaaagattgaacacccctgctttagaacattgatttgtatcagttatatataaaagctgattagccatctttataggtcttaattttatcactacctgtaaggctttttaaaaatgtagttcttattttaattagagttataaatgcacgtgatttaaaaaagaagatatttccacaagcgtgtcaagaactacgaagggtctgagattttaccctacttgaaagttaacaagcctgttaacaattttcatggatcctggcaaaagacacagactcctgggccagagatgaagtgccatttatgacctatattaagcagtagcagaggatcagcatttttcttttaggttgctagagccttaattcccacagggcagtatgaagagggccaagtgataactacaaacagtgggttgcattatgggaaagaaaccctgagcttagagaagccaaatcttttatagtgggcagtaagcatgctgtgctttgccccaggtaacattgtctttattatattgtcagtaagaaggtttgccctttgctagggagggaaacaccatctctgtctttctaggctgtttgctataaaaatagccttgaaaaaattatctggaacaaaaagacagtgcctcacttgcaagatgtacagaaatgcaagccacccatggcgaattgcctcccaacaaagagttgtacttacgaaaaacagcatgcttctcccaatggccccccaaatctcctactccctaaaactccattgtccattagaaatataatgtgagaaataaaattttctagtagcagcattaaaaaaaaaagaatcagggctgggcgtggtggctccatgcctgtgatcccagcactttgggaggctgaggcgggcggatcacgaggtcaggagatcgagaccatcctggctaacacggtgaaaccctgtctctactaaaaatacaaaaaaaaattagccgggcgtggtggcaggcgcctgtagtcccagctactcaggaggctgaggcaggagaatggcgtgaacccaggaggcagagcttgcagtgagccaagattgcaccactgcacttcagcctgggcaacagagggagactccatctcaaaaaaaaaagaactggtaaaatctttttttatccttttgagacagggtcttgctctcttacccaggctggagtgcagtggtgtgatcatggctcattgcagcctcaatctcctgggttcaggtgatcctcccacctcagcctcctgggtagctgagactacaggcatgcgccaccacaccgggctaatttttttttttttttttttggtagagatgggagtctcactgtgttgcccaggctggtctcaaactcctggactcaagtgatcctcctgcctcagcttcccaaggtgctgggattataggtgtgagccactgcatctggccaaattaacagtatattatctttaatctagtatatcaaaattttataatgttaatatgtaaacagtataaaaaagtgaaatattgaaatgatacatgtgtctaatatttgtattacaatgtaataatagtatcttacatgatgtcattaaagtgaaatatagtcctaccgaaacagtaatgtgtttaagggaaagacatttaatactgcttcaagttttaaaatgtaaataattaaaattttaaaaaagtatttgttgagactagcctcatttcaagtgctcagtagttgcatgtgactactagctaacattctctactgcatagccctgaagttaaccattttcaactttttacagatttctttaggtgtgtattttcatatctctaaataataatgcttatatggtttctaaattattcagctttaagttctttctactattaaggaggggttttttttttattgttttttgttttaatagagacagggtctttctctatcacccagtctagagtgcagtggtgcaatcatagctcaccgcagcctcgaactcctgggctcaagtgatcctcccatctcagccttctgagtagctgggtctacaggcgtgcaccaccacacccagctaatttttaaatttttcttgtttttgtagagatggtatctcaccattttacttaggctagtctcaaactcttgggctcaagtgatcttccaacctcagcctcccaaagtgctacgataacaggcacaagccaccacacctgaccattaaggagggtttaattctctttcaaccaaaaccctccaccacacttgcactcatttcctggctgtctctcatccccaaagtcaatgattctgaaaaactttttgtcgtgtgtgtgtatttttaaatatgagatggggtcttgctatgttgattcaggttgttccaggctgatctggaactcttgggctcaagtgttcttcccgcctcaaccttccaagtagctgggatcgtaagtgtgtgccaccatgcctggcctgaaaacttttttatttcagcactgtttatactttaaaaaaatcactgaggatcacaaagagcttttgtttatgtgggttatatctattggtatatattctatcagaaagtaaaactgaggctggacatggtggctcacgcctgtaatcctagcactttgggaggccaaggcaggaggcttgcttgaggccaggaattcaagatcaagtttaagtccagcttgggcatcatagtgagaccctatctctacaaaaataagcagccaggtgcacctgtggttgcagctacttgagaggctaaggtggaaggatccccaggagtttgagcctgcagtgagccaagataatgacattgtactacagactgggtgatggattgagaccctgtcttaaaaaaaaaaaaaagagagagaaagcaaaaaacttaagtattacttctgtgaaaataacaatgataagccctttattttaacataagtaatttcttgtgaaaatcttttcagaaaaattggaagaataacagtgtttttgtatttttgcaaatctcttttactgtttgacttaatagaaaatacctgaattctgatacttctgcacttattctgttgaaaacaaacacatcatgtagaccctggaaaactgcgccgtatataacacagagggagtgaaaagggtgcagaatggcctagtattattatgaaaatagttttgagaccctctgtatattgtcatgctttttgtttgaccacaactcaatgtttatattactatagccatgtataaactgagcatagcataccatgattgcttttttttttttttttttctgagatggaatctcactctgttacccaggctggagtgcagtggcaccattttgggtcactgcaacctccgcctcccagattcaagtgattctcctgcctcagcctccagagtagctgggactacagactcgtgccaccacacccagctaatttttgtatttttagtaaacacggggtttcaccatgttggccaggcttgtctcaaactccagacctcatgatccgcccaccttggcctcccaaagtgctgggattactggcgtgagccgccgcgcccgaccatgatttcttttattgtacatacttgttggcatattttactcacttgtactcaatggcattttttcatattgtttgtttattatatgtacttttatgttttttggagatggagtctcactccgtcacccaggctggagtgcagtggtgctatctcggctcacttcaacctccacctcccaggttcaagtgattatcctgccttagcctcccaagcacctgggattatgggcgcatgccaccacacccggctaattttttgtgtttttagtagagacagggttttgccgagttggccagcctggtcttgaactcctgacctcaagtgatcagcttgcctcggcctcccaaagtgctgggaggcctgcattttacttatttaattctggcctgcacctggcctgcattttacttatttaattctgaactctaccttagttatcaaaatctcttctaaatccattaatttacagcaggggttctctgtttctctcaaatattttctggagctgtttacttgctttaattaaggactggtttcttcctagtactcccacacaaccatcatcttgggatctgtctttgtaatcctaggatttctgttgcctctcatttatattgggtcccttgattactggatcctgtctcttccttttttttttttgagacaaggtctcactctgctgtcacccaggctgaagtgcagtggctcagtctcactcattgcaacctccgcctcccaggttcaagtgattctcctgcctcagcctcccaagtagctgggattacaggtgtgcgccaccacatctggttaatttttgtattttcagtagagatgaggtttcgccatatcggccaggctggcctgaactccagacctcaagtgatctgcctgcctcggcctcccaaagtgctgggattataggcgtgagccactgtgcctggccagatcctgtctttttcttaatgggcagtagagcgcaaacttgggggccagattatgtgagtttgaagcctagctcttctgcttactagccatatgacgttcgaagagctatttaacctctttatgcctcagtttccttatctggaaaataatactttctatgtagcattctcctgaagattctatgtgttaatacgggtaagccatttagaagagttccagagcatattaagcactccaggttagtgatgttgttaatgctcttacagttgctggtgaatttcatcttttagtggcatacttctcatagtaacctgctgagaaaggtgcatgtgactttgctgtataaaaatgcctttctgttacatcacatttgaccaatagcttggctggttatttagaattccaagttgaaaacagttttccttcagaatttggaaagcattgctctattttagtctacctttcagcagaaggtgggctgtaaattgcacggtctcagctttccccatagcctgctttaggattcagcttcctgagatctccaagtcagttatcattcactacctctaattttcaaatttttgatgctactacttcagttatattctttgtgtttgagggacttagccttttttgaaaaattgcttattatcattttatcttaaacagagtatgcttttagatatcttcagttcctgcaagtttgtggggaactagaaacagaactcttttctggcagtcaaaagagaagaaagaatagggctgggtgcagtggctcatgcctacaatcctagcacttcgggaggcagaggtgggtggatcacttgaggtcaggagttcgagaccagcctggccacaatggtgagaccctcatctctacttaaaacaaacaaacaaacaaacaaacaaaactagatctaaatttttagcagaagagcttggccggttcctcatggccagccacagttagggtctcagcagtttgttcagtgtgagaccacagaggagctaagcagctcactgcagggagtcacagacaggtatcagagactaccctccaagcagggcaaggttgtggtggggacagagaccaaataccctaagatgagatgaggctatgaaagtgcaattggccagaaagaactccaccctgaatggcaaggccttcgccttgtgatcttacctgtttcctgctccttcccttgacctaccttgggtggcgtttgggctccctcacttgggtcacagtcctccgagatactggcatggctttgacatcaaacacagtagttggtattttgctccagtcacagcagcctctgggacactgaacagtagtccttggagagtcagtgaaattgataagtattcactgggactagaagccaactgaacttagaccatgcttcctgctgccgaagggcaataggttggtgacccaggtttatccatcagcggtttgtttatgcatagatgtgtgcatatgcttacgtgcatatgta

SEQ ID NO: 6834 - DNA, 7013 bp, mus musculus; identical to SEQ ID NO: 6833

SEQ ID NO: 6835 - DNA, 7013 bp, mus musculus; identical to SEQ ID NO: 6833

SEQ ID NO: 6836 - DNA, 1059 bp, mus musculus
gtctgtctggatgtctgagtatctctctgccctacttttttctttatctttttcaaagttgtgcatgcttggccgcaaagtgcggtgggaagttgggtaagccggggatgaggagagaaacaaggttgcgcttttgtgtggagatgtgtgaagatgtgtgaaaaattggtaccctgatgtgcttttcgtctttcatttatatccgtaatcctgcttgaaatgtggattatttattcacactgggctggtctcctcctggaacgccagggagccgctgccatgaattttcatttggtggctgcaccagctgaggcagaggtggtcttgtttctccaggagtattctttctaaccttctctgatgttttaaacagaggaaagttgaacatgaaagaaaggaggatgtttttcatcttatagtggacaactgactctaaggagggaagcgtggtgcaaagagagactgctgatccctcaaatgtggttgagataaattatcaccatgccttctggctatctaattcctccttctcacccaacagcctggggattttagaagagtaaaaataacaacatttaaaacgtgtgtggcatttttccttctaagcactcagaatgtttcctatgtattttaacaacagtagttgccacctattgaagattgactccatggcagacactggctttgcatgcatgatctgacagcatcctgacctaggtgctgttatgcttcccattttgtggatgaggaaactgaggtttacagaagtcaaatgaccttcttcaaggctataaagacgatgagtgccccagatagtaactaaatccctcaaagtcatggtgaggcaagaatattctgccccatttaacagcaatctttgtgaatgaatggagagttaaaggacttgccctagttcttatcttaagtggcaaagcagccttctctgaaccctccaactagctcaactggctcttgtcttatctcatgcctttcttcatagcacttactaggggtcgttatttctatgtgttcttattattgtctacactaggcattaag

SEQ ID NO: 6837 - DNA, 142 bp, mus musculus
caatatccaatttgtaatgcttatgagtcaggtcaaatggaaacattgcacaaagatcatgactataaccacagccacttggaaattaataactttttttaaaaaaagaaatttctggaaaggaaaacctttagaaaagatg

SEQ ID NO: 6838 - DNA, 1025 bp, mus musculus
aagtggagaacttctcaggtaagaatgcttgggaagtccccacctgcccttgtgacagggatcaatgaaccctgtcaatgaaacccgccctttcccccctaactttcagctcttacagagatgtgcctgacatgcaaagctatcgtccttagatcttcttttagactttcctgacaaacaaccataacttcctgatattcaaccctgtgctttgtttctgtatgagtatctaactcctgtcttccccaccctccccacccacattagcttgatctggttatagagtatttgatatctccaaacttatttctgctcaaaccaaagtttcagtccttgtcaacaaagtctattgttcccaaatgtctgtattaattcccatatcaaagccaaacaaactaggctccaggtgaatttcattagcattcgcatcctcctcaaagagagtcagttgggagaagagcgaaaagaactttcagtagaagcagaaaccctttcacttaccagttgtctaattttgagcaagccacattacttctccagagatgagattcctctctgcagaaatggaagataattaaattaaatgactgccaaaccttgctttgactttcaacgcttattaaactttgattcttctgtgtttggcagactctgctatccctgcctctggccagtcttactatgaagtaacagaactgactttactgaatttgttcttttccttccctgttaagctattatcaacctgctctttcatgctagctattggtccttccttcattggcctctccctcagattaagtgaagattgtttgcacacgcactcaatacgggtttatagtagatgaaattgtgcatatgtttttcccaagccagaagcttgagcaataatgcttatttgtttcaggcttacacttgagaattggtcaaaagagtcatttatctggtaaaaccataactcaataggcaaccacattcatttaatgttttccaaaaacatttcttgcctcttggctcttaatagc

SEQ ID NO: 6839 - DNA, 891 bp, mus musculus
caaaaaccaacactggactcagtggcaaggaccgggtcaggagaggggtgaggtctctgtgggaggagaggccccagccctggctcatcacccccttcctggggcaggtgcctgggggcccagcctcctctgtatgatctgggtgtgatctgggagctgtgctgagctcctgagagcctcccagtagagcctggattcgcctgtggctgcaccccggccacatgtgctttttcctccttcaccacagccccatggtaccctggcctcctctccattctcatccaaagcagaatcctactggcagctcagaggcgcctgtgggcctgagcctaggtgttccttgagcggaggagcagggactggggacagccaggttggagtcacacagacaacccttccttgcatttccctaagaaggaaaacagaaaacatttcattcacggtaaacatgagtaaaaagcacacacagagctccctgagctagaggctgagagccgtgtccctcatgagcactgcgtgtgtgcagctggtctggggagaggagactgagaactggtcccagcccctcatcctttcttgcctctcagcctcaaagggagagaagcgggaggtccaggagcaggaagatctcagctctgaaaggtgaggctctgctgccccccgggactccccagaggtaactgagctttgcctgtccctgaggaagtcatttgcagaggcctgagagggaagctcctgggagagaaatcagaacctgcggcctcctcagattccctgcgggaatgaagccacgggcctgggaccggtattgcccataagggggcggtgtggggaagggaccaaggcctgcctggatatggggggaggtcagggaggctccaggtccatgtg

SEQ ID NO: 6840 - DNA, 821 bp, mus musculus
agaatggaagggcagaagttgcctaacgttgcctagtgcaagcctggcctgcgagtctgctcagagcacaattgcagtttgtagaaggcagccccaggggactcctgggcagagagagctaataccagctaggtgatcacaactccccaggaatgctgaccacggagggaggctgtccaagggtctacgagatggcatccctctgtagacggcctccctctgtggatggcattctatgggtgaattgatacaattcattcgtcttattcagatttccctattatcacattacgagtcctccatggggactcatcaggattcctttgtggtctgaaatgcaggaaattgagctctttgggtcagaagccaagttaaacaagacagactccagatgctctgcaagatggatgcagatgccagcggcaccaaggttaaggtgggaggcatccactccacttcctcccatgggagtctggtccttccagggccggtgggcaccgttcttccccatgctgcaatggtgttgaacaattcctggggtaaaataaagttagtaaagacaacaactttcttatgtgataaaaattagcaccaagaacagagaacaaataagagcagcttcatgggcaagcaacccaggcaggtacacaggtctccactgtcagaagggccctgtgcttggcttaatgctctcctgtcaccatcttcaaattctaaataattgtgaacgaaggctctttccttttgcatcatgaagcgggtcctaattagcagtataggagaaagtagaatctttaattgcagtcaactggcttggagtc

SEQ ID NO: 6841 - DNA, 4090 bp, mus musculus
atgtcaaaaaacatttttctacaactaagtgcacatttaacttgtgtcacaaaaaaggtctcaaaagagcaagggatttgcagtgttttcaggagctcaccagacacctgaaaaccctccttgctgaaccactacctgcccaggtgttcactgaggtgccagacccagcaggctgaggggtacaggtggagttaaggaggagctaagtggcctggtttgtttctcagtttcgtgctttggaatgaagtagtgtcacacatggaaaaaaataactgggaatgttgaattaagaaaaaatagggagcaagttctaaacactatttggaagaaaatgatccctgggaatgctaaagagaatttgagccatgagctgttcctgtagtcagagttaagcattgtgagttggcaaaagcatcaggcgggaaggactgagtctgtgtgtgcaggaggaatgcctgcaggggaaagtcacgggctccgtccctgtctcagttggtgggggtggcagagatgccacagccgtggccaagactacgctgggtgaaaagtgagactctctggatttgccatactgactgaaagctgatatctgaaaagtggagctgagaacagcagcctgggccactgtgggcagtgactggaatggagatggccatttcctgccaaggtggcctgagaaagaggaggttggagaccaggacaaggccccgggtgggtgccggtgggtgccagtcctgagaaggtatgcacaggaacaccatggacattgtttattcccccaattaagtagcccaaaaatgtgccataagctgtccttgcagtgaaccagtgattctgcccaaaccatcaccaccaacatacccaggtcaactccggcacaggaagtcacatggccagaaaagggccatcagccacatcggtgctgacactgagtgcagcacattcttctgccacctgcttgcgaacatatctgcaatgcaccatcaaagccacacagagtgtccctggcgtgtgcctggaggttgctccgggtctgcagatgctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttgttcctacaaagttactgtctcagtttgagctgatggtgcagtctgctgttctgcaactacataaaaagtaacctgggccctgcagaggggacacaagcatcggggccaggtacacagtgacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctttgagggaggaccgggcagctggagagggaggcgtcaggaagcaggagggcagaaggtgaggagtgaagggcagcagtggaaaggacagggttacgccaagcagtggtcatggatatgggcagtaaggaacatgcaccaagggcgcctggaaaacgaaccttagagaacgcaagtcctgcggaggactcctgggttcctggctgggacaccgcctgggcagggaaggcagagaagatggagaacctggtctcaggtggcatcagaacccagcatccgcatcaccaggattgcaggagcagcagcgtctcaggccctgggtgtgtcagagcccccaggccacgtggaagtatgagacgtgctgggctgcaggggaaacaatggaaatgaggttggaggcccgagaagacccactgcaggaaaagggtggagtgggggaaaagcaggctgggggcagtggctggcctgcaacaaaagcattgtagaatgcaggcgtgagccaccgcgcccggccaaggcgggcagatcatgaggtcaggagatcgcgaccatcctggctaatgcggtgaaaccccgtctcttctaaaaaaaaaaaaaaaaaaaaaactgtagaaaggggaaagcagtccaaagagaagtatttcttccaagagactcatcagcacactgtgtttccagagatgtctttctgttaacagcattcttagactcaaaagtaaatgtagatatactttaaaaaacaaaaacaccttgctaagagatgaatttttagaaacttgttggacaaagaaaagtcattgatagtcaactgctgtgagaggcaagccaggaaatgatgattaataccctcaaattataataaaacccatgcctcattaggggctcgcccaggagtactgacttgtggatagacaccgtctggggaaaactctgtcgcctgtgtcaggctgatgctcttacattttatagccccttgtaggatagtgcatgttgagaagaagccgcttcacatcatcgtggtgcaggatctgtggtgtggtgtgcttcatgtgtgtgttttgtgtgtgtagtgtgtatgtagtgtagtgttagttgtgtgtactatggtgtgtgtgtggcatgtatgtagtttgtgtgtggtgtgtgtgcagtgtgtgtgatgtgtgtagtgtgcatgtagtgatgtggtgtggtttgtgtgtgtttttatgtgtagtgtgtagtatgtgtgttgcatgtagtgtgttgtgtgtcgtgtgtatgtagtttgtgtgtgtggtgtgtttgcagtgtgtgtgggtgtgtactgtgttatgtgtgtaatgtgtatgtagtttgtgtgctgcacgtagtgtgttgtgtgtactgtgtatgtagtttgtgtatactgtgtgtagtatgtgtgcagtgtgtgtgtagtttgtgtatgacgtgtgcagtgtgtgtaagatgtgtgtagtgtgttgtgtgtgtagtgtgtatgtagtttgtgtgtgtgtggtgtgcgtttagtgcatgtgtggtatgtgtccatatgtgtggcatgcatgtagtgggcatgtagtatgggggtgtatgtgtgtggtgtagtgtgtgtgatgtgtgtagtgtgcatgtagttgtgtggtgtgtttcgtgtgtgttttgtgtgtgtagtgtgtatgtagtgtagcatgtgtttagtatggtgtgtggtgtgtatgtagtttgtgtgtgatatgtgtgtagtatgtgtgatgtgtgtagtgtgtactgtgtgtggtgtgtatgtattttgtgtgtgtggtgtatgtgatgtgtgtagtacatggtgtgtgtagtgtgttatgtgtgtagtgtgttgtatgtggtgtgtatgtagtttgtgtgttgtgtgtgcagtgtgttatgtgtgttgtgtgtgtagtgtgtatgtagtctgtggtgtgtgtgatgtgggtagtgtccgtgtagtacatggtgtgtgtagtgtgtgtggtgtgtgtagtgtgttgtatgtggagtgtatgtagtttttgtgtgttgtgtgtgcagtgtgtgatatgtgtagtgtgttgtgtgtgtggtgtacgtgtagttggtgtgtgtgatgtgtgtagtgtccatgtagtacatggtgtgtgtagtgtgtgtagtgtgttgtatgtggtatgtatgtaatttgtgttgtgtgtgcagtgtgtgttgtttgtagtgtgttgtgtgtgtggtgtgtatgtagtttgtgtgtgtggtgtgtgtgtgatgtgcatagtgtgcgtgtagtgcatggtgtgtgtgtagtgcagctgtggcatgtgttcgtagtgtgtgtggcatgcatgtagtgtccatgtggtatggagtgtgtgtgtgtggtgtagtgtatgtgatgtgtgtggtgtgtggtgtaccgtatgtgatgtgtgtagtgcgcatgtagtcatgtggtgtgtttcatgtgtgttttgtgtgtatgtaacgtagaatttggtgtgtgcggtgtgtttcatgtgtgtggtgtgtatgtagtttgtgtgtatgtgtatgtgtgtggggtagtgtgtgtgatgtgtgttgtgtgcatgca

SEQ ID NO: 6842 - DNA, 4090 bp, mus musculus; identical to SEQ ID NO: 6841

SEQ ID NO: 6843 - DNA, 4090 bp, mus musculus; identical to SEQ ID NO: 6841

SEQ ID NO: 6844 - DNA, 885 bp, mus musculus
aaaaggtacggagggagttttttatttgttctttcctgggagcaaataggactaagagttgacctactggaaagctgttggccacaaagaggcctggctcaggtgtctgcagctgcttctctggagcaaggacagtcccatctgcacaatttccctatgtcactggtgggtcactagccattctgtggtgagcttgacaatctcagcagccacctgactgagatctcaaaacacatcacccatctacctgtgtataactcttgtgcttggcagactttgtatctgagctttatcagaaactgtggtccccacttacaatgaagttcctgtgaggtcagagctagggagtggcagccttattcatagcagtttttcaataaattggaaaggcttttacaatgacccatagatactcatttttcttatagtgaactaaatatatgacataggctctagtaaatctcagatgtgtaatatcatagcttatgatgagagtttaaattggcctagattttcagtatcaaagttttaactgttcatacatttgctccagcttttcttttcctaggatgccccaggtatcctccagaaacacttacaataagggtacacagatgcatcaaggacattcatcatgccagtgttcatagtagtgaaaatttgaaagcaatttaagtgtctgtcaacttgttagaaataattcgtacctctataaaatagcgtcccatagagctctttaaaaggatgagaaaagtctgtatgtgctaatacatggaagtatgttgacagtatattaagtgaaaagctacaaaatcagatagaatattacctcaattagaaaaataaaaagaacttacacatttacctatatgtttgtttgtatat

SEQ ID NO: 6845 - DNA, 183 bp, mus musculus
ggagtaggtacaggtgtagatgcaggtatgggtataggagtaggtacaggtgtagatgcaggtatgggtataggagtaggtacaggtgtagatgcatgtatgggtgtaggtgtaggaacaggtgtagatgcaggtgcaggggtggaggtaggtacaggtgtagatgcaggtgtggttggaggt

SEQ ID NO: 6846 - DNA, 181 bp, mus musculus
cactgttaatttgggttggaactgaaaatatactttctgtgtgtgcctactgctactgtagtgaagttcttgagccaggtctgttcagtcatattgttgaaaaactgtatgaatatttatgaaggagaaagagctgataggtaccatgaacattcactgttgtatatgcatatggtttata

SEQ ID NO: 6847 - DNA, 1038 bp, mus musculus
attatgttaggcagtgggaaaaatacaaagacaaagaacttgaggtttctgccttggaggagatgaaaatttagctggagggacaagcaaggcacacccaaaggttccaaagcattcaataataaagagcagcatgaactaataagatttgcatttatccagtttacaaaaaggataagtaatctgattggcattccaactgttgtttttggaatttctgaggtatcatagtaatatgaaatggttctgttttttagaaacaataaactcagcatctgtgaatatgaatgaacatgccagacacggttggaggaaagaacatgtttagagtcagaatatctgagcttctggtgcactcacttggctgattcactctggggaacttatttaacctcaagtcttgattttctcatctgtaaaaataacaaaactaatagcacaaactgtggtagattgattgtatcaatgaccataattaatggtgtttctatagcaacatctttttctgtgtactgtaactctgggttggccatgttatttgctttggcaagtgggacagtagcaaatttgatgcagtctgacacatgaaaaagtatacctgctcattcctttcctcctctgcctttatcataagaaattcccaaacaaggggaggggccatgtggaacagagtcaagatagcccatgttgtccagttaatgcccaagacatgtgagagagtcctgttaaggtaatcaaaactacctagatgacctgaaactgatcaaagatgtgtgaataaaccctgttgagctcagctgaactgtgcagccaatgatatcaatttgtaacgaaagataggtgattactgttttatgccattgaggttttctgctagtttgttatgcagcagtagctaactaataaaatacttcattgctactgtggagattaagacaatgcatatgaatgagttttgcaaactgtgaggtaatatacacatgagtttaaaaggtcttaagatcaatagattatttgttggagatgaggacatagaac

SEQ ID NO: 6848 - DNA, 639 bp, mus musculus
aacagtaataaaatccatcaaatgacaattttgtctttgtttcagtatttatacagtttatttcaatatctagtgttagtagtcatccacttacaaaccatcataaatatcaatggtggtagtgagtaaatatttcgtgatctcactttaatgagaattaaacttgtgtttcatttttcactttgatgctagctgttagtttgatatatagacaaaatcatttttaaaggtacaaggggactctctgtcctattgttgctgtatttccttagttcagctaaagatggggtccttatcacatggccattaaagattaggctcgcagacaatttgaaaagtgaatgaggcagggttttattgggagaaaaggacagaaagaggaaacagagaccttctgcaaagccagagtccctgctggtgtgcttccagcctcacagttggaatcccaggttccacacaggaaaaggcggggccaggctcctccctgctgcaaatggggacaaacttctgtggctccaccccagtgcgcactgcacccagtgtgcaggctggttggagttttgccagggagtgcttcccacctgactgtctcactatctttgcaacttcctgtaaatctataattactaccaaataaaa

SEQ ID NO: 6849 - DNA, 1468 bp, mus musculus
tttaaatcacttaaaatctgaaacttaaatagcaatagatgtccacttagcaagttagcatggacctatgctagaaaacagtttctgttttttcttaaaaatgagaggatgtttcatttgacccagccatcccattactgggtatataccaaaaggactataaatcatgctgctataaagacacatgcacacgtatgtttattgtggcattattcacaataccaaagacttggaaacaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacaccgcatattctcactcataggtgggaactgaacaatgagaacacatggagacaggaagggaaacatcacactctggggactattttggggtggggggaggggggagggatagcattgggagatatacctaatgctagatgaagagttagtgggtgcagcgcaccagcatttcacatgtataaatatgtaactaacctgcacattgtgcacatgtaccctaaaacttaaagtataataataataaattaaaaaaaataaaaaataaaaaaataataaaataaaatatttacctgtaaaaataaataaaataaaattaaattttaaaaaatgagaggatgtaagcataccatttctcttcttgacaaccataagagtggaattgctgattggtttgtgtagagaacagagaaagtgattggaagggaagggaggtgatttatgagacgtgttattattattttcttggtatttttaaaacaacttaatttacaaatagtagttgtgtctatttatgggatacaaggtgctgttttgatatatgtaaatattgtagaaagatgattgttttagtgacaggattctatctacctcacactctgattatatttctgagagttgtccatcccttcctcccagctcttggtcttagtttatatagagaaaaataagaaggaaaaaataggaggaaaggaatgaccaaggctatttatatttaatgtgatcacaagtgtcatttgggtggccttagcttccatttcttcatatataagattaaaaaatataaaaataataataatagtgatatatgcctacttagattttataagaattcaataaataattaatgtaaaatgtatttgtaatttgtaggtgctgtttaagcatcaggttttaagttattaaatgtgttaacatggaattttgcacattacacacttttctaaggcagatcattttcttctcaagatatgtaatattctatttctaagcaatatcgtttttatatatttctatcattaattatgctgaaaaatacgaaagtaaattttcttcaatagatag

SEQ ID NO: 6850 - DNA, 194 bp, mus musculus
atttcttagtttcacttttcattacctgttttctcatatttatttattacctatcaattaccatagagcaggcacttgtatttcttactactatgccatacttaaaagattgagggcacgtatacactcattaaatacttgtgttaggaaaaaattgataatactcaataagctctgaagacaaatggtctgtg

SEQ ID NO: 6851 - DNA, 1386 bp, mus musculus
acttgaacccagaggatgaccagagaaaagcagggtaccaaccacagtcaggccaccatgcatatttccccaatcctgtgacaaacaggactgagcctgctctgtgccaggctctgtcctggatgctgcagggacagagatgagacagactcagcctcgaggggcggcagccatgagtaaacaggctatgcttagtagagtctggattaagacccacacagcacccatgggggctccgtggagaaagcagctccaatcccaagggagctgcacctataagctcgaagccaggtgccagggagggatgtggagcatggcctgatcagcatcacttggatgaaattcccttcagaataggtgacaaaaagaaagggctccatagacaagtcaagggaccactggagagcccaataaacatcaatatgcagaagagagaagcaacagtataaatcccaaagtaaatgctaagtctaaagccagataaaaggccaagcaggtgttagcaatggcatggcgggcatctgggaaggccagatcagtagcagaggccagagccaagcaagcagaaatggaacagagtgacccagacatgtttgtctgggtctttatgctacaccgccttccctacctcacagctttattcttgatttatctcccacagctgactctctgccagccttgtgcatcaggaacttattaacactggtgccttctagaactggggaagatccatccagagttaggcttttttttttcgagagaatcttgctctgtcacccaggctggagtgtagtggcatgatctcagcttactgcaacctccacctcccagattcaagtgattctcctgcctcagcctcccaaggaggtgggactacaggtgccgccaccatgctggctagttttttttatttttagtagacacagggtccatgttggccaggccagtctcaaactcctgacctcaggtgatctgcctgcctcagcttcccaaagtgctgggattacaggcgtgagccaccgtgtacagcaagagttaggtattttctgctaacgttcctcctacctcctcttccccgccagccagctgactttcccaagatgagctaatggccttcctttaaaagaaatagtgtcaggctccttttctaactcacatttttccctagcatcattccatccagagcttaaggttgctggtgacctggtggtgttggtgacttcaccattctccctctgggaaatgaagtgactcaacagtcacaaacgcaaagataacagtgccatcagcggttccttgcagagcaaagaaatgccagggttattaggtgtctgaataaagctgaaggtcctgaggttaacatagcaagaaaaaatgacagtgtag

SEQ ID NO: 6852 - DNA, 1192 bp, mus musculus
aagaaaatagcccagaattatgtgatcctaacaagtccagtatttttcacttgttaattattttctgttctcatgattatgtgtaatcttttatgcagagatatcacattagatatacttttccccttatattattacattataagcatttccatatattagtactcatggttactgttttaaatagctgcctattatgctgtttgttgatgtctcagcatgactttgtttatatgagaggtattaagcttatgctgtaaacacctttattaatctgagattttgtatgctgttttgttagaggaaacattctattaatggtggcatatttcaagtaaaagcatgtgctttttatttttaaatcgcttatggcaaaaattcattttcagttcaataaagtatgtgtttgtaagctttgtcatctgccccttgactggtagatgtgcaggctaaggagttttaagtgtttggttttgcttttggtagttgtgtgtgtgtatgtgtgtgtgtgtgtgtgcgtttcttttcagaaggggcgggtaatgtcttctgttggaacatgcactccaccctctttgataaggcttgtggtaagatttgcatcactacccatgacagtcatcctcatagcattaagcacacagctcttagctcccataatgatgtgtggagggtggagtgtattgcagccatattcacctttcatttgtgtgtttgatgtggcatttatattaagtaggagtaattttttttctgatttttttttcttgtgtcaccagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactaggtaattgtttttctcattattagctattgcatagtattgcagaagaagactgttttgtcttttagccaaaatatgaatacaactggggatacttgtaaaatgtttaacttcccatagccaaaatcattgtttcagattatatatagttaagaatatgtacatataagtatgtatatatatctgaaactcattcccttctttttttctttcattggagaaaactagtgttttcccaaacgttgt

SEQ ID NO: 6853 - DNA, 1094 bp, mus musculus
atttatacaactcaacctccatttgtgaataacaacatcgactctccagagggcagtattttcctaggaagtaaatccacttagtctgaaaggatattgtagcagtcagtacaggttaggttacatagtccatcgtgacaaataggacccaaatctctgtgacttaaaacttcatgatttatttatcccttacactaaatatccagtagaaatcagcggggacctctgctcactgtatgtccttggggactcaggctgaagaagcaacaacttttggatattactagtcaccatgtcagaggaaagaggactctggagagtctcaaatgggcaagtaatgctctgatctagaagtgagacacatttttctgcttactacttattggctggaattagtaatatggtcttgggtaattagggtaggctaggaagtttacccaatcatgtaccgagagaatggataattttttcttttttctttctttttttttgacggtgtctctctctgtcgccaggctggagtgtagtggcacgatctcggctcactgcaacctccgcctcctgggttcaagttattctcctgactcagcctcccgactagctgggactacaggcgcacaccactacactcagataatttttgtattttcagtagagatggggtttcaccatgttggccaggatggtctcaatctcttgacctcgtgatcccccaccctcagccttccaaagtgatgggattacaggcatgagccaccgcacctggccaagaatggataattctttacatttagactcactaactataaacaactcacacaggactcacaagaactcactaaggacccacatagccagctaccaaaactgtatagctaccttcatgcttagtggcaaaatgttaaaacctttttccataaatccaagaaccagacagggtttaacattataatagagatcctaaccagctcatcaaggcaaaattaatgaattaattaattacactaataactaatatatattctttatgtatgaaatccaaaacaaataaattaacaaataaaattaataacaaagtagaacaagcttgctta

SEQ ID NO: 6854 - DNA, 196 bp, mus musculus
cagttatgttagactgagttgcttttcagcctcagtttgctgaaaggttatctccttccacatgcagtgtagagtcaataatttactaattaactccatgagcataacccacattcctaaataaatacaggattcatgcagcctatcgcatggataagaaatccctcaatcttcactgtactcaagattcttaaaa

SEQ ID NO: 6855 - DNA, 1146 bp, mus musculus
cagatggaagagcataaagcaagaaaatcatgaagatggaaatgaaaggtgtctggagaagtatagaatgagcaagactggaattcatggtcaagcggatgaaagccttgaaggctaggttatgatatctgaagttgattctttgggcacttgagagtgatgaaagttgtttatggggctaagttgtgattagaatacacttctcattctcagttaagaatggctagatgcaggtgaactatcacaggtggttgtagtatagagtaggctctgccagacttggcttgcataggatcttggcagcagaacagaggatataatttggacaagtgaaatgaaggtaaagataaaaagcaggttacctcccttcagacattctcttcctttaacatacatgtggagaatggcattagcattctactccaccaactgggacagtttgataatttttattaatgtgtggcctactgagttacctcagccttcatccatcaagccctgtatcatgccttcggcccacgcccagtgcctcagaagcccatatatcatcccttcaggcagggaagcagattcccttttatttcccttgcaaaagcacagatgttaccgcacccagccttgtctggggttcaggcactgcttctccctaaatgacctccttggaatcttcattcccattgcattccagacagacaggcttttcttttgttccttcactcaagagctgcctccaccccactcttccaattcatgtgtcatgggcaacatatttgtgttgccacatctgccttgtcccagctgctgagtccatttgcaaggcagatattaatgttaatcattgcctgaaaaattttagaccatgacattctgatgcacagctcattgttagacttcatccacatctcacctttatcactgggagaaggaaggcaacattatgaagggaaaagatccatgaatgggttgtaggagacttgcttctaatgctgaatccctttgtgatcttgagattcccatctatgggcctcagtttctgtatctgtgaagtgaagtggttgaattcagtcatctttgagagctttctatctctaaggttgtatgactttcagcctttagggatattaaatgcatatagtcacccctctg

SEQ ID NO: 6856 - DNA, 1146 bp, mus musculus; identical to SEQ ID NO: 6855

SEQ ID NO: 6857 - DNA, 1146 bp, mus musculus; identical to SEQ ID NO: 6855

SEQ ID NO: 6858 - DNA, 1346 bp, mus musculus
atcagaggaatgcaggaccaagtcaatttcagtacttctgacatgggcgatagggatgatattggatgaggcaatgggaggtctttaatattcttaattgttatcaactattttgctttccactcaagacaggacttttgcttaaactggccatctattgaagataagcttattttcttaggggagataaaaaaaatacatgtaataaattagtaaattttttaataggctacaaggtcacatgtactattattaaaataaaaaagggagtccaggcgtggtagctcacgcctgtaatcccggtactttgggaggccaaggtgggtggatcacgaggtcaggagtttgagaccagcctgaccaacatggtgagaccccgcctttactaaaaatacaaaaattagctgggcgtggtggcatgtgcctgtaatcccagctactcgggagactgaggcaggagaatcgcttgaacccaggaggtggaggttgcattgagccaagatggcaccactgcactctagcctaggtgacagagcaagactctgtctcaaaaaaaaaaataaataaaaataaaaataaataaagaagaggaataaagtagagcagggtaagtgggattagaagggcagggagtaggaaagccacaaggtaacattaaataaaatggtcattgtaggtcagagtagcctagatatcattctgaatctcaggagcctcccatctaaacatcttgttgagcactattctctggacagtctatttctcaagaatttgtgtgaaatatgtgattatacatgaatgcatataaacatatatgaatgtatacatggctagaaaaaggaccttaagataatatatttagtcccctagccagaatttgaatctcctttatagcagcattataagcttagatcaaaacataggtgagaacaattagaaagttcatgagtcaatgatttgttgacacatttcttatgaaggctaattgcttgttagctgaaacatgcacctcagttttagttagagacaccagcataacaaaggattggctaagaatttggaactcttctgtcatatagagctgtcaagaaactattcacaaaggttgaaattctaactttttacatattgccatataaggctttaacagaagcaaattcttactgaaaaattttcatctctccctctctctctctctcacacacacatacacacatatatacacacatgagttaatcagttctttatacaataccgaggtttttttttaattttaactaccaacccctgccatatttgatagtttctgatttctaacactgaaccagattggtctttagagttac

SEQ ID NO: 6859 - DNA, 918 bp, mus musculus
aaaaagatcaaacccatcagtatcattatgaacaatcaacaaggaaatattgagaaggaagatgtaaataagttagtattaaacaaaactgagcattgacattttatgctgcttttatagagacaaacagatcaccagtcgagggctttggttacataggttaacccctgaaatgtgccacatcagctccactaattgaagatcagggaatttcattgaacccattgatgacatggactgttgaaataatgccctttttaggctgttaaatgagcgagaccttggttagcagtcattacccttttggaatgaattacttgcttctttttcatactgcacccttaggaagtcttaatgggcgtatgtgttttatttttctagatttagcaatcacacaagataatgattcaacaaggtctccattgtcttaccttggagacccctgcctgctcaatatgttcaacagttatgtttgggaggtcccagtctcatcaagaaatttcaacctctaacaaaccaaacaaaactattatgtaattttgttgtgttatcctcaaagcaaactttttaagcatctgaaacatcctcagaaatctcccactctactaatcagccttgctaacaaataatgtttatggcactatttaaaatagaactgtaacaacaaagaatttcccctttttaaaaaatttaattgaatttaattttttaagttctgtggtacacgtgcaggatgtgcaggtttgtgacataggtaaatgtgtaccatggtggtttgctgtacctgttaaaccatcagctaggtattaagtctatttgccagtaatacacatgcattatttcatttcctctttacagtatccatgtaggtcattattattatcactatttcaaagatgatgaaatggagactcagag

SEQ ID NO: 6860 - DNA, 686 bp, mus musculus
attaagatttctgtatattagttgataaatatataactacctaaatccagttcttaggttatatctttacttttctttacttcacttatacaaggaagacaatgataatacatgatattatgtgctgaattttagtctaccggatgtgctttgaaattaaagcaggctgggtgcagtggctcacgcctgtaatcccagcactttgggaggccgaggcgggtagatcacctgaggtcaggagtttgagacgagcctgaccaacatggtgaaacctcatctctactaaaaaatacaaaaattagctgagtgtggtggcaggtgcctgtaaacctagctactagggaggctgaggcaggagaattgcttgaacccaggagggtggggatcgcagtgagctgagatcatgcccactgaaatctagcctgggagacaaagtgagactttgtctcaaaaaaaaaaaaaagaaagaaaataaagcaaaaacagatttgttctggcagaagtaatcagaactttgcataacagaggagaataacataaaattacctgtgaagaaatatagactctgagtaggaaagtgagaaagtgttagagaagtttgagaagttagagaagaaagacattcttcaatctaaactttggagaacccttaggttatccacccattgttgatcttcaggtttagg

SEQ ID NO: 6861 - DNA, 220 bp, mus musculus
tagaagaaaatatcttatgccataacgccttgttttcctcatactggaattcttccatggggttttgtttttgcaggccaaccatctatccttattaaaggctgcatttagggatccagcccattgacccagcctgaggagacttgctttgctccctcgttcatcattccctacccactttccaaactttgtgttaattacaaaaaaaaaaaaaaattga

SEQ ID NO: 6862 - DNA, 818 bp, mus musculus
aagggtaatgacaaaaaaaaaaaaaaaaatagctgcgttagcatggacacaaattctgcttatattttagatggcaaatctacattttctgttgagttatgtaagagaaggcattgtgtttgtgttcaaagggcaagattggggaaaatctcaggacactgcctgcattctaagtggcccgactgatggagggaatgggccctgttccaaattgattagttctgctaccttctcattaccgttctgcctgaagtttggcacacaagcaaggtcattccatgcatgggtctgcgtgacttaactgattttgctacaaatttcctccccttccacactgccacccccaccacagcatgccacctgcactcgagaaaattaaaaatcagcctatacattttacatgagttcccaagaccagtgagaaattaatattatgttgtcttttgataaagatacagctgtttttaaagatgttaatccaattcagtaataggaaatcttgtttaaattcctctatgaagcctatacagcaagatggaaaaaagaaatgcatatagactcagaagaatatatttgagcaagttttcatcttgcagttcaccttacaaagaaatttcagggttacatattaggttactgtcctccccaaactcttaggtgcctcattaattctctatgtctatgtttcttttaggttgttcccttagcctagaattatgtcttctcatattcttatgttcaaatacttccagttgttcagggttgacctctaatgtctcattttccatgaagatacctcattttctgaaagtaggatg

SEQ ID NO: 6863 - DNA, 1000 bp, mus musculus
tattcagccagaattattattccatggtcccagatagacaaaggtgcgacagctgacccaagtagggcctagcacacattgtctttcccaggaattgtggctgggagaaaggttcaaatgaatcttacctgaacctgcatagttgcattttcctgcaccaatcatttcaagtctctgaaccccaactataaaataaagagattggactagactgttctcagtgatcacctgcagctccgacactctgtaatcccacgttgagtgctctattgtgcagtgatacaatatggaaattgccagtgtgggtaagtgaaacctcaacatgaactgtgcagatagctggtgattacacaatgggaaatgtcgagaaaataaccttatggagtggaaagtattggattgtctgatgatgacttactctccaatatgaagatataactatgcttggccgctcaaggatgaaaatgtagtaatgtgttaaaatgctaatgaaattggaagcctataatagatgtttagaacagtttaggttaccaagacacaggaagttagagagcatagctcataaatcctgatgataaggccaaactcctcagaacattcaaagccttttatagtctgattccaacttgccttcgcaagttcatctcccctctcaaaccctcatagaccctgttttcaatccataatgagccatttgacattccccatacacagcaggctcttctgtgccatatgcatacaaattctgttgcttccacctccatatttcacgttgctccatctcactctcatcatctattccaattcctcatcactcacctcataggattactcagagggtttcttgactggtcaacccacccctagtctctgttcactctgatccattgtccttacaaccagagtatttttcttaatcacgtatcttcgatcatatctgtctgcttaaaattctttaatgatttttaattgcctttaacacaaaatccaaattatt

SEQ ID NO: 6864 - DNA, 1394 bp, mus musculus
ggcagccaactgacaggccatcagtctctacccagacaccctcttcacagttctagccccagcccggatgccaccccacccgctagtcacccccagcaccgggccaggaagggaggcggcccgggaaggggctgtgggggaaggcacggagtccggaagcccagaggaacagtcttcaacctgtgaatccggccgcgcctggccctgcagcctccccggcccggcagcctccctgctcctgcgtgtcccaatgcatgatgcacagctgacccctgcctgtgagggacccaggccatctgtgaggcagttgccatgagtgactcctggtgaacagcccattggcatctccaagtgctgggcagaggccagaggcaatggctttggacgaggagaccgaggtttaaaacccagctctgccactttctggctggttgacctcaggcaagtcaccagacttctctgtgcctcagtttcctcatctggaaagaagagctatttaactcactgggcacccagtcggtacttggtgcttagtaaacaataggatgaaggaaaggaaggcacagagaccctcccacctgcaggccagacttaaacccagaccctagaccccagaaacgttccagagctttcacgcatgaggaacccttgccaggcccccacctgctggaggcagccgagtcagggtttctaagcgaaactcacacgagtttgtcattcttgaaaaacagtccctttccaagccctatttgacctttccttaatggaccacttgctttcagggccctcatcctgggaggtaggttactccgcccatgtaatggagacagaactgaccccagagggtcaaagcctcttccccaaggttcttcctcaactgggaagaaaaagagtcaggacttgaatccactctttcaagtactcctgtttctgctcccattcttctgctgccttggtggggatgggccttccagttggggacacctgggctgctccgagtccagcctccagagctgccaggtcagcagtgtaaccagtcactccacctcctgcagggttgctggactgtcatctaggaagaagatggtctaaattcaagttccttaggaagtcttggttctgaggcccccggggagcatcaaagctcaagcggagagaaaactgagtgggagggggaggaaccaggtctctaaggaggtgtagagacctagagacatgagtttccttggggacatccctctgtagatcttacctcatccccaacctcctccctcttggaggctttacttatatctcagttatctatgcaacatggagcaggagaaagagctcagagggttaccagctacgtgacctccagaaagtcagaacttctctgagcctaagctttctca

SEQ ID NO: 6865 - DNA, 3058 bp, mus musculus
ctcagaataatctttacaaaaggaaatgagaagaactcaaacaaattaggccacatagaagttcctatgagcacatggaaaacctttagtttctaatttagaagacagcttggcatcctttaacttttcttttgttgaattttactatctgtttctatgtagtttcagaattaaatgttctttcgaagtataatagcagtaagatttttaaaatagatttgaggtggggaagaagctgtcttggtcaaactgtcctttacatctctcccattgcttctctaaaccctatccaggaagtccagagacatggagacaaagaattatagcagcagcacctcaggcttcatcctcctgggcctctcttccaaccctaagctgcagaaacctctctttgccatcttcctcatcatgtacctactcactgcggtggggaatgtgctcatcatcctggccatctactctgaccccaggctccacacccctatgtacttttttctcagcaacttgtctttcatggatatctgcttcacaacagtcatagtgcctaagatgctggtgaattttctatcagagacaaagattatctcttatgtgggctgcctgatccagatgtacttcttcatggcatttgggaacactgacagctacctgctggcctctatggccatcgaccggctggtggccatctgcaaccccttacactatgatgtggttatgaaaccatggcattgcctactcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtaccatcttctcctacctgcaaatcatcgtcactgtgctcagaatcccctctgcagccgggaagtggaaggccttctctacctgtggctcccacctcactgtagtggtcctgttctatgggagtgtcatctatgtctattttaggcctctgtccatgtactcagtgatgaagggccgggtagccacagttatgtacacagtagtgacacccatgctgaaccctttcatctacagcctgaggaacaaagatatgaaaaggggtttgaagaaattaagacacagaatttactcatagaaagaacaaaatgttggcatgtcaaaatcaggacatgacctaaaagattattatcagtttatcctcccttcctaacccttttccacatggcattcaaagaggtcatgaaaagtggtgttggatatcagtaagagaattaacctgggagcaaaacactcagtttctttatatatatatatatatatatgtatacacacacacacatatatatatacacacatactttaagttctgggatacatgtgcagaacgtgcaggttcattacataggtatacacgtgccatggtggtttgctgcacccatcaacctgtcatctacattaggtatttctcctaatgcaatccttctcctagctccccaccccctggcaggccccagtgtgtgatgttcccctccctttgtccgtgtgttctcattgttcaactcccacttatgagtgagaacatgtggtgtttggttttctgttcttgagttagtttgctgagaatgatggcttccaggttcatccatgtccctgcaaagcacatgaactcatcctttttttaatggctggatagtattacatggtgtatatgtgccagattttctttatccagtctatcattgatgggcatttgggttggttccaagtctttgctattgtgaatagtgccacaataaacatacgtgtgcatgtgtctttatagcagaatgacttataatcctttgggtatatacccagtaatgggattgctgggtcaaatggtatttctggttctagatccctgaggaatcgccacactgtcttccacaatggttgaactaatttacatccccatcaacagtgtaaaagccttcctatttccccacatcctctccagcatctgttgtttcctgacttgttaatgatccccattctaactggcatgagatggtatctcaatgtggttttgatttgcatttctctaatgaccagtgatgatgagcttttcttcatatgttgctggccgcataaatgtcttcttttgagaagtgtccattcatatccttcgcccactttttgatgcggttgttttttttcttgtaaatttgtttaagatccttatagattctggatattagccctttgtcagatggatagattgcaaaaattttttcccgttttgggccaggcactgtggcttacacctgtaatcccagcactttgggaggctgaggcgggcagatcatgaggtcaggagatcaagtccatcctggctaacacagtgaaaccccatctctactaaaaatacaaaaacaaaaattagccgggcatggtggtgtgcacctgtagtcccagctactcgggaggctgaggcaggagaattgcttgaacttgggaggcagacattgcagtgagccgagatcgtgccactgcactccagcttgggcaacagagcgagacaccatcacaaaaaaaaaaattctcccattctgtaggttgcctgttcactctgatgatagtttcttttgctgtgcaaaagctctttagtttaattagatcccatttgtcaattttggcttttgttgccactgcttttgaaaaacactcagattctatccatgactttgaccaaatacatatttaatctcaggctaggtactgataggaatccatattttaggaaaaccacttcagctatcctcaatagactagcttccatatggtaaaataaagcttttctacaaatacgtcttctatatgcctgacaatgggtcccagtcaaggagttataaatcctgttagtcttcagaagtggaaaccacatggatttggtaggaaattggaaagaactt

SEQ ID NO: 6866 - DNA, 1210 bp, mus musculus
acctgtttctccatggtttcttaaagtaaatattttttaaaactgtaacacagtgaaaccccgtctctactaaaaatacaaaaaaattagccgggcgtggtggcggatgcctgtagtcccagctactcgggaggctgaggcaggaaaatggcatgaacccgagaggcggagcttgcagtgagctgagatcacgccactgcactccagtctgggcgacagaccgagactccgtctcaaagaaaaaaaaaacaaccgtaacaaagggctatgagctatttttacaggcttaagcttatgaaagaagctgtcttggtcaaactgccctttacatctctcccactgcttctccaaaccctatccaggaagtccagagacatggagataaagaactacagcagcagcacctcaggcttcatcctcctgggcctctcttccaaccctcagctgcagaaacctctctttgccatcttcctcatcatgtacctgctcgctgcggtggggaatgtgctcatcatcccggccatctactctgaccccaggctccacacccctatgtacttttttctcagcaacttgtctttcatggatatctgcttcacaacagtcatagtgcctaagatgctggtgaattttctatcagagacaaaggttatctcctatgtgggctgcctggcccagatgtacttctttatggcatttgggaacactgacagctacctgctggcctctatggccatcgaccggctggtggccatctgcaaccccttacactatgatgtggttatgaaaccacggcattgcctgctcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtatcatcttctcctacctgcgaatcatggtcactgtgctcagaatcccctctgcagccgggaagtggaaggccttctctacctgtggctcccacctcactgcagtagcccttttctatgggagtattatttatgtctattttaggcccctgtccatgtactcagtggttagggaccgggtagccacagttatgt

SEQ ID NO: 6867 - DNA, 2072 bp, mus musculus
ttcaggaagaattctgggacagtgtatgtctgtttgaaactatcttggtatccttttacttttcggaaagcagcttcatttcatgggactcactcccatacaagagtgtagcgtattcattcattcgacacacgtgtgttcagtgtgccattgtgtgccaggctgtatgcttggtaaggtcatgaagacagttccctccctatctgtagagagttcacatcctcaagggggaggctggcggataagcaggtgacttttatttaataggatagaggtaagcttagagtgctatgggaccccagaggaagaccccaagagggatggctatgggggcagggacagcttcctggaactatggcacctgagcatggcttgtaagatgagatgttagcctaacaaagaatggaggaagaggcattctattctaagcagagggaataccgtgagcaaaagcaaagaggtttgaaagcacagcgtatgggaagctccaggcctgtagcaatgattgagacttctggtttgcagggctaatgtcaagaggtgtggctggaggggccttggggggctggcacgctaagctaagaagagccttgaagcctctcacaagggcagtgccgggcttccgcaggtgtggcgtgagcacatgtccagagtggtgccttgaggaggtctctcgggagtgtcgagacacagggttgggtggagagagtctggaagcaggggccctgggaggaggcaattgccgctgtccaggcagaagatggggaggcctgggaaccctcacagagtcagatggagggctcaggggataagaacatttagaaagtaaaatagcccattggcagaaggtctgttattttgtatttctcccaaaacaaccttgttcatgagtacctcagattatcagctcctacttcggtaggggagtctgccctgacactagggaatatgttgctagttaaatgaattcagctgacatttgccttccccattcatcatgactaaatgaaagctcttttctgagtttcttggaatggtcttttgacagtcccctggccagaaccacaaatcaccctgcagttagcgtctaaaggaagcaagaagcaagaggctcccaatgtgtaataccaccaaagcaagtggaagattcgtttgatccttgtagggggtttttgccaaaaggcgtttggggtcctgcaggggcagacaggccaagtgggcagacagggaaaggcatggcactatctagtcaaaactctggcatccagatgctctcttggggccacttctctttccgcccaactaaccagtccctacgtgtttcagtagccgtgggacagaggggagcagagggctgggcaaacaacctgtcacttcagacctcacaggtcaaacgggctgaaaactacaggaattccaggctatctttcagggctgtgtgcaggttaaatgaggtagtgattgggaagccacctgaaaagccgaaaggtttcccaaatgaaaagaatttcaacagcagccatccatttcccagctttctaagacagtctgatgagaagcagggctgaaaagcatggctataatggagttcaggagtgatcctgggatgtcagtttccttgtagctcctctcatcaagagcaaatgagaggcgatcatgttggtgaccttttgaaaggtggcaggtgacagaggaaagaacccagactttagactcagacatgtctcacgtgaacctggccccaactgcttgtcatgaggacttgggcaagttgcctggcttttcagagcattatttccagatctgtgaaaagatggtagatgccttaccatgcctgtcacatatttatttccttgtttatgtgacctccccaccctctctgagaggagagaccttggctggtttattcattaccattctggtgcttaagcagtgcctagcctgtaataggtgtacaataaatagtttggttttcatttatcactcacttttaatacctccctgtcactgcatcagcagtaaactggattaacacgaagtctcatttggtgtcagttgtggaataacacagt

SEQ ID NO: 6868 - DNA, 2072 bp, mus musculus; identical to SEQ ID NO: 6867

SEQ ID NO: 6869 - DNA, 1517 bp, mus musculus
gctaggcactgcctggcaccgagacagtttaagaaaccaaatgaaacgtgtatcttcccctttaggaatttatccataagtcaactgaaacacgaacataaatctcctatatcacaaagtaaaagctctgaatatcaaaagataggccataaaggacaatatggttatatgcttcaattttaaaacagtggcatgaaaaagaaataactgggtgtggtggctcatgcctgtaatcacagcactttgggaggccaaggcgggtggatcacgaggtcaggagttcaagaccagcctgaacaacatggtgaaaccccgtttctactaaaaaatataaaaattagccgggcgtggtggcgtgtgcctgtaatcccagctactcaggaggctgaggcaggagaattgcttgaacctgggaggtggaggctgcagtaagcagagatcacgccattgcactccagcctgggtgacagagtaagactccatctcaaaaaaaaaaaaaaaaagaaataaccaaaataacaaacatctgttgagagtctactacaggccaggcactctgttaggccctgggaggtatccagggacatgggagccatggtcccacctgcaaaaagaaaagactgtggctggggagaagaggcccgagcaatgaaatagtaattcaagagtctagacagtggcccaagagatgtcacaaagccaaggatgggcaacggaggctccgggagtcagagaggtaggaaatgggatttgacttgcatggctgggaggggctttccagggaggcccgcgtgaaggctttgttcctggaattttcactcctgtaattatttaggactatggcagttactactcactgggcacttgcaccattcctcatgttcatacacatctctaatgtaaacaacccagcaagggaagtagtaccctatatgtgggggaaaagtggttcagagaggttaagtaactcacccaaagtcacacagctgaagaaaatggctgggctaggatgtgcgttcatgctctttccaccatgccatgttgctttactgagatgacacagggcacaaagtaagtgcaaacacagacctgttcattttccattcaggaagcccatttgccacgaccaatgcaactccaacctaccaggctgactgtagaatgggttttcctcatgggcaacacatacacacatgcatgcatgcgcgtgcatgcgtgcacacacacacacacacacacacacacacacaaaaccaaatcactgtgcattggacaaggggaaaaaaaagctgccactggaagatgaaggaaatcacaattccaaactccccaagttcctaaatgcataaagtacgtgcagcttgacggcatatggcaaatcaattactagtttaaatcttaaaacaaaaacatggcaagtgtggtgcagaaataatcaagaacaacggttaggtttagattacagtgggccactagagttttgaatacaattaatcatcattccaggcaatgggaag

SEQ ID NO: 6870 - DNA, 1517 bp, mus musculus
cttcccattgcctggaatgatgattaattgtattcaaaactctagtggcccactgtaatctaaacctaaccgttgttcttgattatttctgcaccacacttgccatgtttttgttttaagatttaaactagtaattgatttgccatatgccgtcaagctgcacgtactttatgcatttaggaacttggggagtttggaattgtgatttccttcatcttccagtggcagcttttttttccccttgtccaatgcacagtgatttggttttgtgtgtgtgtgtgtgtgtgtgtgtgtgtgtgcacgcatgcacgcgcatgcatgcatgtgtgtatgtgttgcccatgaggaaaacccattctacagtcagcctggtaggttggagttgcattggtcgtggcaaatgggcttcctgaatggaaaatgaacaggtctgtgtttgcacttactttgtgccctgtgtcatctcagtaaagcaacatggcatggtggaaagagcatgaacgcacatcctagcccagccattttcttcagctgtgtgactttgggtgagttacttaacctctctgaaccacttttcccccacatatagggtactacttcccttgctgggttgtttacattagagatgtgtatgaacatgaggaatggtgcaagtgcccagtgagtagtaactgccatagtcctaaataattacaggagtgaaaattccaggaacaaagccttcacgcgggcctccctggaaagcccctcccagccatgcaagtcaaatcccatttcctacctctctgactcccggagcctccgttgcccatccttggctttgtgacatctcttgggccactgtctagactcttgaattactatttcattgctcgggcctcttctccccagccacagtcttttctttttgcaggtgggaccatggctcccatgtccctggatacctcccagggcctaacagagtgcctggcctgtagtagactctcaacagatgtttgttattttggttatttctttttttttttttttttgagatggagtcttactctgtcacccaggctggagtgcaatggcgtgatctctgcttactgcagcctccacctcccaggttcaagcaattctcctgcctcagcctcctgagtagctgggattacaggcacacgccaccacgcccggctaatttttatattttttagtagaaacggggtttcaccatgttgttcaggctggtcttgaactcctgacctcgtgatccacccgccttggcctcccaaagtgctgtgattacaggcatgagccaccacacccagttatttctttttcatgccactgttttaaaattgaagcatataaccatattgtcctttatggcctatcttttgatattcagagcttttactttgtgatataggagatttatgttcgtgtttcagttgacttatggataaattcctaaaggggaagatacacgtttcatttggtttcttaaactgtctcggtgccaggcagtgcctagc

SEQ ID NO: 6871 - DNA, 7053 bp, mus musculus
tacagaacttgaggaagaggcccaacggggtgaggtgggtaccacgcggggaggaggaggaggcggcggggacgacagacacatccgcgtccgggtcgctgtcacaaatatctcctcagacgtagatttttctcttgacacactgtacaccttccactgcccaacttggagaacagcgttctttgcaaatgtttaaccaggacatgccctgagctgtgtcgtctcggggtgtgctccagagatacagaaacagatcactaactcgcgttttttattaaaaccaattaattgtgaaatgcatatcgatcgttaagagtttgtataatttagaaaagtatagtcaagacgataaaaagcacccataattctcccatccggaaatgatcagtgttaacattttttttccttgcagagccacccaagaatgcactggtattaatattgaatactctttccaatctgttttttttcgtctctctctctcagattgtgaacaactttctatgtacttttattccctgttcttttcaactcattatgacattgtgggcattcacccatattgtggaatatttttcagaaagccttaatggctgcataatattccaccagatgtgtgtattgtaatttgttaacaaatcccctattttgggacatgtaggtgattttgtaaatttttactatcaaataaggctgcagtggatattctcttaaatttatctttagctgcactttccatgatgagaatatcttagaaatgagatttccaggccaagataatgccaaatggctttacaggaaagtggcaaagtgtaccacttcaccaccagcgcacccttcttccagcatctgcggtgctcgttgagccctgtcttatgcttataggcttttccagccggcttgcctacccacccctcaaatcccacccttgcactaatgttgcaatccgcatacctgagagggttcctccttatctctgaattatgccatttctctctctccccctctcttttttttttggttttgctcagtgctgtggccttgctggtgggagagaaggtacaagaggagaccactctagtggtaagttatggggtcttccctgagtagttatggcagccctccctgcagtgctcttcagtgagtgagcgtgcttcacaaaaaaaaaaattccactaccatgtatttagatgcttcctcttaactgtgtttgctttctgcaggatgatccctttcagatgaagacaggtggtatggtggatatgaagaaactgaaggaaaggggcaaagataagtaagttcaggacaagcttagatgcaaattcacctttagcggctgcctgggtctaggttccctcagagagctggggcctgtagcagcagcattagtaggacatcttgaagcaggttttgtgctttgcaaagggtgtgttatttaaaaacaaagaaagcaaaaagtctttaaaagttaacttagagccaagttggtagactccttttgtaagagtgtattgtaggcgtgatgactcatgcctataatcccaacactttgggaggctgaggttagcttgagtccaggagtttaagaccagcctgggcaacatagtgagacccctgtctctacaaaaaaaaaaaaaagtgtgtatgtatacacacacacacacacacacacatatgtacacacatatacacatatgtatatacacacatgtatatacacatatacacacacacacacacacatatatatatatacacacacgcatatatatatgtgtgtgtatatatctgggtgtggtggcatgtgcctgtagtcccagctattcaggaaattaaagtgggagaatcacttgagtcagggaggttgaggctagagtgagccgcgatcacaccactgcactccagcctgggtgacagagaaagaccctgtctcaaaaaaataaaataagtgaacctatggggaagtttcatataaaaacaattaacaaaaataataaattcaggccagctgcggtggctcatgcctgtaatgccagcacttcaggaggctgaggcaggcggattacctgaggtcaggagttcgagaccagcctgaccaacatggtgaaacactgtcgctattaaaaatacaaaagttagccgggcattgtggtgggcacccgtaatcccagctactcaggagggtgaggcaggagaattgcttgaactcgggaggcagaggttgcagtgagctgagattgcgccactgcacttcagcctgggtgacagagtgagactccgtctcaataaattaataaatcaaacattcaaataattcaaaaattaaaaaaataaaagtttactgtgtacttttgtgacaactatatagcatttacattgtatttggtattataagtaatctagagatgatttaaagcagatggtagtgtgtgtgtaggttagatgcagatattatactattttatgtaagggacttcactatctgcagattttggtatccttgagggacactagaaccaatcccccatggatacctaaggataagtgtatccactcaatccttggaggtatcactagcagccaacagtttgcttgcatatatttctagagtttcttttctttacatatactacggcatttttttttttttgccaactgtaaataggatattataaatgcttatgtctttgttttcttcttagaacataaaactcagcctcattgagttgtgacttgaaagctctgcctcattgttctctccctccaggatcagtgaggaggaggacctgcacctggggacatcgttttctgcagaaaccaaccgaagggatgaggatgcagacatgtaagtgtcagtctgtttggctgtgagcagttggggctggactccagtcagagtccaagatatttagtcaacagatgacatttctagaattttctagaagatgtcaaagttggcccctctctttctacttcccagcttaagaactttgaaaacctcttaaaaggtcttttcaggccgggcacggtagctctcacctgtagtcccagcactttgggaggccgaggcaggtggatcatctgaggtggggagttcgagaccagactgaccaacatggagaaaccccgtccctactgaaaatacaaaattagctgggtgtggtagtgggcacctgtaatcccagctactcgggaggctgaggcaggagaattgcttgaacctgggaggcagagcttgcggcgagccaagatctcgccattgcactccagcctgggcaacaagagtgaaactccgtctccaaaatataaaaaataaaaacttgttttcaaaggtggtttcatgactagtaatatttccccaaaacattgcagggataaaacatgggcttgcccactttttattttgccaacaaagctattggcaaactatcatctttctgtcttcaaagaaccttgtacatcataacaccaatagattagtgggacataacctcataggttggtgcttctttagaaaatttctaacttgatgaaaaaactcaagttattttttttctcgtttctccatggactgtcactggtctgcgggccagtgttggggaccactgatttagaggacacctggtgtgtgtttcccacccctccctgaggcctctgggtttctcacttcaggatgaagtacattgagacagagctaaagaagaggaaagggatcgtggaacatgaggaacagaaagttaagccaaagaatgcagaggactgtctttatgaacttccagaaaacatccgtgtttcctcagcaaagaagaccgaggagatgctttccaaccagatgctgagtggcattcctgaggtggacctgggcatcgagtatgtttgagacccctaggcagaagacacagtgctttccagttaaaagttatgggggacaggccaggcacggtggctcatgcctgtaatcctagcactttgggaggctgaggcgggtggatcacgaggtcaggagttcaagaccagcccggccaagatggtcgaaccccgtctctactaaaaatacaaaaattagctgggcatggtggcaggcacctgtagtccagctacttgggaggctgaggcaggaaattgcttgaaccctgaaggtggaggttgcagtgaggcgagatcatgccactgcactccagtctggcgacagagcaagactccatctcaaaaaaaaaggaaaaaaaaatttatgggggacaggtatggtggctgatgcctataagcctataatcccagtacttgggaggccaaggcaggaggatcacgtgaggccaggagatcagcctgagaaatatagtcagactcctgtctctcaaaaaaatttaaaaaattagctgggctgtcacttgagctcaggagttgaggctacagtgagccatgattgcaccactgcacaccagtctgggtgacagagtaagaccctttaaaaaaaaaaaaaaaaggccagacatggtgacttgtgcctgttatcctagctctttgggaggccaaggtgggaggatcacttgagcccaggagttcaagaccagcctgggcaatgtaatgagaccccatgttcttatctgtgtccttagaatcctacaaatacaaatgagattgtccctggcaggttgttgctagaagtttcgctgaaggcttgatcagagtagtaagggcccctgactgctggaagcaaaagtggttctttagcgtgttacagctgttcagctgtatcaggccctttattcttctgttttcttctagcaggagccatgttaaaggctcactcaccccttctccccatgatccttcttaaaatatccactttaaaagggaattgttatggaagaggtacaattgttagaataatcttctggtacagtagaaagctgggaggcttctgggctcttttctggcctttacaaactttgagccttaagcattttacttctctgaagctcaatttgctcttgatcagaagagcagagtaactgtggttctccgacagccgtgagagtcccgtgagaatgtgactacaagtgtgcttgataaagtggagagctgtgccccaggacacatgattttcttatgtactgctgggctgccagcctcaccactcatgtctgagtagtaaggtgctatcatcttctaagtggtgtggtttctttctctccatagtgctaaaataaaaaatatcatttccacggaggatgccaaggcccgtctgctggcagagcagcagaacaagaagaaagacagcgagacctccttcgtgcctaccaacatggctgtgaattatgtgcagcacaacagatgtaagcccctcggagagcagtcttgcccccattcccctatttgggctgagatccctaggaacctcatgttctaacgtgtcccctggtctctttgggtccagtttatcatgaggagctcaacgcgcccatacggagaaacaaagaagagcccaaggcccggcccttgagagtaggtgacacggagaagccagagcctgagcgtgagtgcaacaaaggcctcggggctgcctggagtgctcagcaatgtgggaacccatggaggcaggatgcagcgggggacagggtggagcctggcattggagccggggcatatgggttccagtccatgctctggaccatgactatgtgccttcccctttctaagcctcagtttcctcattggaatcctaatagaacctacctgttaggattactctgagaattcatactctctcatattctcacgcacagtagagactcaagaagttagaaaatttcagtaaggacaaataaaagctactcataaggttagctgggtgcagtgcctcacacttgtagtctcagctgctggggaagctgggacaggaggattgcttgagactaagagttcaaggctgcagtgagctatgattggaccactgcactctagcctgcgtgacagagtgagaccacatcttttttttaaagaaaagaaaaaggtattggccatgctcggtggcccatgcctgtaatcccagcactttgggaggcagaggcaggcagatcacctaaggtcaggagttcaagacgagcctggccaacatggtgaaccccgtctctactaaaaatacaaaaattagccaggtgaggtggcaggtgcctgtaatcccagctactcaggaggctgaggcaggagaatcacttgaactcgggagttggaggttgcagtgagctgagatcatgccattacactctagcctgggcaacagggtgagactccatctcaaaaaaaagaaaagaaaagaaaaaaaaaaagacaaatacgtatctactgaggccctactgtgttcactgggttaggcgctggggctcctgtggggaaggaaacaggcagttgtctttgcctgcatggagtaaagtctagcagtgggttccagcatggcaaaccacctttcctgttcttttccttctcagggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaagaggcggaggttgtggtgagccgagattgcacctttgtactccagcctgggcaacgagcaaaaaactctgtctcaaaaaaaaaaaaaaaaaaaaaaaagaaaaagaaaaatggcttccaggacagagcatgctcatttgctggcggacagttccagaaacagaccctgttagtccttctacttacctgctggat

SEQ ID NO: 6872 - DNA, 745 bp, mus musculus
tgagcacctttgcttatcaacaggtttgtgcccccgagggtccttctctttgattttttttacactagactttgattttgaaagtgtgccttgtctttctccggtatgaaaatgatgctttgccaggaggcagccccgtcaccaaaagatcaaaaagcctttgctcaatggctagtccagtggggaaactgaggcagtaagtgatgccagattcattcatgcatccattcgacaacattgtctccccaagaagaatgggcgctgccggaggggggtaggtctggcctgcttagcgctgttccttgtcactggctggagccaccataggggcacagccagattttcctgttgggctgaatgtcaagtgttgctgtgtatcaggcatccagattaaaaaagaaacccaacccaaccctgacatttctgggaagtccaaggagagccggagtgcacagagtcatccttgctctgaccagagcttctagaagcgtttccctctccgtgggcagccccagcggcttcagagaagagcaaaccgccagtgcgctcagctgtgaaattgtctctgacaggcctgaccctggaggccccgggccttcttctccagtcgggaggtctctcagtgtagctgtctgggcagcccttggcatggctagagctgtgctcctgcccctcacagaccccccaacggcaggtgcagcttgaagcctctttccctctgggaacatcctcgcctgacgggagc

SEQ ID NO: 6873 - DNA, 988 bp, mus musculus
ggggccgctgtcctgacacctctgtccccttgggtccacccagtggtgggctgctcgcggggtgcctcccgaggcgctcctggcccgggaaggaggccgccgtctgtttccacttagcggcctcccaggccaacatgatgtcattgcagcttggcctggtgggcgctggcgccgggccaccagtgacagctcagctgggagccccaagctaatgagaagggggccgtggctgctgcggccatggtggggctgctgcctctcatcccagaaccacggcctcatccgcagaatcccggcctgaccccaacaggcagagtaggcggcagccaggctgcaggaatgtggggtggggtggttcactaaggaactgcacctggtgggggcgggcgcagctggagccagggcctcgagctgtggtcctcccgttctaggagggtgcttcgccaaggagctctgggcctggcctgcgggcggctgtgctgctgagctgttgctcactgcagagtccatggaattggcaggcctgggcaccgtccgctgaggccaggtctccaggcctggacagggaagccatttctccccagccactgcggctcacctctcccagggctcagctttccctgcttgatatgggctggctctgtgtccctacccaaatctcatctggaattgtaatccccacgcgtctagggagggaagtggttggatgctgggggcagcttcccccatgctgttctcatgatagtgaatgaattctcacgagatctgatggttttattaatggtagtttttctctctctcctgccgccatgtaagactggctgcttccctttctaccatgactgtaagttccctgaggcctccccagacatgcaggactgtgagtcagttaaacctcttttctttataaattacccagtcttgggcagctctttatagcagtgtgagaatggactaatacactgtggcccacctgtagctgtggaca

SEQ ID NO: 6874 - DNA, 480 bp, mus musculus
ggatctgatgatggggagcaggtgtcgtgtgcccttgagcaggagcccagcagagagaccctttttcctcctgtagcagcagaagagaaggcagcagggtgcaggactgaaggagggctgggctgggctgggatgggagcctggctggttttcccctggtggccctatgactggttaagggcagggcagaggcacggcaggttggaggcacagaaggcccaagatagttatctgggctggatgtggggcggtattctcgcctctctggggacatcccttaagtggacaggaagactgggtggttcaggtgtatgtccactcaccaagaacacaggatgaaggtggggcctagacagtggctgttttgaccagggcagaacagttgagggcatgtgagagggcccatgctgacgccagacctcagtggggagaggggagagtccagggaccagaggtccccctaggcttaaaggacaaacc

SEQ ID NO: 6875 - DNA, 996 bp, mus musculus
cagggctgatgagggtgtgactgcaccagctcctcacatccactgggggccaattctggcagagtgggcccacgcgggggtggccgaacccttcccaaagcagtggcggggggctttactctctgcctggctgaggcctaggcctacgaccactctcctagccagagtaggtgtcgatgctcagtgtctgctgggcaaggagggcacctcagaggagctgcagggacccttggagggaatcccaaaggcagataagatcccaggtccctggagagccacgaccagacacgcagcatcagctcccgtatagaagctcaaggtggaaaccttgggcgccagtgcagggctgaccttgaaaggtgatagggtggccggtccccaaggctcggtgacactcatgttcctttctagggctcctcaactcttccgaaatttgccatctcctaaagttctttaatctctagccacgggggttccggatttcctccgggtctacggggactcagggactgcagaggcagctgtggggggtggcatggaggacacagccctggacagaatggggacacaacagggcctggagccctgggggaggctgcaaggctgagcgcatccggggacagactcccggctgactcctgtgggaggccggcgagcagcccggtgccaggccaggcagcttgtgcgaccgactgcgcagcaagctgtcggtgctggtggcacttggcaggcggcggcgggaaggggatgtttgcagactgccggcgacagcttcccggctgaaacctccccggttagactacgcagaagtgagcagtgcccgcgggcgggtcttggaggagcgagaggcagcagaggggctgctggggctgttgggcccttctgggggcctcccaccgggcctgcccccccgccccccgctgtgggcctggcctggggcctggatccaagccagcacccccacaccctgcaggctcctggattccggtctctggg

SEQ ID NO: 6876 - DNA, 1085 bp, mus musculus
gctcctcctggggtgtcagtggggttggaccccagccgtgggtggtgtgccatgcctggcccaggggccgtgcccactgaccgccgctgcctgcccaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtaggtgccagcacagggggtgcggccaggtgggggtggcagcctggccccagaaccgatgagaagtcgattctggcttcagggggtgcccagttagatgggggatgggaccctgccagtccgatgggggtggtgtgcagtgaggtgttgcaggggccagggtgcctggagcagcctctcacccgtgtgccctcgccaggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggtgcgtcggccggggccagggcgggaaaccgagtcgaggctgggcagccttggaggggcagccccgggaacatctgtgggttgcttccgctttccccagcctccatgccttctgggcccacagcctgcacagggcatggggaaactgaggccaggccacagggccagcagagcacgggggcagtgctaggcagatgagggtgccgggccaggggccacgggctgcaggggagcgggtgcgcagggggcccgtggtggctgggacactgggctggaggcagggttcgtttctgtcccaagtccacagctgtgcccagtggggcactggggccgcgcgtgcccccctcactgttgccccaccccacaggctacgagggtgtgcactgcgaggtcaacacagacgagtgtgccagcagcccctgcctgcacaatggccgctgcctggac

SEQ ID NO: 6877 - DNA, 559 bp, mus musculus
ctgggaccctcccaggctagtcagggctcccagcaggagccccctgcaccgagacggccgtgtcccctgctccatgggaccacagcacccactgtcacacacacacagccaccgtcccatcaggcacccacatccccgtggggcccggctcagccaggggttgccagcctcccagggtatccttgacagctgggggaggctggccttggccccatctctctctaccccactgctgggggtctgaggccctcccacttcctctcctcttcccctaaggtcctgtcacaatgaggagctcccaggggccggcgctgcagccaccctccccgggcaggctggagccggccttccttccacctcgccctccgcttcccacgggtaagctgctcgcaaggcagccggcacgctcgggtcacgaggtcaagggcagcaggagcgaccagggagttgcagtcaccctgccccgtgccacaacctcgttcacaggagggaaatcaggcaggcccagagacggcaagcaacctgtataagatcacacagccagcgcagggtgaggcct

SEQ ID NO: 6878 - DNA, 1193 bp, mus musculus
ggtcagagtagaccacaagctggccgatttgtccctgtaggccctgaggctcctcagagggcacgtaggcccagtgtgggctggggacgggaaacctgatttgctgagccagacaatccttaccctcagtgccctggaaggggctcagaccttcagtggttccgaagggcctgtgcccaccttccctggccccagggagcacgtggtcctgtctgggctgggccagccctatgggaggctggggagggcctaggcgagcacaggtctgtcctatccctcactgggcccaccctttccagtgggtcctggccttcgagatcttcatccccctggtgctgttctttatcctgctggggctgcgacagaagaagcccaccatctccgtgaaggaaggtgagtgcggcaggaggccccaggcacagccgggggagcgcggcacctcgcacgcctgcgctgtgtgtgcacatctgcacacgggtgtcctgctcccggagtccctgaggtgcggtgcctgctcccctgtgtggtcctgggccgtgcctcctggctgggctgtggaggtcggggctggcctgtggccgcgaatgatgatgccaacgcctcttcctggtgatgtgggcactcactggtctcctctgttctgttttgatccccctccctccccgcatggtctcttgtcctcggctggcatgcagtctgtaagtgagcggccacctcctcctggctggcctgggcagcagctgcggggggcccatgggccgtcctggcttgagcgccctccccgcttgcattaacagccctcccgggccccctgccggcctcaggaacagctggctccagatggggggtggcaggcagtgaagtgggaggtggtagggagtgaaaggcccggccacctaaaggcacagctggtgcctgggtcaagctgaggcggcatctctctgcctggccttgccttctagggctggggtgcctcggcttctgggctgagtctgggctgaggctgggctggcctgggctggggctggagcggcctggctactctcccttcatactccttcaggctcttgcactcactctgctaaccagctggccagaggtcagaggtcactgcccagagggggtcctttgtcctcccctgggctctgtaggcagtgccacacctgaaacgttttcggggggagagtgccagg

SEQ ID NO: 6879 - DNA, 1193 bp, mus musculus; identical to SEQ ID NO: 6878

SEQ ID NO: 6880 - DNA, 526 bp, mus musculus
agactctcttccttccaacacatgtgtattactgggttgtaaatttgattaatactgtagacacagggtcagcaaactacagcccagcggccaaatccagcagccatctgcttgtgtaaataaagtttattggaacacagccatgcccattaatttatgtactaaatatgactactttcatgccaccatggcagagttgaatggctagctgtgacagagactggcccacaaagcctaaaatatctgaccccttacatgaaaagattgtggatccctagcatagacaaaaaatttgacgatgaggggaaaaaacactattatacaagaccttcttcaggattatgccagtccgtttattagcagttgattggtttagttgtattatccttttactggaatggccatttaattcattatttttcatctttgtacaaagataaatgtgattaccaaggggttgctttgaagccagcagcctttccctgatcttgtccagcatctcacctctatagcacaaggtaacttt

SEQ ID NO: 6881 - DNA, 1471 bp, mus musculus
attcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagc

SEQ ID NO: 6882 - DNA, 1471 bp, mus musculus; identical to SEQ ID NO: 6881

SEQ ID NO: 6883 - DNA, 1471 bp, mus musculus; identical to SEQ ID NO: 6881

SEQ ID NO: 6884 - DNA, 1471 bp, mus musculus; identical to SEQ ID NO: 6881

SEQ ID NO: 6885 - DNA, 1471 bp, mus musculus; identical to SEQ ID NO: 6881

SEQ ID NO: 6886 - DNA, 807 bp, mus musculus
ccgctcttgcaagcattcactcggccggtcgcctgctgaccctccttcgccacaggctcgtagcggaggcagcagcgaggtgtccgatttgggcacgtgaggcccgcgatccccggcggtggacgccaggcagggcaaggccattagtgggcgccagaatggagagggggatgggaaggaatccagcaggagacatggggtggagttgggcgccaggcaagggtggggtgggggagtgcggtgagcaacatgaaaagggggtaggaacgggagccagacaaggatttgaaggtgagcgccgggaagcaagggcggtgggtaccagagaagtggttagggtaggcagggggtgttgtggacagcagctgggacgctcagggaaggagggcagtgggtgccggtcaaggcctctttgcaaggggattggaagtggacgccagtggtagcaaggggttccgggagggcagtgggctctgagctaggaggaggtggcccagccacttctgcagagttcctaaccccagacagctctactgcaccaccccagcccttccccacagcccaaaggaacttaagagggagagcactgcgggcatgcagccaggatttccagcattgcttccaggctcctaggggaaacttaggcactagcgcagactacatccagacatggctatagggaaaagtttgccttgtggcacactgggtgtgtctctctatcctctctcctcccccagcaggcatgaagacccccaacgcacaggaagccgaagggcaacaaaccagggcagctgcaggacgggccac

SEQ ID NO: 6887 - DNA, 2385 bp, mus musculus
gaaacgtgccatgtgaaaagagccacacaaaactcttataccttgtatgattccatttgtattgtcaatgttggcgtatagctccatcgcgtggacatagcataaattccttcaccaagccctgttgttggacttgacgttgttccccggtttccaatattacaagcaatgctgtgaggaccatctttgtggctacatatttgtggccgaccttattcatgtctttgcaccaatgcccagaagtggaactgccagtctgaaggtgtgtgcattttaaagctttcgggaaatatcgcggagcggccctgcacaaagtttgctcagactgcactcccaccagcagatctagagggtctagtgtctcctttctccaatacaacacctccctcttggcgctactcacccatgggaggctgtcccaggtcccagggtccccccgctcaccatgctctgtatttgtttgtagtttcctgggtgcgctgccaccatggtctggttctgcaacagtgccgactgccaattttcagtcttcgcccttaccaccataggatggatcctctcctctacgtccacgggcctcgtggagtggcgaatatggtacatgaaagacacctcgctctacccccctggaatcgcctgcgtgggaatatttagagtctgcatttaccggcgtcgcaccaacagcaccacaaccaaattttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccgatgctgttaactgggatgttttctctgttttacaaatgtcccccgtacggccaagtgcatcctggtatttcagaaatgtgaatttcctggttgcattggctttgcaaatctaagatttctgggagtttatggaaaatgttattagcatgctctaccaaatatttccaacgactcaagaccgtggcatgggtagtttgggacagaaggtggccaactgcctccttctgttatcttgtgtatctgaatgtggctcactgatttgttggttgaattgagaacttttatttaaaagtcttcccacctgccagttggtcttattgcatctgaattttaattattgttggctacagcaaataatcaaccctgtaaactaagagtagggaaataagagtttctgagtacattaacttctcacatttccctcttaaacttttgctacaaacaatcataggccaggcatggtgacttacgcctgtaatcccagcactttgggaggccgaagtgggaggatcacttgaggccaggagttcaagaccagcctgggcagcatagcaagacctggtctctacaagaaaaaaaaaaaatagctgggtgtggtggtgcgtggctgtgattctagttacttgggaggctgaagtgcgaggatcacttgagcccaggagttggaagctccagtgagacgtgatggcaccactgcactccagcctgggccatataacaagaccctgactctttaaaaaaactccaataaacaaaaaaccaagaatggaccttattttctatgtcatggtaataacatctccctaccatataaagttttctaaaatgtgcaaaagtagagaggatagcataaggaatctccacacacccattgccagactccacagttactgagattagggcacttctgctttctctttccattcttttacctttctaatctatgtttctttttcccaagtttttttttttttttgagacagagtcttgctctgtcgcctggacttgagtgcggtggcgtgattttagctcactgcaacctctgcctcccaggttcaagcgattctcctgcctcagcctcccgaacagctgggattacaggcacctgccaccatgcctggctaatttttgtatttttaaaaatattggggttttaccatgttggccaggctggtctcaaactcctggcctcaagtgatccgcctgcgtcggcctcccaaagtgctgagattacaggtgtgagccactgcacccggcctctttttcctaagtattttaaagcaaaccccagacaccatgtcccagacaccatgtcccttcatccccatatactc

SEQ ID NO: 6888 - DNA, 348 bp, mus musculus
tgggtatgcactgtatgcacacatgcatacacacgcacacggccttttaaaattttgttttacctcctttctggttcttgttcccattccctccctgaggtccaacttaatttctccccttggttctatgagacaccctgcaaataccccttctgcctaaaccagctcagttgatttttgctgcatgcgaccttgctgcatgcaaccaaaaactattaacaaatatactatcacaataattcattttccttccttagacatttcaacatttgtaagatttaaaaatcaccccagtaaatacttgtgttaatttgaattgatttctatttccttggacttcagctattt

SEQ ID NO: 6889 - DNA, 2409 bp, mus musculus
aacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaacct

SEQ ID NO: 6890 - DNA, 2409 bp, mus musculus; identical to SEQ ID NO: 6889

SEQ ID NO: 6891 - DNA, 2409 bp, mus musculus; identical to SEQ ID NO: 6889

SEQ ID NO: 6892 - DNA, 2409 bp, mus musculus; identical to SEQ ID NO: 6889

SEQ ID NO: 6893 - DNA, 146 bp, mus musculus
aaatgaagaaaagagaacttttcagaaatgtctgtgcttctaaacattaggctgaaattcagacagttctcctaataaattctgacagtgtttatacatgtttttaatctaatcatttatgtattcttttttcttctaaaataatt

SEQ ID NO: 6894 - DNA, 132 bp, mus musculus
cagaacaaatcattgaaattccagctgttctgataaccaggaaataaacaaatggatgtcctttcttcatcttagggcctcatctcccctgtggtggagttgggacaaggtgggattcagaggtgggatgag

SEQ ID NO: 6895 - DNA, 297 bp, mus musculus
gaaataattttggatacagaaaagttataaaaatagtacaaagtttctgttaaaccgttcaccaagcttcccctaaccttaacaacttacataatcttagtacaactgtcaaaactgggaaattgacactgataaaatgccagtaactatagcatttacttggatttccccagtttttctctttgctgtggcaggatccaattcaggatctcacatggcattgagttgtcccatctccttagtttcctccaacttgtgatagttcctaagtttttccttgtctttcgactttgactc

SEQ ID NO: 6896 - DNA, 248 bp, mus musculus
gctgcattgagtggtcatgtggaggagcactgatgcatcctatacaaaagccccagctgaatgccccagccaacagtcagcatcaactgccagctatatgagggagccattttgaatgttttatttctagtaaatctttcaaataactgcggcccagctcatacttgcatggaacaaaagaattgcccagctgagttcagtcaacctacagatgcatgacagctgataagtggttgtttttgttttaa

SEQ ID NO: 6897 - DNA, 265 bp, mus musculus
accatcctactacaagccctgcaggcattgacacacaatccttagctaaacaaaacaacaaaaaatgagaaggaaatacccatctacttccacaactttcagattcctgtgtttggccttctaagcatcgtttttactagcaataactcacggtggtactatagacctgattttcatcaggttccctggaataaatctctctgggtatctcaagcagaaagaaatgtaacgcagataattagttatttaccaaactattggaaaa

SEQ ID NO: 6898 - DNA, 489 bp, mus musculus
aaacatacattttgaatttcctgtaaacatttagaatgctagggataattaagaagggttaaagttacagtttacaaaatcctttcatagtaaagccacagtttacaaaattttttcaaaatactttcaaagtttcatagttgagcttcatgacaaatccatgttgtggaaattattgtcctcatataaaactaaactaataaaatatatatgtggatttgattatcaaagaatacagctattacccatagtgaagacacactttctaaataggcaaaagctttccctgagtcatgaaagagttggagacgatctggaggtctttatttcaggagtcattactaatctaggatgacaagtgtgcctgcagtcaaaagcagaagttggaatctgagtgagttgcttatggaaacaagatttttctttagggagtgagaatgctgcttgtaaagcagaagtgattatatatatatacacacacacacacac

SEQ ID NO: 6899 - DNA, 495 bp, mus musculus
cctatcaaaaggaattgatatcagtgtgctgaagaggtatctgcattcccatgttcatagcattattcacaatagccaagatgtgaaatcaacctaggcattcctcatcaaatgaatggataaagaaaatgtggtaaaaatgcacaatggaatactgttcagccttaaaaaggggaacaatactgttatttgcaacaacatggatgaatctagaggacattatgctaaatgaaataaaccaggcacagaaagacaaatcccttataatctcacttacatgtggaatctaaaaaagttgaactcacagagctagactccgtctcaaacaaaaaaaagaaagaaatagaaagtagaatgatggttacagaggctggaggggtcaggaagaagggaaagggcagctgtgtaatcaaaggtgcaaagtttcagaaagacaggaggaataagttttgagatctattgcatggcagggtgatcatagccaataataatata

SEQ ID NO: 6900 - DNA, 3206 bp, mus musculus
tgtgttcacctctttttcagatgatgctcatattcttgtgttctggttttgttttgtttttttgaaatgctttatgtaggtataatttacataccacaaaatgtacctagtttaagcacacacaattcaatgatttttaataaatgacataattgtgcagccagttgtgggttgtgtaccacagtctagttttagagcatttccctgaccccaaaatgcttatttgcagacaatctctcttcccacacccagccccaggcaagaactaatctgctttttgtcttatagacttgccttttcaagacttctcatgtgaaaggaaccatacaatatgtgatcttttgcatctggcttctatcacttaggatgatgttttcgaagatcatccttaatgcactaggatcatggatgcatggatcagtagttctttcctttttattactgaatggtattctactgtatagatattccacattttatccattccctagtagatggatttttggatcgtttctactttctggctattatgaataataccactgtgaatattcgagtgcaaatctttgtgtgggcacattttttttttcctcttggatacatacctaggaatggaattgccaagtcatatggtaaatataggctttttttttttttttttgagctggaatctcactctgtcgcccaggctggagtgcaatggcgcgatttcggctcacggcaacttctgtctcccgggttcaagtgattctcctgcctcagcctcctgagtagctgggattataggcgcccaccaccacgcctggctaattttttttgtatttttagtagagatgcgatttcatcatattggacaggctgatctcgaactcctgacctcaagtgatccacctgcctcagcctcccaaagtgctgggattacaggtgtgagccaccgtgcctggctggtaaatatacctttaatttcttaagaaactgtcaaaacaattccaaagtggctgtaccattttacatttccaccagcagtgagaggtccagtatcttcacatccttgccaatacttgatatcatctgtctttttattatagccattctagtgagtatgaactgatacctgagtgtacttttagtttgcatttccctagtggctaataatgttgagcatcttttcatgtgctgattggtcattcatagtcttctttggtgaaatgtctgttcaaatcttttgcccgtttaaaattgggctgtgttcttattacgaagctgtgtaagagttctctatacattttggaagcaaggcccttattagaggttttatcaattatttcttttatggatcgtgcttttggtatatctgtgaactcttagcccaaaccaaggtcatgaagtatgactcctatgttttcttttagaagttttatagttttagctcttacatttaggtctctgatccattttgagttaatttttttgtctggtgtgaggtagatgtccaacttcattctttctcatttggatccctagttgtcccagcactgtttcttaaaaaaaagaaaaaaaaaaactgtcttgtcatctttgaatcatctttccaccctcgtcaaaatcaattgactgtatacgtaagggtttatttttggactctcaattatactccattgacatatgtgtctactcttatgctaataccacactggtttaaaacttttttttttttttttttttgagacaagttctcgctctgtcacccaggctggagtgcagtggtgcgatcatggctcactacagccttgacttcccctggttcaggtactccttccacctcaacctcccgagtgcctggaattataggtgtgcaccaccacgcccagctaatttttttattttttgtagagatggggttttgccatgttgcccaggctggtctcaaactcctgggctcgagcagtctgcccacctcagcctcccaaagtgctgggattacaggcatgagccaccatacccagcccttttttttttttttgagacagagtttcactccagcccaggctggagtgcacaggctccgctcactgcaacctctgcctcccgggttcaagcaattctcctgcctcagcctcctgagtagctgggatcacaggtgcccgctaccacgcacggctaatttttttttttttttttttttttaagtagagaccgggttttgcagtgttggccaggctgatctcgaactcctgacctcaggtgatccacctgccttggcctccaaaagtgctggaattacaggcacaagccaccgtgcctggcccgcacccggccctttttaaaaaatttatttttctttgttttttgttttgttttgagacagggtcttactctgtcaccgcagctgtggtgcagtagtgcaatcacagctcactgcagtctgcactattttgattactatagctttgtagtaatttttgaaatttggaagtgcgaatcctctaactttgttctttttcaacattgttttggccatttggggcctctcaaagttccatatgaatttgaggatcagcttttccatttctggagaaaaaaaaagccattgaatattgataaggattgcatcgtatctgtagattgcttggctggtattgacatcttaatagttttaagtctactaatctgtgaatgtgggatgtctttccatttatttaggtcttctttaatttatttcagcaatattttgtagttttccatgtacaggtctttcactttcttggttacacttactcctgtgtattttattcttttggatactcttgcgaatggaattgttttcttaatttctttttcaaggttgactttaaaaaaacacctgtcacaaaaatcttcaacactacatttcacttcatatttcagtatttgattgagttgaaaatgtaattgactttttggtcagagttctatacaaatggcttctggtttttcctgtattttcatccattttaattcttacactattttatactgctttggagatgacagagatagccactttctgcagtttatcactttagagaaaacatgtttatatggtgacagatcaaggctgtctttatgaaagtaaaagagtgaaaatacagccaaccccaaggctactttatctgtttaaccttggaacttcctagtactttgccactagtgtacatagtccatag

SEQ ID NO: 6901 - DNA, 1202 bp, mus musculus
actttacatgagcgtttctcaacaatgcaagatatacacaaggcagatgtaaatgaaattccattgaattcagatccagaaatacacaggtaatgattgattaccatattatacccatttaactaatggggatatacctcagaaaagatttgggaaggggctgctttccgaacctgctcacttgggcttgctgtagactgtaggattgcatttcctgcacaaaaataataggataatccaagcattatctggccactgcactttgatggaatgaataggatgcgctgaaaacattgactagcgttgtttaaatgtgtaggactttgaagatgcttacatacctaacttcacttctgctgtcaatagtaattgcttcctgaggtcctcagtagaagaatgaaagacagttttcaagccatcgaaatcatatgttgcttcgtgtggtcacaaataggtgttctgagggcagccagatgaaaccacgtgtcttctgctggcacttgttggagcaggtggtgtaccctgtcttgtgagctgatttgaatacatgtgagaatgcagtatatcaccagagcaaagtttgagattacacagactactgatttgagaaccactaaagcttccctatagtgtgttccacaggatatgtatatcctgggagactgccatataggtgaaaaactatctggtagcaagtttcttttgctagctccaaaacatactagctttatttcaaattctgttctgtaatagtagaatcagggtatcagtgtataacataattatttagttgtactatgcctttattattttaggagaatagatatgtctttggccgagcttcagagtaaacaagctgtgatctatgaatcggaacaggttagtgaatacaatttttgatgagaaattatcttattgtttgtatattaacggcaaggggcttggtggttgggagagaaaagggagttaaagtacatgaagaaggaggattgaaacccaggaatctgaaattaaaaaagtcttcaggtgattctgactatcagccaggttggagtgagaatactgacaaaagacaaaaatattccctaagagggacaatccctaaggataacagctttgtaaaattgacacgcaattacagcatttgatattcatccccaaaatccgcactgtaaagcttatggaaagtatgttaggtacct

SEQ ID NO: 6902 - DNA, 593 bp, mus musculus
tgcagtaaactggcaggccagctgggggatgcatagtctatgagagcctagcagaaaacacttatttctgcttcccgtgcttgttcatcctccagcagcctagagaagcaaaagaagaagtgcataaggcttcttgagacctaagcttgaaactgacccactgtcactcccaatgcatcctattggccaaagcaagtcacaaggccaacccatatttaatgggaaaggatataggctccacctcttaatggaaggagcagcaaagtaattgtagaaaagctgtggatgcaaggagagatagaagattggagacatgtttgcatagtaccacatgcacagtaagacaacagatctaacctagagggaatcaagaaaggcaaaatacagtctttaaatattagtatattagtatctataataatatgcattaaaaggcaaatcaatacttacattgacagtataaaataaggaatccaaaacatataattgagtgatagccttgagtcagttgttctcttgttacatttgtcacttagctaaacctctgaaaagtaaagtaagacatttttttgtgaactttagctaaatataaa

SEQ ID NO: 6903 - DNA, 294 bp, mus musculus
gtctttttcttagggtatgtatattaaatctacatatgatggcctccatgtaattactggaaccacagaaaatgtaagtattctaacctttcaaatttttaagtgtgtttttcccttttattgctaacaacttatatatctcacatgattgaggttaacatctaaggataaggacatgaacagatagtagatacaatttaaaagagatactgagttagtagcattcattctgttcaaatttccctttttttttgtttagaatagctgtttacttaaagtaaatcaggtgttttc

SEQ ID NO: 6904 - DNA, 294 bp, mus musculus; identical to SEQ ID NO: 6903

SEQ ID NO: 6905 - DNA, 1207 bp, mus musculus
cattagattttgtgagactcaaatgagatactgtctggcaaaccacaatatacccgtgaaaaggtacaaagtagtgtgtatgtgtaaaagcctttagttttaccaaatgctttgtgccctgatttctctgcctacaaaatacgggtaaatataatatcctttcctgcttcacaggagattagaaagttaagtgacatgatgtatatgaatttgttttgaggctttgtggggaaaaagttcttcccctaacagtgtttagagtcatcatttagctcttgagagttctgtgtagcgtgctggtgctctggatcacaccctgagtatcagataacattctttttatctttgatttcagacatttcagcagtcctcactgcagcacaaatcaaagaagaaaaacaaaggtaagaaaaggaaatgaaacctttacctgcttattttgctctttgataatccccaacacacttcatccatgccctctttcttgcctgagcccagtgtggtttagaagagcacaacccccttgtgcgaaagctgccagcttcttcttcagtgcaattataatacaaggtaccttttacaacaaatgatctcaataagttttgagagtggtgttacatatttctgattaagatgtgtgtcacttatgtgagggaaaatattaaagatttttatatttttctagtctaatacaatataaaaatttttaagattttcaagaactcatacttctttttggtatctatagattaatcctctactttcatacctttgacaaaattgaaagagcatttccaccctttaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggtaagataaagcaccttttgttttctcatccattctctatctttaatcaaaagaatcattttgagacttatattttaaaatcgtataatcaccttaaggccaattcagtagacttctgctaggtatttttcaatccaccctcttaaaatgattgcatgttggggttctagaaagatagctgtctcaattatgctaatgtagcaacatatctgaaacacagataaagtgt

SEQ ID NO: 6906 - DNA, 1207 bp, mus musculus; identical to SEQ ID NO: 6905

SEQ ID NO: 6907 - DNA, 1106 bp, mus musculus
gaagacatgaaaatcaactaaaatgaaatacataaaaaatcagtaaagagcctgcttacgaaagtggaaaaacaacagctgggcggggtcgcagggtggcaaacgtacgcgggcacgtgcacgtgcttttggggccgacagacgcgccagttgcctaggcgcatgcgtctggctatcccagaagcacctgcgccttccggctcgtgctttcctcagtctcgcgcctttctctgcagctcgcgcctttctctgcagctcgcgcctttctctgcagctcgcgcctttctctgcagctcgcgcctttctctgcagctcgccccttcctctgcagctcgccccttcctctgcagctcccacctcactcccctcagcgttctttttcccacggtcttcccgttgccgctaacctaactaactctcagccatggcctccaacgaagatttctccatcacacaagacctggagatcccggcagatattgtggagctccacgacatcaatgtggagccccttcctatggaggacattccgacggaaagcgtccagtacgaggatgtggatggcaattggatctacggtggccacaaccatccgccattgatggtgttgcagccgctcttcacgaacacgggctatggcgaccacgaccaggaaatgcttatgttgcagacacaagaggaagtggtgggctattgcgactcagacaaccagctaggcaacgacttggaggaccagttggccctcccggatagcattgaagacgagcacttccagatgaccctggcctctctgtcggcctcggcggcatcaacatcaacatcaacccagagccgcagcaaaaagcccagcaaaaagcccagcggcaagagtgccaccagcactgaggccaacccggcaggcagcagctccagcctgggcacgaggaagtgggagcagaagcaaatgcaggtcaaaacgctggagggtgagttttccgtgactatgtggtcccctaacgataacaatgaccaaggggcagtgggtgaaggccaggctgaaaacccacctgattattccgagtacttgaaagggaagaaacttcctcctggggggttaccaggcattg

SEQ ID NO: 6908 - DNA, 1106 bp, mus musculus; identical to SEQ ID NO: 6907

SEQ ID NO: 6909 - DNA, 551 bp, mus musculus
ttctgaggaggtgtctgccagcagaccctatcctggacattttatggaatctgagattactaatgctgaaaacaacttagcatttctgagagacatcttgattcaggctccagcctatcctgttgttcccctcttccctctgcgtgcaagacctgcaagcacattgtgcttaatcttggactttgcgcttggcaaaattgttcagaggctttgaggacagcaaagcactatcaatgaatggagtgtctctgccccccacaacatttagaaatgatttttacagacatgctgtagatggatataactatttaaagcaggagtctgcaaacattgggccaaatctggcctcctgcttgcatgtttgtaaagttttcttggcatgcagacacgcccatttattacatagtgtctgtggctgcttttgtactgagtagttgtggtagatactgtatgatctgcacagcctaaaatattttctatcagaccctttacagagaaagtttgctgatccctgtcttataggaaaccagtgaaacctgctcaaatgaagc

SEQ ID NO: 6910 - DNA, 298 bp, mus musculus
atctgtcaattgtcaagctgctctgttcttacaatatttttaactttttattttgatataattttgaagaactgcaagaatagtataaagaatttccatatgtcctaatctaggttcttcaattgttaatatttttatcatatttgctgtatcaatattcctctcaatagatagatagatagaagatggatacatctataattttgtaactacatctataatttttcttctaaatcagttgagagtaagtttccagcgtgatgccccattatctctaaatacttcagggtttatttct

SEQ ID NO: 6911 - DNA, 1308 bp, mus musculus
atgatgttttaaataattttaatttctattatcaccagtggaaaccatatttattatagaagtttccggtgattaaagagaagaaaaatttttaaattacctgaaatcctaccactcaggaaagactgctatttattattttattgtaaatccttcaggacctttagaacatttaaaatctctattcctcaatattaaactatcctgtagatcttacttggtgttagtcatatctctgggagcagaatcggagtgtctgcaccctgtgcttgagggactgaggtatgaccaagggaacctgaggcatatgcccgctttgcttttatggcttaggcgtctgtgtccagcaaatgcccaacttatgacctaaccagtgaattggtctagactttgcagaaacctctataactcattttatatcctcctcctacccctactcctctctgagactctgggcagggccagacctgagccaacatcttttcctgagaactgcctcctggtcttgcttggcctgccaaggtcaggctggatatcccccttacaaacagaaggcacccatagtttttgtctctccacactaatcccaccaaagggaagggatctagcagctgcagcagcagcaggagagagagagaaaggtacctcttgtggttccattcttggaagccgctatcaccagagctctggcctattggggcctcaagatgacttccctcaatgcctgccagagctctcccacttgaggttagagggaggagaagagggttgtagccacctttcctgaagacgggtaggatgacctgcaggtgatgtgaactccattcctggcctgtgaggtatataacctaccccccttgccagcctctggaaaggtccaggagagagggggtgcattcccatcttgtcactgctgtattctcagagatgtgcagcaatgactgtggcctcagcaagcccttcttctcccactccaaaaagcagattgaaatataaaactgacatcattacagggatggccttaaattgcctctagttcataaaaataaccaaattgatctccaacttgttgctagtattggtaagaaaaaaaaaacatagggctcattctacgattgattcaggtgtatcagtatatctcagttttgtcacatcataagccttgccatctcttagaactgcataatttctgcattcctgagctctgatgccctagtccatcaacttagttacgatcatctttttcttactgatcttgcgcacctccttcctggccctcttgtcaattcatttaccctatgactgaga

SEQ ID NO: 6912 - DNA, 1394 bp, mus musculus
caggatttttgctccttactggaatatctgctcacagctgtcaagggatgtttagtttcattctactttaggtacattattgttaatttttttttaggtgttctttttttcttggtgaaagtgggctgttttaaatgtgtgctttgagtattcaaataaaacagaattttcatctcctaaaagttagggtaaagagaaagcaagaaatatttcttttttgacttgcatgcttttctcctgaaactccatgcagtaaataaagaacattggaacaaaaaaaaaaaaaaaaaaaaaaaaaaaaggcaccactgcatcatgtcttgtcacgttctgctcacccctacacctgatttcaaatgtaaattgcatggcatttagcgctaatgaaaatactctagtgaaggaaattgttaagattttctggtgctcccctaggggtaatattaaaaaccccgttactaacatctcactctgagaagacaaaaatgtgcactgagaatacaaaagccctgttggcatctaaatgtgggccaattaatttgctgttattgacgtgtggatttatgaggagatgtaaaagtaggacccaggaaagctattgagatcctcgtactgcgggacttcttgaccctggattttcaatgcttgcctaatcatggcattctgctttctatttatttatacagttgcttcaatgaacaaattaataattatacagcacattgacaaacatgccgggtaatatttgccagattttaaattaatttaattcaagggccacttcatttacaggattcatctgcacatcaggcatcagccttacctcgttgctattcatgctataccaagatttttcatcgttttctcccttcttttcttctctacagacaaagacagcacaacttgccatgccaaataaatagacactaacaggcaggtggaagacagatagatgacagacaaataggaatatagataaatgcacagatgacataaatttagaaggaaggataatagctgttactatgatatgtggaagacaattagattccactaaaatcttgtatttattttctctttagctccaatttgcaatttatcttctcttgttttgcacccacaagccttcttcacaatttacagactggaaattcaaatggatagcttatagttccagaaatgatcactcttcttggaaacagaaaaaaaaaacatgtaaaaatggaacttcatgggcttaggaagccaggcaaaattctgggttgctttatatatcagtgaggtttgagtgaaagtgaatgacaagattggattgcagagaaggggtcagttacttttaggaaaatcgcaattgaaacgtcggacataattgtacttgggtttgtaagaaagaa

SEQ ID NO: 6913 - DNA, 205 bp, mus musculus
gccttttccttgttctatatccccatcactaatgatttagttcaaatacacatcttctctagcatttactatggcacaaaactctgttttgttctctctgcttctacttttgccttacctctccatccatgttccatatcgccaccagattgattttttcttaaaaacaaatctgatcatgttatttctttgtataaaacaattc

SEQ ID NO: 6914 - DNA, 274 bp, mus musculus
atcaaatgaattaaaatatgcaaagtacttagaatggcgcttggtgcttagtaaacactataagtaattgttatttttattgtttgtttaatgtgatatatttatgtcatacagaatcttaaatttgcatatgttcaaatctattaatcttttcatctgtggtttctgcctgcgggtcatgcttaggaagatcttaacctaaagattatttttgaaaagcttcacctatatttcctatcggtacgtttttaaacattcaaatcttaaatccatc

SEQ ID NO: 6915 - DNA, 274 bp, mus musculus
ttttggcccggaaaataatggtgacatcctttggaagcaaagacaactaagtctctttctgtttttctaccttcccttactcttcctcacttcacactggcagagcccagctagggaaggggaaaagatttaacactaaatatagtccagagttttgatgatttcaagggcttaatatttcagttatagaattgagacatttgtatgtgtgttatatgcatgtgcatgagacttaaagaaactttcagattgatttcctccctctcaactttta

SEQ ID NO: 6916 - DNA, 224 bp, mus musculus
ctaaggtcagcaaaggaaggagtaccatgcctttcagggaatcaacagcagaagcctgcgtgatttctgagggaccactgatctcagaagagtaccgtagcacaaagcctgctcctgccatcaaacttaggaagccctgggccaggctgacttcttcaagggggtctcagagatgtgagggccttggtctaagggaagagtactcaagtcagcaaagaaaagca

SEQ ID NO: 6917 - DNA, 388 bp, mus musculus
agagaagaaaagcaactcaagttagattaagtaaggaatgaattttttataggaaactcaatgcctcacagtatttgggggaggtttgtaaaaacagaatacaatctgagtggagtatattgttttattgctgccaactctttgctccctccaagttataggattgtatatctaagctctatgtctgtgatattgaagtgtctcccagtagaacaggcacataatatgtctccaactcttttactttgaccaaatgaaggtgacactatgccagttttgaatagttgctttaagacgaatcttgcattttgactcattctcttgtgttcctgccatccttcaggaggagaacatgccctagggtgttgctgctgcttcagcctggatc

SEQ ID NO: 6918 - DNA, 341 bp, mus musculus
ttagccatgttttaatgaaaggtctgaaaaaaatgtctttttgtatctatagatggaaggaaaggaaaaggtagtaataagagaagattagaatcacatttttgttatccctcgactaaagttagaagatattcatgatctagacattcttggagttgttacactttatgtcattctgatgtttttggtttaaggacttggctgcatctatggccccattattgactgattatgctaatcttatggagagtgtcattagatattgaacaaagttgcaactcctcatgtgaatactaaggatgttctcaaacacattttcaaaacccaagagggaaataaac

SEQ ID NO: 6919 - DNA, 415 bp, mus musculus
tataaaatcaaagaaggaaggaatgctattctattcactcattgtacagtcagccataaggcagtgcttggctctccctaagtatctgttgaaagtgttgaagaatagttacatagaaaataataaaggaatatttaaaaacatagatatgatatgtcctttttgaccttgaaattattcactggttccacctaaacgcaaaaataaaaatgaaaagtttagaatcaggccttacctccttcattggtttctcctctcaccacactcttaaaaacaccttttgttcaaactataataaagcatttacaatataaatcatatgtttcagtcacatattgttttcttcacttattggcttctgagcctgaagtgactatcctcccttctattcttagctaaattatgattatccttt

SEQ ID NO: 6920 - DNA, 685 bp, mus musculus
gaaaacactcaagccttcaccaaaattaccagggaggcctccaaaactaatccaagcattttcaaaatctcttatgtcagtaactacaagaattctgagactcctggttaatttttcatcaccaggctacccattcatatgttttggggattctctaatattatgccattatcacccatctccatctcccaacacccttttaccctgtctcctggaaaatcccaccttacctgaatgtttttgttctaactgaaagcatacattccactgaaaacactgctccccacatagtttctcgagtgtttgctctcttaccactaggcctggaagtagcatcagtgtcttccttgtttctcattgccacctctgggcaattatactgttactttctgtccttggaaacttaattattagtggtaaataccactgatgtatcacctgctatttctccttgctgtaagcatccatgtaccctctgggttcctcttcctcattatttaacaaatgtagtctctctctctctctctttctctctctctctgtccgtctgtctgtctgtcttcaatgctacttctttcataattcctggcgatttctgtatccatataaatgcacatgtacttgtctttcttgttactgtggataaattagctgtggtctggttacagctaatactttccctagt

SEQ ID NO: 6921 - DNA, 163 bp, mus musculus
tacatacttttaagcctactgatgtaattactgaaagaataaaatttatacttaaaattaatctatactttgtctcactggagaaaagtcagtaaaattattttttccatctttcttcaggagaaatgaccaaagagagtatttagcatttagaaggtgcctc

SEQ ID NO: 6922 - DNA, 576 bp, mus musculus
tggactctaccagctagaagccagtagcaccctcacagctagttgaggcaactaaaaatgtcttcagatattgctaaatgtctcttgaggagaaaaattgtcctggttgagaatcactgaatttgagtcaacataagtaacaatgaccaaatatatttttttctactgtacgtccatcatttgcatggcctataaagaataaattctttgattctattcttttgtctcgctacatatcagttcggacttgagtctagtgggaagaacttcatgacagatggtttcactggtcccaagatgatatttttgtagtcactctgtctgtgctctctggtagatgttttctctagctgtgaccacgattcagagttcagcagtggccattagagtgcattaggctagacttgttaaatgcatatttattcaggagtaagtgtttttgtaggtcatggaagctgtgacagaaaatgttctgagcagagccagaactcttctctccacaaagcaatgtagtcaccccctaataccttggaaagctcagaggcaaaatctggaccaacaaactgaatacttaaa

SEQ ID NO: 6923 - DNA, 266 bp, mus musculus
atgtgtggtgaatcctattacagtagatggaaccatgtatcatgaatgtatgtcaaaagtggctaaaagtcaatttcatatgactccgcttaatataatgttctacatggtaggacatctttgatgtgaactaaatatatacaattgtataggccatcaagtccaagctatccatctacatagatatgagctcttacatatgatcctgcagacttgtttttagcattttagtgacccaatgctcactcactcatgatattactgat

SEQ ID NO: 6924 - DNA, 655 bp, mus musculus
tgcccatcagaatgtcccactctgtctgaaatggcagggcctttacacccatgcctgattcagtcaccagatacaggctgctctgagaagagaatggtcctctgacaaggcagctcccagcagctaaggctgaccctgaaggagccgccagatggaggcagcctgctgaccacacgccccacagctggagagcaagaccttcctatgcttaccatgtaagttcagcattctgagtacttgtgagttttgactcattttgtccacaaagcaaccgtattcaactattcaacaagaaccactagtaagtggcagagttgagattcacaccgagtaagtttggcctcagagttcacactcttcatcactctgctattctgtctccctccattgttcagtagagaacttcatgcacaatatgaacaaattgactacctttctctctctctctctgtctctctgtctctctctctctcactaatgcatatatacatgagagaatgtgcagtttgagcttgtatggtaaactaaaattatgttaatcctcaaaagtatcatttttgtctttgcctagatccattttctttgattgaccatgcaatcaacttgttctcttactcaagtggtctcctctattccaagccagtctattctaacc

SEQ ID NO: 6925 - DNA, 312 bp, mus musculus
gtaaattgcaaaatattgatgactgttgagagagcttatttctttgaaccataatgcatgaaaatcatctataactcttggcttgcaaaaaggaatccacaatctttctccatattacaaattatataatgtcaagtaagaaagtgcaaaataattatgaacagaattttgtctctttacattcattcaacatcaccaccaagaaattacttgtctagaatttggctgacactttggaaatgtacataacttatttatattaaagagtttaactgtatttctagtgtatataaatatgctcttatgatgcat

SEQ ID NO: 6926 - DNA, 210 bp, mus musculus
tcatgttttccctatgcacacacacacacaatcctgttttaagttaatgtaaagacctactttgttggagagaagaaagagagatgtcacaaatggcaacctactagtgcaaagaaaggtcaacactgtggtctgggacccaggcagccctggccctggtcccacaagacttgctttatgttttgttttgttttcagcccttcagtccac

SEQ ID NO: 6927 - DNA, 725 bp, mus musculus
aggaaattttagaactaggtactttgagaattaagagattaagaagggattattttctatctgcacagttctcagggaatagatatgatgagtgatcctaactatttgagtaaatgtcaactgccagcagacaccaccagcttatatcgaagaaaagtcacaaaaaatatgaagagattcatcacactgggaatggaaaacatcgaataagtcagcaagtccagcaaaagaagaaagtattacaagtataatttaaaaatagttttggcaagaggaggttggggagaaagcagagtaggctataataataattataactcaaagatgggccagacctaaatgtacaccttggcctctttccatcctaaaatgttctatattagcaaaagaggtgttatgatttatactcagctccaagtctagactggtttaggtttcctgtgtttaattctgcttctttcttaacaaaaaaatctagtcatctagatctcaagtgaaatgtgcaattgaaggtataaaaataaaattcaattgaggaaggcaagtttgtccttaaaataaaatttaaaataccagcatttatttttaaaaaactacctaattacatctagtcccatacatatgttcaagattaatatgcaactgatgcatgaaaataaaattcagctgagggtaactactgtctcattaaaaagaaaatagaaaactagcatttctatgaaaac

SEQ ID NO: 6928 - DNA, 366 bp, mus musculus
aatacaatgtggtaagattgacatcatgccatttctaggtttagaccttaggagaccttgaatgcttccatttattctcttggaaccctgctatcaacagatgatgaaagacttaacgttttactcaccccattcgacaggtggccaatcatcagacatgagcgaggccattgtagaacaagaaatcccctaatcttggctaggtttcctcataggtctgggttagctgttgtgggtactcatgtcttactttaaaatatggttatttaatacctctgtattgttattcctctaagaagatgtaataagtcctctggaagatatgacattaatggacttcgctgaagttttctgtgactctttatg

SEQ ID NO: 6929 - DNA, 232 bp, mus musculus
gctgcctatttccacacatctataggttaaataaaccaatattgaataccattggcattacattttttcaagatttgaaagtgactcatgaatcattaaggagaggttgaattacgtcaagtgtagtttcactactacatttaactgatacttttaaaaatgtactcactttcatatggtgcataaagctctgttaactcaaatattttcattgtccttgatatttaatacc

SEQ ID NO: 6930 - DNA, 1009 bp, mus musculus
tcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctatcattatggtccctttaccaaaaaaaaaaaaaaaaaaaaaaaaaaaaaaaccttgttgtctctcaggcaaccagcgctttttgtcagcctatttcatctccccatcccttcctacaatcgtttatactactgaaaacttgaaagcccacatcccattctctcctggatctctaggcctaccaaagtttctttctaaaaccatgaaatgaccacaagttaatttgatgaagtgattcataataaattgttaataagaagtgacctacaactaggtcaggtcattcttcaaccacctattttattagtgatcccccacaggcaatacatgtgactgaagctggaatttgaactttctgtgatgagggccctgtagcgtatatgtgagacctctggtagcaggagtctctgagagcctctaactcatggtagtctgaaatagacataggcaaagccccagggacatttttaagagagctgttgtaagtaatccagtattataagttaagtctgtcctgtattcatcagaaaaaaacagaatctgctgctacaagatattaggatttctggtcttaagcaacagacttgaatttcactacctggattcttctctttggcttcatgtttgcagataggatggttgaggaggatggagctattgagagggtggctgctctgtgcagttgcttttgtttatattcttactgacctggcacagtgtaggtggaggtgatgcatgttttctgacattgggccagtgatgtatggcctgaccttcaaaatgagaaacatcatctctgtgggtgagactatagccgtgcaaatgcttttatcccatattgctcagcagtttgcaac

SEQ ID NO: 6931 - DNA, 583 bp, mus musculus
aataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaat

SEQ ID NO: 6932 - DNA, 550 bp, mus musculus
aaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctgg

SEQ ID NO: 6933 - DNA, 197 bp, mus musculus
cactcacctaactgcaggaatttggtagacacacatttctcaaaaatgctcaaggatactaaaaatgatacctgatctcatgattgacgagagtagtagtctacccatttaatacctaattccagttcattctattcattcgagacaaaccctatttttattccctttcaccttattttctccatggaatatgtgat

SEQ ID NO: 6934 - DNA, 999 bp, mus musculus
tgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccatttta

SEQ ID NO: 6935 - DNA, 272 bp, mus musculus
tttattgatgaatccaatgacattcaacctcatcagctagtttggtgagccaaatccatgaggataatggcattacataatagtgattagatctcagggcaattagagcaattatatgattagagggataacatcctttatgtaaggcaatatgaactcccagatctgctagacttttgtatcacttcatattttcatagtgttttagaaagatatatatccaagacacaaaatattagaatatatatttcatagctttaaggacaatatat

SEQ ID NO: 6936 - DNA, 211 bp, mus musculus
ttttcctaactttgtatcatgagtgtctccggttttatcagattctcaagaggatccaccagccccaaaagttttaaaagcattgttttgccagtttgaaaaacattacctaatttatgcttcttggattcaaacatattgcactccctctaaatcttgattcctcttttctttctccccaattcatcttcttttaaaaaaaattgtttat

SEQ ID NO: 6937 - DNA, 1048 bp, mus musculus
gtactggaatgacatccactggagttgtgcctcttataatgagcaggtggctggggaaaaggaagaggagacaaattctgttgctaccctttcctattcctctgtggatgaaacacaagtcagaagtctctacgtgagctgcaaatcatctggcaagtttatctcttcagtgcattcaagagagagccaacatagcagaagtcagagagtcacagtgctgcagacaaaccccaatcctgtgtttgaaagcccaaacttggctgcagttgaaatatgtagagatgccagcagagagacctacttggttccatcttcttgcaaaagtatttgcaagaattataatgacttacagattgcagggggccaggtgatggccattaattcagtgacaacagattttccctctgagagcagttttgaatatggccctttgctgaagtcatctgagattcctttacccatggaggattccatttctactcagcccagtgactttccccaaaaacctatccagcggtactcatcctattggagaataacaagcatcaaagagaaaagcagcttgcaaatgcagaatcctatttctaatgcagttctgaatgagtacctggagcagaaggttgtggagttatataaacagtacattatggacaccgtgtttcatgacagttctcctacccagattctggcgtctgaactcatcatgacaagtgtagaccaaatcagtcttcaagtgtctagagagaagaatctggagacctcaaaagccagagatatagtctttagccgcctattgcaattgatgtcaactgaaattactgaaattagcactcctagtctccatatttctcagtatagcaatgtaaatccatagagaggatgcttccattactgtctcgcatttacttaaacatgaagcaacactttatccatttattctgagaatgtgcaggaggggttagtgaaggggaattaagggctagagaagtaaagatcagctggaagtcatgtgtgaatcatggagaaatctcataatattacacttgat

SEQ ID NO: 6938 - DNA, 277 bp, mus musculus
ggtacacacttttaaaactgtgtgtatttcctactcttcatccagattttcccctagatttagcatccattgatgatacttgcttgaagtagtctatactatgatggctgcaaaatgatttttcttccagctccagcactcctgcatgtttaccaattggattttactgtaagcagggacttcccttctcccctatttttgtaggtatgtatttagctatcttcattgatacggacacacggctccctcttttctacaggtttataactcattactg

SEQ ID NO: 6939 - DNA, 199 bp, mus musculus
tatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaa

SEQ ID NO: 6940 - DNA, 199 bp, mus musculus; identical to SEQ ID NO: 6939

SEQ ID NO: 6941 - DNA, 199 bp, mus musculus; identical to SEQ ID NO: 6939

SEQ ID NO: 6942 - DNA, 199 bp, mus musculus; identical to SEQ ID NO: 6939

SEQ ID NO: 6943 - DNA, 199 bp, mus musculus; identical to SEQ ID NO: 6939

SEQ ID NO: 6944 - DNA, 199 bp, mus musculus; identical to SEQ ID NO: 6939

SEQ ID NO: 6945 - DNA, 199 bp, mus musculus; identical to SEQ ID NO: 6939

SEQ ID NO: 6946 - DNA, 1026 bp, mus musculus
tagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagtt

SEQ ID NO: 6947 - DNA, 1026 bp, mus musculus; identical to SEQ ID NO: 6946

SEQ ID NO: 6948 - DNA, 1026 bp, mus musculus; identical to SEQ ID NO: 6946

SEQ ID NO: 6949 - DNA, 1026 bp, mus musculus; identical to SEQ ID NO: 6946

SEQ ID NO: 6950 - DNA, 1026 bp, mus musculus; identical to SEQ ID NO: 6946

SEQ ID NO: 6951 - DNA, 1026 bp, mus musculus; identical to SEQ ID NO: 6946

SEQ ID NO: 6952 - DNA, 1026 bp, mus musculus; identical to SEQ ID NO: 6946

SEQ ID NO: 6953 - DNA, 1257 bp, mus musculus
tatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttc

SEQ ID NO: 6954 - DNA, 1257 bp, mus musculus; identical to SEQ ID NO: 6953

SEQ ID NO: 6955 - DNA, 1257 bp, mus musculus; identical to SEQ ID NO: 6953

SEQ ID NO: 6956 - DNA, 1257 bp, mus musculus; identical to SEQ ID NO: 6953

SEQ ID NO: 6957 - DNA, 1257 bp, mus musculus; identical to SEQ ID NO: 6953

SEQ ID NO: 6958 - DNA, 1257 bp, mus musculus; identical to SEQ ID NO: 6953

SEQ ID NO: 6959 - DNA, 1257 bp, mus musculus; identical to SEQ ID NO: 6953

SEQ ID NO: 6960 - DNA, 472 bp, mus musculus
tttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattat

SEQ ID NO: 6961 - DNA, 472 bp, mus musculus; identical to SEQ ID NO: 6960

SEQ ID NO: 6962 - DNA, 472 bp, mus musculus; identical to SEQ ID NO: 6960

SEQ ID NO: 6963 - DNA, 472 bp, mus musculus; identical to SEQ ID NO: 6960

SEQ ID NO: 6964 - DNA, 472 bp, mus musculus; identical to SEQ ID NO: 6960

SEQ ID NO: 6965 - DNA, 472 bp, mus musculus; identical to SEQ ID NO: 6960

SEQ ID NO: 6966 - DNA, 472 bp, mus musculus; identical to SEQ ID NO: 6960

SEQ ID NO: 6967 - DNA, 213 bp, mus musculus
tcttttgtacgacatagtgactataattaataataatatgttttcgaaaattactaagagagtcgattttaagtgttctcaccgcaaaaaaatagtatgtgaggtaatgcatatgttaattagctcattttagctagtccacatttttcaatacaatgtgttgtataatacgtgatatatacaacttatattttccaattccaataagtaaaa

SEQ ID NO: 6968 - DNA, 213 bp, mus musculus; identical to SEQ ID NO: 6967

SEQ ID NO: 6969 - DNA, 213 bp, mus musculus; identical to SEQ ID NO: 6967

SEQ ID NO: 6970 - DNA, 213 bp, mus musculus; identical to SEQ ID NO: 6967

SEQ ID NO: 6971 - DNA, 213 bp, mus musculus; identical to SEQ ID NO: 6967

SEQ ID NO: 6972 - DNA, 213 bp, mus musculus; identical to SEQ ID NO: 6967

SEQ ID NO: 6973 - DNA, 978 bp, mus musculus
atttcgagaatttattttttcatgcactttcttctaggaattttgtagtttcaggtcttacatttaattctttaatcaatttttagctgacttttgttgtgtgatgtaagggtccaattttattctttagcatgtgtatatccagtttttcaaacaccatttattaaagagaatatcctttcctcatagtgtactcttgttgcccttctcaaaatttagttgaccatatatgaatgggtttatttatgggccctccattctgttgcattggtctatatgtctgcttttatgccagtactatattattttgattactaaagctttgtcatataattcaaaatcaggaagtgtgatacctccaatgttgcttatccttctcaagattgctttggctattctctttcttttgttgtttcatttgaattttagattttttttaaatctatgaaaaatgctattggcattttgatagaggttgtgctgaatctgtaaattgctttgagtagcatggacattttaacaatattaatccttctagtccatgaacacagaacatacacccatttatttgcgtcttttaaaatttcttaaatcaggccacgcacggtggctcatgcctgtaatcccagcactttgtgaggccgaggcaggtgaatcaccttaggtgaggagtttgagaccagcctgactaacatggtgaaaccccgtctctactaaaaatacagaaattagccggacgtagtggcgggcgcctgtaatcccagctactcgggaggctgaggcaggagaatcgcttgaacccggaagatggaggttgcagtgagcagagatcccgtcattgcactccagcctgggcgacagagccagactccgtctcaaaaaaaaaaaaaaaaaaaaaatctttaatcaatgctttgtagttttcactgtataaatatttcaccattttagttaaatttattcctcttttattcttcc

SEQ ID NO: 6974 - DNA, 318 bp, mus musculus
ggaaggattttacctaaaagcaataatttttctcttttgaaaatgtaaggaaatcaagcataaaagtaaagaaagggatggaacaaaagaggaaaatgaggtagtaggactgtactaataatcagagtagctaacaaaaggtcaaagggtcatggccaagagaaataatttctaagacaacgataaagtgataacattaacatctatacgaatagagatgtgttctcctaaatagagtcctttatcagaaacaaaggaagcaatgtgataacgaaacagaacagccaagcaacagaatgacattaaattccaattgag

SEQ ID NO: 6975 - DNA, 352 bp, mus musculus
tctgactgatgacaaatatgtccaggtactgataaatctatttctactttgaagtttcttgtttatatattaacgtaatccttaagtatttttaaacacttttttcttttttggaagagtaggtgtatgaggggcataataaccagaagtcagtatcagccatctgttatacagtaataattttaattttaatgtattcagtgatgcctagcttaatggtttttaaatttagttgtctgtttcaggaagaagctttattactatcagagatatatcatcatgaggaaaaaaatggagaaggcgatactttgcttgagaatgccttcacaggcaagtgatgtgtaacaatatc

SEQ ID NO: 6976 - DNA, 427 bp, mus musculus
ggggactctaacgaagatgcatcatataaaacttggcttaaaacttaaaacagtaagataaaattttatctgaggcccaagcctctagaatttattttaaaaagtattatactagttagtttcaaggagtacaggttttgtattagacacccttctcatggcatgactcagaatcttaatgggttactgtattaatttaatttcaggactcatcttttaataagaatgtacacaactgagtccatgctaaaaacgaaaatgataatgataataatgttatatttgtggaaatgcttattctttcattgcagaaagctaaagatgttacagttggattagaactccaaagtgtaaatgttcttaaatcagtgcaggggaaatgtaggtcaaagcacataaggtgtttcccaagcccttgttccctaga

SEQ ID NO: 6977 - DNA, 1160 bp, mus musculus
aatggatggatagaaacacacacagatacacacacccgcacacacacacacacagacacatagaaagagaaaaagagagaggtgattacataaatatacaagggtaggacataaattgtaagcatttgtaaaggtacacagattacttcaaaagagtaaacagtactgcattaggccccaaagagaacttctatatatgttagattgctctggtagtgcaatcagctttataatgactaatgaagttaagtcaaaaaattatctgtaaaccataggaaccattaacagttctgctatttgcatccttacatctttaatggttaattccaaagaattctcagtggaggcaatagtcattaaatatattatctgaatcattatctgcaacctgctgataaccaaaagctaaaaatcccacagtgatgacatgaacccatataaacacagcaatctcattttcattaagccattccttagaaatgtgtaatgtacttattttagaagagagccaagaactagctaaaacataaacgaagtaatttttatgggttatttttattttatctcttaaataatttcagcatgttttttagtgggcattttttcaaaaagaagaagaggtagttatgcattgaagtacctataattaatctatttgaatgcaaggttttttaaataaatatattgtaatacagactaaagttagagctgaccgtacaagttattaaaggaggctatcaacattgtgtcataatggaattctctttgatagaatcgttattaaaaatgtatttttctcaatcatctggccaaatctctgaactctcaccatgaaatgttctttttgattagagcaatgacaaagcagaatttttttgttgactataaatcactagcttggaagctaaataccgatgcctgagccagggaaatgttatccactgggccacaataaaatcaccacaggaacttgggaagcaacaagttggtcaggcatcactttcctagggaatatggttgcagaaggtgaggtcagctgcaaactcctagtaatagaagagtgacttagaagagaagacaaaaagaaaattaatcagaaactgtgttataccaagtacagccaaaaacatctttagcttatttaatatttcaaagttaca

SEQ ID NO: 6978 - DNA, 999 bp, mus musculus
gaatgcatttttttcagaaagttagttttactctgaaaatataataaatattaactgtgagcaaaagaaggaggcttacatacttaagtcaatcctgattgtatgcatataatggaaatcaaacaactttgtgacagcatcattaaacctatggaacttgcaatcgttgtgttattcttgtagaattctttttggcacagctcccagtagtgttgacattaacatgggtcatttgtgttatgacattttatgatgtgaggatgcaggtatggaagaataattttgacattaaagccacgccattcagatttatttgctctttatctgcaaatacatgcctatcaggatatgttgactgtgataaaatgacttaacatttagaaagtgacagtatggttaataaaattgggtcattaattcaagatatgtgcatatgtttcatcatggaaatatatgtattcaaatacaaaataatcataaatgttatcagcttccccatttaaatttgataatacaataggtaagaacttttatacacgtgaaatatctactctgcataaatgagcaacttatgtttagggattaagctaggattttttaagaaacaaattttttgaagattaagtttagcatttaataactaattgcacctaattatgttttgatccacccaatgcgaacttggaaaaaatattcaaataaaaaaactactatgtaaaagtttaatgaaatcaattaggaaagtcaactctttataaaactactgacaagacgtaaaatctactgataagacataaaggtaaatattgtcttgtgcactgatgaagttaggccttgaggtagattcaaaatgaaaagcataaaacaagtcttcataacagtctcagcctttaaaatgaaaaaaatgcatttttcttgtcctcaattttacctagggtttactctctggtggacactttggaatactcaaataaataacatgtaggctccctcctcaag

SEQ ID NO: 6979 - DNA, 203 bp, mus musculus
acatttcaataaagtaacatattttactattttttaggtaatccataagaagtgaattgatttaaagaaatttaagttttagttttcattttaattgtcattgacagtcctagtagttggtatattttccttaattttagagttttaactcgtcttttgtaaaaggcagcaagtcattcagaattggtataattagttttgat

SEQ ID NO: 6980 - DNA, 159 bp, mus musculus
gcccgccctgggcccgctgtcgccggtgcgacggtaccaccatcccagctgtgaggctgccatcaacacccacatcagcctggagctccacgcatcctatgtgtacctgtccatggccttctacttcgaccaggacgacgcggccctggagcactttga

SEQ ID NO: 6981 - DNA, 761 bp, mus musculus
cgctgtcgccggtgcgacggtaccaccatcccagctgtgaggctgccatcaacacccacatcagcctggagctccacgcatcctatgtgtacctgtccatggccttctacttcgaccaggacgacgcggccctggagcactttgaccgctacttcctgcgccagtcgcaggagaaaagggagcacgcccaggagctgatgagcctgcagaacctgcgcggtggccgcatctgccttcatgacatcaggaagccagagggccaaggctgggagagcgggctcaaggccatggagtgcaccttccacctggagaagaacatcaaccagagcctcctggagctgcaccagctggccagggagaacggcgacccccagctctgcgacttcctggagaacgacttcctgaaccagcaggccaagaccatcaaagagctgggtggctacctgagcaacctgcacaagatgggggccccggaagcaggcctggcagagtacctctttaacaagctcaccctgggccgcagccagaaacacaccagagcccagacaggccccacagccacggggtgccttcccctgctcgcgccaccaggcgggacgtccatgttcccttttcagaacattctcttcatttttctcctctcagttttaccgttgttggcaataaagttatctgttctcaaagcaataaaggtgtccagctgatgcgtatctgcagcactctcaccttttaggaatcagggcacatccccatgcaggttt

SEQ ID NO: 6982 - DNA, 1312 bp, mus musculus
aagatttttctctctcttttttttttttttggctgagcacagggtactttattgatggtatatgacaaggtggggctccctaggcccctcccctcttcaaggggtctacatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaaccatgtagttcaggtcaatgaaggggtcattgatggcaacaatatccactttaccagagttaaaagcagccctggtgaccaggcgcccagtacgaccaaatctgttgactccgaccttcaccttccccatggtgtctcagggatgtggtttggctgacgatgcaaaagaagatgcggctgactgtagaacaggaggagcagagagcc

SEQ ID NO: 6983 - DNA, 694 bp, mus musculus
tttctctctcttttttttttttttggctgagcacagggtactttattgatggtatatgacaaggtggggctccctaggcccctcccctcttcaaggggtctacatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgt

SEQ ID NO: 6984 - DNA, 1279 bp, mus musculus
tgagcacagggtactttattgatggtatatgacaaggtggggctccctaggcccctcccctcttcaaggggtctacatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaaccatgtagttcaggtcaatgaaggggtcattgatggcaacaatatccactttaccagagttaaaagcagccctggtgaccaggcgcccagtacgaccaaatctgttgactccgaccttcaccttccccatggtgtctcagggatgtggtttggctgacgatgcaaaagaagatgcggctgactgtagaacaggaggagcagagagcc

SEQ ID NO: 6985 - DNA, 907 bp, mus musculus
gagcacagggtactttattgatggtatatgacaaggtggggctccctaggcccctcccctcttcaaggggtctacatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagt

SEQ ID NO: 6986 - DNA, 1095 bp, mus musculus
cagggtactttattgatggtatatgacaaggtggggctccctaggcccctcccctcttcaaggggtctacatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaaccatgtagttcaggtcaatgaaggggtca

SEQ ID NO: 6987 - DNA, 998 bp, mus musculus
acatggaaactgtgaggaggggagattcagtgtggtgggggactgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaa

SEQ ID NO: 6988 - DNA, 991 bp, mus musculus
ctgagtgtggcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaaccatgtagttcaggtcaatgaaggggtcattgatg

SEQ ID NO: 6989 - DNA, 1003 bp, mus musculus
gcagggactccccagcagtgagggtctctctcttcctcttgtgctcttactggggctggtggtccaggggtcttactccttggaggccatgtgggccatgaggtccaccatcctgttgctgtagccaaattcattgtcataccaggaaatgagcttgaaaaagtggttgttgagggcaatgacagccccagcattgaaggtggaagagtgggtgttgctgttgaagtcggaggagaccacctggtgctcagtgtagcccaggatgcccttgagggggccctccgatgcctgcttcaccaccttcttggtgtcatcatatttggcaggtttttccagacggcaggtcaggtccaccactgacacggcagtggggacacagaaggccatgccagtgagcttcccgttcagctcagggatgaccttgcccatagccttcgcagtgccagtagaggcagggatgatgttctggagagccccgtggccatcacgccacagtttcccggaggggccatccacagtcttctgggtggcagtgatggcgtggactatggtcatgagtccttccacgataccaaagttgtcatggatgaccttggccaggggtgctaagcagttggtggtgcagaaggcactgccgacaatcttgaggttgttgtcatacttctcatggttcacacccatgacaaacattggggcatcagcagagggggcagagatgatgacccttttggctcccccctgcaaatgaggcccagccttctacatggtggtgaagacgccagtggactccatgacgtactcagcgccagcatcgccccacttgattttggagggatctcgctcctggaagatggtgatgggatttccattgatgacaagcttcccattctcagccttgacggtgccatggaatttgctatgggtggagtcatattggaacatgtaaaccatgtagttcaggtcaatgaaggggtcattgatggcaacaatatccactttacca

SEQ ID NO: 6990 - DNA, 206 bp, mus musculus
catgtagttcaggtcaatgaaggggtcattgatggcaacaatatccactttaccagagttaaaagcagccctggtgaccaggcgcccagtacgaccaaatctgttgactccgaccttcaccttccccatggtgtctcagggatgtggtttggctgacgatgcaaaagaagatgcggctgactgtagaacaggaggagcagagagcc

SEQ ID NO: 6991 - DNA, 784 bp, mus musculus
gttggggaaccacggtgcagaagctgctgtccaagcagcttgtagagccccagtggccacagtttagtgtttatgggttcagggtagactgaacagccagctgtctgcagcaggaaagtcccttggccaaaaaatatatcccctactggtctgtggtaaatgcctgaaattccaccattagcaatgcattcctttggttatgccccaccatttgagccacaattttaaagtgaaaatgctcctcaggggactaacacatggagaccctgacactttcaatgaataagtgtttcagatcggtttctgagagaggaggtgagcccttggctgcctccctggtaggagtgtggctgcaggcaggggggaaggagtagagaaaggaaggggtgggggcctggagggctgtgggcaaacttgggcagctgagccattatgacgcctttaaaacaaggcctcaattctctgacactccttccaattggaggtggggtctatatcctctcccttgaatctgggtgggcttgtgactgcttcaactaatagaggatggccaaagtgcctcaatgtaacctccaaggctgaatcataaacgccaatgcagcttcctcctggttggctggagccccaggtcatggtgtgagaattccagctactctgagaactatatgctggaaagatcactctggtagacgacactagattagcctagcctgccagccatccctgcctaggttctagatatgtaagtgaagcctccagaacaagccattcactagctgaatac

SEQ ID NO: 6992 - DNA, 330 bp, mus musculus
tgatttatggcaactctataatcccacaaagcccaagcaatgtcttctgtattccttgtggaactgggcccccaatatagattataaagagcagaaattatatcaatttgtcagactgtacccattgcagctttctatgacaaggctccaaattatatttatccctggggtcaactgagatgaactctttttaacttcattaaagactgtataattcaatgtataattttcaaaaagttagaagcatgactctcgtatgcacatagtatgagcacatgctcaaaatttattaactcattaatgaagaaatctgtaacatggtaaaactgg

SEQ ID NO: 6993 - DNA, 518 bp, mus musculus
cattgtcaaagaggtcaggccattagcaaggcaattaatgtaccctatgatgcctctcattgagagtcaagtctccttaatagctaatgtggggaaaataatcttcaagcatccattacagctcccagataaatgcccaagggaattagttcactggctacctctagttgggaacactgttctcccctgacctgaggccttcgtactcagtcacagctctagcctctcttaggtgactcacctggctcagatccacatccaaagcactgcttagctttgccctcttctcactcttcctgccatctggggggcctcctattcacacactcccaggatttccaatggactctttctgacttccttcccaaacccagaatcatgcaatcaaccttaattgtcactattttatgttaccacttctcaagcttcttattgagtgccatttcctctgcaattttttttgcctctttggtttttcttcagttgtactttctatccttcagcactttactatggta

SEQ ID NO: 6994 - DNA, 1657 bp, mus musculus
tatagattgtgattgagtaggtttgaggtggggcctgtgtatttgtatttttcaacaagcttttcaggtgattatgataagcaaccagatttagaaaccagtgaataagttcaacgagatgatttgcacagtggcctcttttattcatcacttaggttctgttatttttagagccaaattaatcaatcagtgcattgttttaacatccttgccttacatatcttttccaaaaatttttaattttaaagggaagaagggaaagggaaagataatttcctatgtttgtgtgaacacatccttggctcttctaataatatgaaatacagtaaataatgacttgtaactattataattgtttttaacattcatgaatgaaaactaactacaatgtgggttgattggatttcaggtttcactctgctttaataaaaattttattacacatccagaaagtaagttaagcaggcctggcgcattggctcacacctgtaatcccaacactttgggaggctgaggcaggcagactgcttgagtgcagaggttgaagaccagcttgggcaacatagagaaaccgtctccacaaaaaaataaaaaaattagccaggcctggtgacatgtatctgtagtcccagcaacttgggaggctgaggcgagaggatcacctgagtccagggaggttaaggctgcagtgagccataatcgtgccactgcattccagcttgggtgacagagtgagaccctatctcagaaataataataacagtaataagttaagtactgttgagcttttttagaataatcattgccgatactttcattttctaattaacttgaaatgtctgaattattgcttgtaacacccttgtgaagtaggtgttagaatcagtcatctcttcatagactaggcaaagagtaggctgaggatgggttttgactgaacaaatatttattgagtacctactatgggcagattactcagaagggtaatagccttaccctgctattaattagctgagcaaaatcaaacagatctctgcagctccctgagcctcggtttcctcatctctgaaatgaggggcttgaatcaggctgagagagacagacagacagacagtagtcttgagacttcttcccattcttcttttcctttatgactttttatgtataatgtgagcagctctttgaaggaagccaaacttcctctgactatcctgaaatttaactatccacctaaatatccatctaatgttgcatgacatcatctcaggagtggcatttgtctctcccttaaaccttccatggaaaatggtaacaataagcaaagtttataatctgcctcctcctcctgattttatacatatgaggtgaatgttctggaagttataaaaatggtttaagtgtgaggatttagataaatttataaggttacactttgtcccatgttattcagagaaattgggggcatgtctttaaaatattttctaatgtaattggcaacataaaattgtatatttctaaatctctatttctttattaccagtaagcttgagctccccccgccctgcataattttgtctcttcagcttttaatacttgtcttacagatttgactcaaaccttttgccacatttttaagcaaatatttttccagttgctt

SEQ ID NO: 6995 - DNA, 238 bp, mus musculus
cttgacattttttgtggtgatacatttgaaatttactctgttattttgaaatgcacaatacattattattactacagttactgtgcaatggatttcaaaacttattcttcctgtctagctaaaattttgtacccttcctgtctagctaaaattttgtactcctcattccctcagttctcaccccccagcccctgataatattcattttgctctctacttctatgaattcaacgtgttt

SEQ ID NO: 6996 - DNA, 172 bp, mus musculus
tttaatcagagacgttcccccatgacaacaacaattttgaaattctcaagattctgtggatcgactgggtgtttttctgatctataggatgtcaactacatttagctcatgggtgagctgcagtgttgactcatattaattctctaatcctgctataacaagttatcacaaa

SEQ ID NO: 6997 - DNA, 1176 bp, mus musculus
ttgaggaaactgcaacccagtttattttctttgatttaaatcttccttttcctttcagtcattgacagtagaactcagtttcacctgagtgtaacatcactgttccttttggcagaggatggtcattgctgtttattttgttttctactttttctcacttgtagaaaataatcatcctttctctgttcttttctctttgtactactcgtcagcttgtactttaccaatttcctagataatagtttctgatacgaggcaacctcctaattaatttatctggccacttaataatgctttctctatttcactctgcctgcccaactttggttttctgtttgatattatttctgccctgagttctataacgtgccttcaagtgtgaattagtaaaagtggccgaaatacttcaatacctgcaaaatgcatgtttgaaaagtacatggctgctcatatatgtgcagtaacaccattctttctctttgaaactgaggagttagggtgattctaggttccctgtgttacagtttctctcttctagtatattttaactacagaagtcatttctaaagtgatttctggtgctaacttacaacaacttaagggcgttatagatatttggtcttcaaaggcagctttataaagcagtcactgtattgtcacatttagaaaaaggttgtgtggctgggcgcagtggctcacacctgtaatcccagcactttgggaggctgaggcgggtggattgcctgaggtcaggagtttgagagttgcttggccaacatgatgaaaccctatccctactaaaaatacaaaaaataagccggcatggtggcaggtgtctgtaatcccagctactcgggaggctgaggcaggagaatcgcttgacctgggaggcggaggttgaagtgagcagagatcaagccattgccctcagcctgggcaacaagagcgaaaccccatctaataaataaatacatacatacatacaaaatttagtcgagggtgctggtgtgtgccagtaatcccagctactccagaggcggaggcccaagaatcgcttgaactggggaggtggaggttgcagtgagccgagattgcaccactgcactccagcctgggtgacagagtgagattgtctcaaaaaaaaaaaaaaagttatattttaaaaggatattctac

SEQ ID NO: 6998 - DNA, 979 bp, mus musculus
cacgacaaggtggggctccctaggtccctccctcttcaagtggtctgcatggaaactgtgaggaggggagtgtggtgggggactgagtgtggcaggaactccccagcagtgagggtctctctcttcctcttgtgctctcgctggagttggtggtccaggagtcccactccttggaggccatgtgggccatgaggtccaccaccctgttgctgtagccaaattcattgtcataccaggaaatgagcttgacaaagtggtcgttgagggcaatgccagccccagcattgaaggtggaggagggggtgtcactgttgaaatcggaggagaccacctggtgctcagtttagcccaggatgcccttgaggggggccttcaacgcctgcttcaccaccttcttgatgttgtcatatttggcagggttttccagacagcaggtcaggtccaccactgacacattggcagtgggggcatggaaggccatgccagtgagcttcccgttcagctcagggatgacctttcccacagccttggcagcgtcagtagaggcaggaatgatgttctggagagccccgtggccgtcatgccacagtttcccagaggggccatccgcagtcttctgggtggcagtgatggcgtggactgtggtcatgagtccttccacgataccaaagttgtcatggatgaccttggccaggggcgctaagtagttggtggtgcaggaggcattgctgacgatcttgaggttgttgtcatacttctcatggttcatgcccatcacaaacatgggggcatcagcagagggggcagagatgatgacccttttggctcccccctgcaaatgagccccagccttctacatggtggtgaagacgccagtggactccacgacgtactcagcaccagcatcgccccacttgattttagagggatcttgctcctgaaagatggtgatgggatttccatttgatgacaaatttcc

SEQ ID NO: 6999 - DNA, 608 bp, mus musculus
gaccctctggaatcaagaactctacatccagcaggacaactcagagaggaagcggaaacaccttccagaccggtgggactctgagcatgcgggaggggtcaagaaggcagggctgtgggtaggctcgagcagccagggaaggcttccaaggcaaggcgggctcatagaaggaacggggaactgcattgtgggtgggtttcatagcataggcaaagggagggcaactggaaagtgcatctgatgaagagctaagcctggtgctggcaccttctccacagacaggatgggcctgcagccaagagtgagaaagcagcccccagaagtcagcactggttgcacagggacctgcgtgtgcggtttgtggacaacatgtacaaaggaggccaatattacaacaccaaggtgggaaccctgcagcctgagtccccctccctctcctagggactgggcccccctacctctctaaaatctcacatccccctgacctgtatccccagatgataattgaagatgtcctaagcccagatacctgtgtatgtcggacagatgaaggccgagtcctggaaggtgagtttgagcgatggcagctggaggttgatcaagaagag

SEQ ID NO: 7000 - DNA, 1019 bp, mus musculus
aggaccaggaacagagtcacggtgggaggactttggctctttaaagaatgacccatatagcaaggggggatgtgggccagtaccatacacacagttggtaatttgattaaaatcctaaaggtggcaaatcccactgactgtttcagaatcccccctaaagagtctgtttttgtgggtagggaagatgaagtgagttacggttgcaggagaaaggcacattactcaaacagagggccactgaggctcgggatgatgtaactggagagggagtcctctgcttggtgccagttttctaaattgatttctgagccagtcttctcattgcctttagtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggtaaacacttgcgagataggggtataggggtagagatttaaaaagcagaaggtcagctcatggggaaggtgtaaattaaggccacgggaaactcttggggacaaaactgacacatattcaccactgtgaactctaacacctggacaacttggggcaagggcttctacagcaatggttttgaattatgccatttttcataatcaaagtaccctttgttccaaagaaagctcacctgaaagcccaatattacataccagactactgtgaaggtattctggttgtcatatggggtagtgtgaccctacttcttatccccagccctgttcccctcttgcctcttgcaatcccctcagcaagactggcccctgaggcagcttgttggaacagggtttgaaaagcactgagccagagaagagtagtgaaagcaactgtctgtgtctacaaaagtggcactcaggggcatgactatagtgttcttctctgaagaaggctctcaaagcctcctgctccaatacaaataaaactcatatttgatgct

SEQ ID NO: 7001 - DNA, 1047 bp, mus musculus
atttgctgtctactccacacctgtggtaggatgcatctactctttgctcatactgcctgtccctctggttaaccacttcctcctattcttgcctcagaattttgcttcttctgaaaatcctctcttatagttgtattattgcccaaagtggcaagaatgtcccctttgcctcaactgtagcatggaactacagccttattctactccacaagctcttcataggagaaatggaggcttggagtggagatgagaactttgcccaatcttcaaatttatgtggaatttcaggaataaaacgcataaggatggaaatgtcttgaattgttcacatgaacgtagcctagaagagggcaaaaaagcggaacaggaagaagtaattttaatgcaatttgagactttccccaagtttcttgagaaatggaagagttggggggactgggaacagacggtacaaattacattaacttattatgaattacttggagtttttacccctaggagaaatcctggaaggatgtcttagtcagcccgggttgccataacacaataccattagactggggaatttaaacaacagaaatttatttcttacagttctggaggttggaagtctgagatcagggtgcccccatggttgggctctaggaagggccctctttctggcttgcagatagctgccttctcactgtgtcctcacatggtggagagagagaaagagagcaagttctctggtgtctcttctaataaggacactaatcctattgaattaaggccccacccttatggattcatttaaccttaattaccaccttataagctctatcttcaagtcatgttgggggttagggctttaacatacaaatatggggggacacaattcagtctatagcagagattatgctctgctttgccaagtcctcttgggttcttcccccctagtgttaatcaatacaattgagaacagaggacactgacaatcaagtcaatcagcaaacataggtgagatttgcctagacccctgtgtttccgttgtaacattagctctgg

SEQ ID NO: 7002 - DNA, 953 bp, mus musculus
tgttattagtatatcaacaggatgtttctgaaggatgtgaaatctgagttgacaccaaaggacacgctggaattggctaaatagggaactcagggagtggggtggtggattttcaggtagagggaccagcctttttgagtgtatagagggatgagactgcatgacacatttgcagaaccagctagagctaaggatgagtgtgagaaggtgttaggggtcatagctggagaagcacacaggagacagaacatgaagggccttatatgcaagaatcaggacttcatcctctgggcagccaggtcaattagagggagctgggccagtgtgcaatttggaggcaaaatttggagcatggtgttatgcagctaggcagggtgtttgttcttcagtttaatagccaccaaaatatcctcttcacaaaactgataaaagagcacgaggtcacagagtgagaagggcagaactgcgtccaggtctaagggttttgagtgccattccagcgagctcccaaagatacatggtttttctcactcagagattgcttcaataacagacttggtttgggttatcttttgtcaaaactggatttttttttataaaagattttagtaacggtctgagttttatgacaggcttatctgatagaacaaaatatctaccagcctgtgagaaagtgtccaaaattatgttctaaatgcataatattatctaatttatccacaatctcattactcttttctatctgcctctcctcactcttaccactgcccacttttctaaaagaaaactaaagcttccatatttgtaaaaggtgcttaaatatatagtcatttatgagacttctaaacagtagctgtttaagtttagcccaaataagagttttctctcaattataagttatcatttattgtatctgctgagtttggtctgctttttcatctttatcaaattta

SEQ ID NO: 7003 - DNA, 723 bp, mus musculus
ttcattccaagcatcagtttcgtatttagaagttctagtcttcccagttggactgctcattcctccagtcagggattgcattatttccatgttgcctccttcctcaaaggtttgcccaagctttgccttcagtaaataatgacctgtgatcagctcctgagctactcccaggagctgcctggagccattccccagtactacttgtggctccagggttggaagaaacaagtagaattttggggagaaagtcatctcactacctgctttctgttttgttctctgcaacacagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggtaaggtacagggagattctccgtaaggtgcagaggccactgaaacttggttggtaataaagctcaatagagtcatgtctctatcaatattataaaggaaagaggtgtttcacttgaatagaattttgcagacaactgaagcagaatagcacaggagaaagagcctttggttcaaatcctggcactgccacatagacacataatcttggatatatttattagtcctctgcaagactgtttccttatttgctataaagaggactaaattactcattatatac

SEQ ID NO: 7004 - DNA, 796 bp, mus musculus
ggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaagactgaatgcctggttatgggacataccaaattattacaggatccaaatgttcatc

SEQ ID NO: 7005 - DNA, 793 bp, mus musculus
ggtttgaaggagaatggggctcccatcagattataaagagatgtcccttgggttgcaggctgaaggggggaaatttcagctggggagctgggcctgacttcttacagattcctggtaagggctcgcagtggaatagttgcttaatgaatgtgggagctaggaatgcaaggcctgtgttgacatgtattataagaaatttctgtgtcccaagcatggcacagaagccacagagagcctaccaatctaaaaataccaagtgaacaatgtccctcagtgataacctgtggggataaacaatcctcctcaacaccttgccaaggtttggcattacataagaccccagaaccagttagggaagccccaagaatttaaccaagattgattccccactcctgccccagcagaagtagctgtatctacttctttttttttttttttttttttttgagatggagtcttactctgtcacccaggctggagtacaatggtgtgatctcagctcactgcaacctccacctcctgggttcaagcgattctcctgcctcagcctccttagtagctgggattacaggcgcccgccaccacgcccagctaatttttgtatttttagtagagacagggtttcactatgttggccaggctggtctcgatctcctgacctcaggtgatccgccggcctcggcctcccaaagtgctgggattacaggcgtgagccaccgtgaccagcctgtatctacttctttatgtggcagtttctggcgtttgagattgaattgagaaaggggatcattaa

SEQ ID NO: 7006 - DNA, 1483 bp, mus musculus
tgggatcaggcgcaaatcctaccaccttttctccaagagctaagcactgcatgaactaggtcccctgctggggagcactagtgacaagtgcccaacctagccctgtggggctcatggtagcagctataacacacaaaagagtggtcaggctaccttcttccttcttgacatccaggctcacgctgcttccagctgtgtgcaaagtaacgtcactaggtgcagggtaggctagcaaatgaccttctggagaaggcccagggacccactctcctcagcttgcaggccaaggaggcttcaaacaaaagtagtaactatgaccccatcagcagctccaaattcattcagcaagccagaaaatggtgagcgccttctgggattcagacagtgtgttagaaactggagctgcagaaaatcaaaaggcctgttctttgccctgggaggagctgtatttatcaataccacctccagaggtaaacaaggtgggaatctgaggtccaggttcctcggtgactttctcttctagagccacagaagtggcaagagagagatcctagacaagaccctatgtccattccctgcaaacccacagtgctttcctctaggccaccctgctgccggtctctgcctgctagtgcactctcaaggtctctgtcctcaaaagaaacaccacgtgaaggcaggggaagaggtgtgagtaaccctggccgcggcatccaatccttctggggaccaggccggattacattcctcccccgacccgcccttttacccaagggggcttacagcagtcagtcagccccaggtcagtcagctagtaagtgggagagctgcagagtaaaaagatttgttgagcacctgcctgtcccagaggcatgccacatattatctctgccaggccggtgtgattactgcccatttaacaggatgctcctccggctagctcaggggaagaggtaatgtcttccccaaccctgtctgaatccatgctttcttcggctctggtggcaagttatcatccaatggtctaaaatggttctttgcaagtacgggccaagaagcttaattcagtcagagaaccagcagtataagaggagaaagactgggagaatacctccagctgccctgtcagagagatgactgctggaatcctgaaggcctcaggcaggaggctctgcaggggattgggaaacaagggattgggtgacaggtgacctgccctagcgcaagaaggaagcgatcaatgggccaggcttattctcttgtggcctgggggttcagtctccctaacacactacaggagtactgcaaagagttaaacttcctttgattagataaaggctgaagaagggcgggacttccggtggctgtgaaatgaaagacaggggtgagggagaggcagggaaaggggcttctggaaggtggagagaaaaagaaaacattcaccgtgccatttacaaaaattctttgagctttgcggggcatc

SEQ ID NO: 7007 - DNA, 1067 bp, mus musculus
agacaatgctcggtcttcccagtcaaaaaccattaccggtaaccagcagtaaaaaagagaagctcagaggcactgaaattgcaaccggctcctttaattctccatagcggatgggtggggccaggcccacccacattagagaggctgaaggctcccagcgccctaccccgcccgaggggcggagcctgagccaaggccacgtgatgatgacagacggcactctggctttcctggagctgtctctatggtattcttcccagcccacccgtccctttggtagcggcagtcacgtgacagactccggggtaaggcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgaagggtatttgtgaaacctggaagtgggggtgttcaaattgaagagagtattgtgaattagaacacttctccccacc

SEQ ID NO: 7008 - DNA, 301 bp, mus musculus
ttacttttctggacacgggtcaaattatggtttataatttgcaccatattccatgtctaggttacctgtttacagaaatgctcagcatgaagaggagtttctatatctgttctgccatcacattttcctacttcagagcatttacttagtccggttggttgtctgtctgtgtattcacaaactttcacaatcaactcaatagggaataaagttttttttttcagcagcttcatgtgcagtctccttaagtactttttcctatgacttggtcacttttctccctctcattgtataaagactt

SEQ ID NO: 7009 - DNA, 995 bp, mus musculus
aaagagctgaccagaattccatcacaggtctctgtgagctggggtaggcaagactggccaacaggtgcctgtgaggggtctgcagacaccagctttgtggggaaggtctaaccagaatgtggattcttgggacagcaggcctcttttagtggattatttgtcggaaccacctgtggtttcaggcagctgctgaaagaagtgtggacagtcaggaactccccataacctggagagaaacactaggctcaatcttctgatgcccctcgtctctagatagaaaacaaacattccagcagaaggaaccggtgtgatgagactgctgtacctgagttcagtaaggttccatttttttctgggtaaagtactttccaaatgcaagatggcacatctcttaagttctgacccactaacccatcctctaccaatattgtttatctagcgcaggacaaatgtgaggaggcagcccgcagcccagcacatgtggggaaccgtgttagtgtgttcaggctgagggttggggttctgctgggtaggagcgtcctgaactccctgaaacaggaaaagccttacgggtataaactttcctcctgattaaccttactgagtcatccttgtcagaatgcccttctagggaacctccaatgtatctggcatctttgacagatgccacttcctttgtgcatagagccaggaagagcaatgtggacactaccagaagtccaacattttcctgggccttccgatctctcatgggccccacaccccacaactcttttcctgtattcccaatccctctgtcagtctttcttctttgaactccttcttcctcagtggccctcttcttctaacctctctaacactctaacccacatagcctcttccattgagtatcctttatcctctccacagaccctgtcaggttgatccttctcctctttactctggacctcttctaaggttctttgtgttcctctctactcaatttattctgtgta

SEQ ID NO: 7010 - DNA, 338 bp, mus musculus
aagagctgaccagaattccatcacaggtctctgtgagctggggtaggcaagactggccaacaggtgcctgtgaggggtctgcagacaccagctttgtggggaaggtctaaccagaatgtggcttcttgggacagcaggtttcttttagtggatcgttggtcggagccacctatggtttcaggcagctgctaaaagaagcatggacaggcaagtactccccataccctcgagagaaacactaggctcagtcctctgatgcccctcatctctagatagaaaacaaacattccagcagaaggaataggagtgatgagactgctgtacctgagttcagtaag

SEQ ID NO: 7011 - DNA, 533 bp, mus musculus
ggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaacctt

SEQ ID NO: 7012 - DNA, 533 bp, mus musculus; identical to SEQ ID NO: 7011

SEQ ID NO: 7013 - DNA, 1011 bp, mus musculus
ccaccatgagaggacaaagtttctctctggcttttcatctgattagagctggaagcttttcaagcactttctccagccagccaatatcaatttaatttgagccactatcgtcttggaatatgaaattgcctccatagacaggatctccagtgaagtcatcagccccccagccctgcccccactgaccagtcaccctgcatatgtgaccagtctgcatgtgcccagagagaaaacagcctgctgagctcatggcccgtctgtgaaccatccgcatccatctgtgactgggtgcctgttaggtgccaggctctatgagaggctctgtgaggggtgctcaccctcctctcccctcgagctccccttcccagcagctctgtatctgttggtggttttgctgttggcgccgtcttttgtgtgcacagtgtcatcatctttaactctgcctgacccctgccatcagtcaccaagccctgctctctgtctgtctgtgtgtccttcacagcttcactccctcccatctccactgccagtgccccaggtcagccctccccgactctggcctcaactgtcggaacaggctcctccctggtctccctgcctccaggctgcctgtccaggccagcctccacatggtcacttggtgatcttcagaaacatagccttcatgtgtactcagaattggcaggtgaaccctcacacacacaccaatgcacacacttaccttcccagccctctcttcctcccacggctcctcagcacaggccgtgccctctagctgggctactcactgcacgcagcagcaccgtgtgcttgctcttgtctctgggcttcccgggccctacctcctgcacaaagccctcccttggtctttcctgccctcctcgtgctctctgtctccctcagccccgcagtgcctgcagtaggttcgcagtgctcatctggcctccctcccacatcctgctttgtcttgtcagccgctgctttttttttcttttcctccattccaggctg

SEQ ID NO: 7014 - DNA, 1349 bp, mus musculus
gaaactgaacataatacaagttgataggcctgcaaggctggaaatgagcagatccctctcttctctggcctagctgagcaacctgtcatgagctccaaggttatgcctagaagtgttctggactccttctgcatggaacaaaaactgtgatccctttatgggagcaactacagcccagcctggaatggaaaattaaaattaaaaaaagcagctgctgacaagacaaagcaggatgtgggagggaggccaaatgagcactgtgaacctactgcaggcactgcggggctgagggagacagagagcacgaggagggcaggaaagaccaagggagggctttgtgcaggaggtagggcccgggaagcccagagacaagagcaagcacacggtgctgctgcgtgcagtgagtagcccagctagagggcacggcctgtgctgaggagccgtgggaggaagagagggctgggaaggtaagtgtgtgcattggtgtgtgtgtgagggttcacctgccaattctgagcacacatgaaggctatgtttctgaagatcaccatgaagatcaccaaatgaccatgtggaggctggcctggacaggcagcctggaggcagggagacgagggaggagcctgttccaacagttgaggccagagtcggggagggctgacctggggcactggcagtggagatgggatggagtgaagctgtgaaggacacacagacagacagagagcagagcttggtgactgatggcaggggtcaggcagagttaaagatgatgaaactgtgcacacaaaagacgacgccaacagcaaaaccaccaacagatacagagctgctgggaaggggagctcgaggggagaggagggtgagcacccctcacagagcctctcatagagcctggcacctaacaggcacccagtcacagatggatgcggatggttcacagacgggccatgagctcagcaggctgttttctctctgggcacatgcagactggtcacatatgcagggtgactggtcagtgggggcagggctgggggggctgatgacttcactgggagatcctgtctatggagccaatttcatattccaagaggatagtgacttaaattaaattgatattggctggctggggaaagtgcttgaaaagcttccagctctatcaggtgaaaaaccagagagaaactttgtcctctcatggtggtccattagtgtgattaataataaatattcccagacacttgatactggcaaaacgccttatcagccctgcttatgattactcacctgctatctcgaaccattagtctgaccaccaaggtgcgggggtgatgcgaatcttaaaatacacc

SEQ ID NO: 7015 - DNA, 159 bp, mus musculus
ttacagttactggagttttggtagattattgcaacactcttggtagattagtagttgaagtgatagaccttggagtctcacttggtcaggaatggaagaaaagacaggatgaagctactaggttgaggaaaaaaactgaaggttttgaaagctagaggt

SEQ ID NO: 7016 - DNA, 159 bp, mus musculus; identical to SEQ ID NO: 7015

SEQ ID NO: 7017 - DNA, 159 bp, mus musculus; identical to SEQ ID NO: 7015

SEQ ID NO: 7018 - DNA, 1154 bp, mus musculus
aactacaacagaatcttaggggagggacccaggtgtcactattttttggcactcccaaggtgcaaccaagactgagaaccactggtctaagagattagccaaaccaactccctcgtggtatgaatggagaacttgattccagcattgggaagggatattctcctgatggcagagctgggactaggaccattcactatgctgagctaaaacaggaaatgcaaactttacaaatagtggggcagaaggaagatatgatgtttgatagtttggaaggaggttataaacaagataaaccttggatagaagtggccttgggtcagttcagaaaagggaaaggctgagtgccaacaccaaaaggtaaagcaacatttgaattacaggccaggcatctggaaatgatggcactgtacagtttagaagcttgattttcaagaaagcagtgttctcaaggctacgttgagcaacttctttgattctgtcttgtgcatgtgggtggatagatgggctcgcagtagaggaatgggcaaggcatggagaccatctgctgtcttcttcatcgtttttaatcccacacctcctgcactgtccaggcaaagcaaatatcctgaagtactgagttcttaatttagacttgtccttctttcctgcctacccatactacatagagagagcatgtttcaccccacaggcatgtgtgcaagttgagaagagcagcagccacaagctgcagcaaggagcagctgcacccccagcagcctgggtacctcacatccagcagaaacttggccaacatcaattattcagggcatgatgagctaatttggggattactattgatgtcagctgtattgtttctcctcttccctgtctgcttgcattcttaatcgtctacattattttttgaggaatcaggacagggagatgggtgggaagagcagccacatgacagacaggcaaaataagggaataattctagtcatattgccacttgttggcccttgtaaacacaatcaaggtatatacaacacatacttggataagtttgggtgagaagttggatgaatcaaattatatttggaggcctgtgtaaaaatattcatagcagctttaacattttttggggggctaacttaagcaatatcctattggaataa

SEQ ID NO: 7019 - DNA, 1154 bp, mus musculus; identical to SEQ ID NO: 7018

SEQ ID NO: 7020 - DNA, 1012 bp, mus musculus
agaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccat

SEQ ID NO: 7021 - DNA, 1012 bp, mus musculus; identical to SEQ ID NO: 7020

SEQ ID NO: 7022 - DNA, 1194 bp, mus musculus
tttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgtattttgatgtgacaatttctaactcactgtccctaaccacactaattaccgtaagttcttcatttcttttttctttttctttttaaattaataaattaatttattttttggagatggagtctcgctttgttgcccaggctggagtgcagtggtgccatcttggctcactgtaacctctgcctcctgggttcaagcgattctcctgcctcagcctcaccagtagctgggattacagtcatgagccaccatgcctggctaatggttgtatttttagtagagacggggttttgccatgttggccaggctggtcacgaactcctgacttaaagtgaaacacctgcctcggcctcccaaagttctgggattacaggcgggagccaccgtgcctggcctcatttctttttttaaactaccttaatcacccagtgtgggtaaatggtttgaagtctcatttcttacagcatcagttgctttggtcaaggatactgagaagcacaaacccagtaaaaaatgtgagaagcaaaaaacttgaggatcaaaagtgggagaggagaagggtataaactgtaaggctgtgggaattaagcattcatgaaagaggcccagaccctgagtaggtgaagggatcttcagtgtttctagaattctgaatgatcaaat

SEQ ID NO: 7023 - DNA, 1194 bp, mus musculus
atttgatcattcagaattctagaaacactgaagatcccttcacctactcagggtctgggcctctttcatgaatgcttaattcccacagccttacagtttatacccttctcctctcccacttttgatcctcaagttttttgcttctcacattttttactgggtttgtgcttctcagtatccttgaccaaagcaactgatgctgtaagaaatgagacttcaaaccatttacccacactgggtgattaaggtagtttaaaaaaagaaatgaggccaggcacggtggctcccgcctgtaatcccagaactttgggaggccgaggcaggtgtttcactttaagtcaggagttcgtgaccagcctggccaacatggcaaaaccccgtctctactaaaaatacaaccattagccaggcatggtggctcatgactgtaatcccagctactggtgaggctgaggcaggagaatcgcttgaacccaggaggcagaggttacagtgagccaagatggcaccactgcactccagcctgggcaacaaagcgagactccatctccaaaaaataaattaatttattaatttaaaaagaaaaagaaaaaagaaatgaagaacttacggtaattagtgtggttagggacagtgagttagaaattgtcacatcaaaatacaaagttttcaaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaa

SEQ ID NO: 7024 - DNA, 1244 bp, mus musculus
aacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctg

SEQ ID NO: 7025 - DNA, 1244 bp, mus musculus
caggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggtt

SEQ ID NO: 7026 - DNA, 3945 bp, mus musculus
tgttataactggagttctatgtgcttgtgaccattcttggtttctccgaatatcctagaactttggtggcgccctattatacaggttgttgaagaaatgttaccatgtggattgagtaggaaacaattctctttatcttggcaatattatggcatggcactacttaaagtacaaattaaaagagggggatgctacagaactagctgacaggcactttgatagaggtggatttctcagttcttaaaatagctctttataaaggaagccagaggcattgtggaggagaattcttacataactcatagggttagaccacatccgaccttttctgtgtggcttcatggctctcttggttgagaaagcattagtttctccttccattagtttcaacctcttgatttcttgacccccctactatattttgtgctgagaacacaagggtattaacaacccacattgtagaggatcgctcagtaataaagactggagaataaaatgcagcatgggaatattggcaattactcagttctaaatttctcttggaaatgagggaaagcatacagaatagagctggaatgaataggataattttttttttttttgctaagttggtagccagaatataacagctccgcacaactgtaaatgtccactcttcaatccacatgaagaaaagggtaaaaatatggttgaactcaaccactagttgcccattagaacagactttcccagtgtactgcatttcaatactttttcttttatctcttttcagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaaggtgcgtaagctgtccctaaaagcataataagtagtcttaattttgattttgttttccagtatacattgcacttagtgtttcactgaggtcgtattcatcattattctgcatatgatttggtaaaaacagcttcctaactaacctgggaagcaactgggtgtgagattaactggttaaagtgatgatgtaaagagggtagcgggttgcatgtgttcgggtgtttggagtgggactatagcacgtggcagaggcttacagctaagttgttcttttaggagaacatggacaactgtcacatcagtgacattgatcacatgggcaaatcattctgttccatgtggtccccaaagtctctcttaaagccttacagaagaactttgccaatcatttacatacttcaggatggcttgggatgccatggtgtataatacaacaagtgagaggtgtgtctttttatgctatggttgctgattgatggaagccgcataaatacaaatggaaacctgactaaaaatggcacaaagttatctgtcatcaggcaggagctaaagaaccaggaccctacattctctaggtcagtgttgggagaggctgattagcgagtgagaattggcagataaaggtgaccattcggtgcaataaatcctgaacgtataggctttgcccagcattcttcgtaaatagtgggtagctataaatttcatgaaatattttcatgggtaagaactcttgaaatgttataattgactagaaatctctgtagatttagaaatagagagttactaacaaattgttagaaagtctaggaactagaaagctaagttgagagttatctaggaagatctatctattgtactcataatctttagataaattctcctagggccagtagtctatgtgaattttctttttcttcttcttcttcttctttttttttgtattttagctgcaatgttaaacaacctatgtgaattttcttattgtgagaatatttgccttccagagtgactcacctttatctcaaagagcaatattgtgagttttgaaaatgctgctctaaggctgtgttttgttagtcctgagccaggagacttaaagcaaacttgaggggtcttaaaacatcgaagtgagccttaaacattgggaagaccttatgtttttccctctcatatctattatttttgtgatctcagttattaatcatttaaagggactctttcctagctgattggcacttaaaacaggatggaagtctttttttttttttttttttttgagatggagttttgctcttgttgcccaggctggagtgcaatggtgcaatctcagctcactgcaacctctgcctcccgggttcaagcgattctcctgcctcagcctcccaagtagctgggattacagtcatgcaccaccacgcccggctaattttgtatttttaatagagacggtgtttctccatgttggtcaggctggtctcaaactcctgacctcaggtgatccgcccacctcaacctcccaaagtgctgggattatgggcgtgagccaccgcgcccggcagttctggtctttaactaaggtataaggctatgactggtagtggtgtctctagtgactcatcaagtgatatttggcaagacattttcccatttatgccagtttcctattctgttgaatgaggaaattttctctctaaagacctaaaagttttgactttataggtttcaaagttctgtggaaacattttctattgcttattaatttgaatcttatgtaactctagcacagtactcaatatttatggcatttacatggtttatctcatgtttttttatagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaagtaagttgttgatgttgcagtcctgtgaggatcacttcagaactgttataacagctgttttttgggagctggtgttggatggggtgtgttggtctaatgtgaagtggggctaaatgtgagatggaaagatgaccagtcttccatattactgactgggttcactgaagcaactcaaagacattatggtcttcttaccagttgtatcacagaagaatttagcctttgcttgtgtgttctatgtcttcactgtataggccctctgtcattcttagagccttaaacgttgagaagcttaaaacaccatttctgctttctgctgaaagggtaaccctttctcatctccgtttgtgagagactctgtcgtcagttaagattagtgtaaaaagaaaactaaactctgaagtagccattataaaagtgtgagaatgaagtcagttttctaaagagttggggaaaggtgatgctaaaggaggggattgagcaagtcctatcaaagagccttttatgaaaatacttagtcatctgtgacatcccatttggctcttccagaaatcctagtaaatagttgtaacaggatgttaagaggcatacattgtgtgttttaaatcctctgctactcattaggtatatgacctttgacaacttaaagtctctagacttctctgtttgtgagggttaaatgaaatcatgtatgtaaagtgctcacctattgcagtgcctggcacatgtcaagtaaaaggtaacccaagaagactcataagttcatttcccacaatataagtgaccactagcactatcaggtagcaggcagagttggcatgctttggttctatgtaagaaatccctaaggtaaaagtttataaatagaagagcatctgtgttggtattggtggttgttattattgtagtactataagtagtattcgtagtaacaatagtttattataattactaatgacacttttt

SEQ ID NO: 7027 - DNA, 3945 bp, mus musculus
aaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagagctataaaaaaacatgagataaaccatgtaaatgccataaatattgagtactgtgctagagttacataagattcaaattaataagcaatagaaaatgtttccacagaactttgaaacctataaagtcaaaacttttaggtctttagagagaaaatttcctcattcaacagaataggaaactggcataaatgggaaaatgtcttgccaaatatcacttgatgagtcactagagacaccactaccagtcatagccttataccttagttaaagaccagaactgccgggcgcggtggctcacgcccataatcccagcactttgggaggttgaggtgggcggatcacctgaggtcaggagtttgagaccagcctgaccaacatggagaaacaccgtctctattaaaaatacaaaattagccgggcgtggtggtgcatgactgtaatcccagctacttgggaggctgaggcaggagaatcgcttgaacccgggaggcagaggttgcagtgagctgagattgcaccattgcactccagcctgggcaacaagagcaaaactccatctcaaaaaaaaaaaaaaaaaaaaagacttccatcctgttttaagtgccaatcagctaggaaagagtccctttaaatgattaataactgagatcacaaaaataatagatatgagagggaaaaacataaggtcttcccaatgtttaaggctcacttcgatgttttaagacccctcaagtttgctttaagtctcctggctcaggactaacaaaacacagccttagagcagcattttcaaaactcacaatattgctctttgagataaaggtgagtcactctggaaggcaaatattctcacaataagaaaattcacataggttgtttaacattgcagctaaaatacaaaaaaaaagaagaagaagaagaagaaaaagaaaattcacatagactactggccctaggagaatttatctaaagattatgagtacaatagatagatcttcctagataactctcaacttagctttctagttcctagactttctaacaatttgttagtaactctctatttctaaatctacagagatttctagtcaattataacatttcaagagttcttacccatgaaaatatttcatgaaatttatagctacccactatttacgaagaatgctgggcaaagcctatacgttcaggatttattgcaccgaatggtcacctttatctgccaattctcactcgctaatcagcctctcccaacactgacctagagaatgtagggtcctggttctttagctcctgcctgatgacagataactttgtgccatttttagtcaggtttccatttgtatttatgcggcttccatcaatcagcaaccatagcataaaaagacacacctctcacttgttgtattatacaccatggcatcccaagccatcctgaagtatgtaaatgattggcaaagttcttctgtaaggctttaagagagactttggggaccacatggaacagaatgatttgcccatgtgatcaatgtcactgatgtgacagttgtccatgttctcctaaaagaacaacttagctgtaagcctctgccacgtgctatagtcccactccaaacacccgaacacatgcaacccgctaccctctttacatcatcactttaaccagttaatctcacacccagttgcttcccaggttagttaggaagctgtttttaccaaatcatatgcagaataatgatgaatacgacctcagtgaaacactaagtgcaatgtatactggaaaacaaaatcaaaattaagactacttattatgcttttagggacagcttacgcaccttgacgtgtggtggttgtttttgagactttatcttcctatctgggaccaggaaagtatcttgacagaacctcctgacctagggttgttgcccagtggtagtgagcttttcccctggaggatcctcatgccccatctccacctagggatcgtcaaagggaatggatcactaacactgtaaaacaacaagcctattcttctgaggaagatctgaaaagagataaaagaaaaagtattgaaatgcagtacactgggaaagtctgttctaatgggcaactagtggttgagttcaaccatatttttacccttttcttcatgtggattgaagagtggacatttacagttgtgcggagctgttatattctggctaccaacttagcaaaaaaaaaaaaaattatcctattcattccagctctattctgtatgctttccctcatttccaagagaaatttagaactgagtaattgccaatattcccatgctgcattttattctccagtctttattactgagcgatcctctacaatgtgggttgttaatacccttgtgttctcagcacaaaatatagtaggggggtcaagaaatcaagaggttgaaactaatggaaggagaaactaatgctttctcaaccaagagagccatgaagccacacagaaaaggtcggatgtggtctaaccctatgagttatgtaagaattctcctccacaatgcctctggcttcctttataaagagctattttaagaactgagaaatccacctctatcaaagtgcctgtcagctagttctgtagcatccccctcttttaatttgtactttaagtagtgccatgccataatattgccaagataaagagaattgtttcctactcaatccacatggtaacatttcttcaacaacctgtataatagggcgccaccaaagttctaggatattcggagaaaccaagaatggtcacaagcacatagaactccagttataaca

SEQ ID NO: 7028 - DNA, 7665 bp, mus musculus
gtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacct

SEQ ID NO: 7029 - DNA, 524 bp, mus musculus
ccctttgtgcttccataatccattgctttgataaatagagtaaatctatttaaataaacctattgtaaaactctttgaaacaaattcttaaatgttactagcttagagtatggtcatatatgtaaaaacagtaaaatcaaactgtattctgtttctagagtttatcaccacctaatacagctctatgtttacaaaaagaacatgctaccagtcttttaacaaacacttattgggcacccgccatttggcagacattctactaggcaccggggctatagccgtgaataagaaacagccttgccctccaggaattcacagtttgaaggagaaaacaggtaggcaaaccaatactttaaggtgtggtaaatgcttttgtagagcgacgtgcaggattttatatgagcccggagatggggaaccaccttcagtccaaggaggtcaagaaatactttgcaggtgaacaatttatagatgaatattgaagtcttgtgggtagatgttggactggtggatgaatggggaaa

SEQ ID NO: 7030 - DNA, 1595 bp, mus musculus
taggagaaagctctcatgtggccaagttttgcctcctgccataagcagggggaacaaacagtgagtggcctgtgtgacctttgttagagtcagctacaggcagttgacggcctcatgtggctttaaggacatgggggctgacagggcacaaaacaagttcagcctagaggacagcaaggtaatgctgcgtgctctaaggaagagggaggttacagggaaagatacagaaacctgtccttcttgcatttagaaaacttcccgtttcttgaatttgagagcaatagcaccttgcaattatggagcttttgtagccaaagccttctcatggtctcttcctcataatatgcctaagagtgttgagtagaagcagagatggtgtcccccgttttacatatggaaaaactgaggcccaaagagactaagtaccttctctgaggttccattcttgccgcaaaagatggtttcatcaggcattttatcaaaggcacacagggctggcctccagttggggacaaatgactggtagctcatgtcacctgaacagctttctcttagtttgatgctggtaatgggaatagtgttcactttttgccctaggaatcctggagtttatcagcctggctgtggggctgatcagcatccggggagtggactctggcctgtacctaggaatgaatgagcgaggagaactctatgggtcggtaagtttaaggttttttttttttttttttttttttttttttggtcagaggttattacaaccagtgtttggacaatgtaaagcaaaagtataaaaatatttatctggggaccaggcatggtggctcacgcctgtaatcccagcactttgggaggctgaggtgggcggatcacaaggtgaggagttcaagaccagcctggccaacatggtgaaactccatctctactaaaaataaaaaataaaaaattagccgggcatgctggcatgcacctgtaatcccagctactcaggaggctgaggcaggagaatcacttgaacctgggaggcagaggttgcagtgagccgagattgcgccactgcactccagcctgggcaacagagtgagactccatctcaaaaaaaaaagaaatttatctagcacttgaaagcccttttttagctgtaaaggagtagtgtcttctagttacttcttggctgctcagggtcttgctacataacaccttcactcatttggcccccaccaaaacaagctttttttttttttttttttgctttgagatggagtcttacactgttgcccaggctggagtgcagtggcgcaacctcagctcactgcaacctccacctcccctgttcaagtgattctcttgcctcagcctcccgagtagctgggactacaggcatgcaccaccatgccaggctaattttttgtattttttggtaaagactgggtttcaccatgttggccaggctggtctcgaactcctgacctcaagtgatccacccgccttggcctcccaaagtgctgggattacaggcatgagccactgcacccggccccaaaacataagcttttctctgatacatgtgattttgcctttttcattagaaggcc

SEQ ID NO: 7031 - DNA, 1454 bp, mus musculus
taaaagctaagccaattagtatagtagtaatagcagacaaaaaaaatgagagaagtaaaggaagttttgggggaacagaaagaagaaagagctagtgtggagatactaaaccgaagcttgtggaacttgaacgccattttgaagctagttccttagacgattcggtcgaagatctgtctctcggctgccctctatagagctctaaacctggcttcaaggagttctttcattcttcattagataccacccaccatacgtcattttataaagccggaaactacatttcccaaaaggcctttatttttcctcgcgggaaaagggattgcaattactataggttttacaggtatcgcgagatttcgtcaaatctcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaaggtgagcaaaaattatgacaaatcatttacaacaaccttatatcaatgtgtcctcgcggcctctcgtgtgctttccttttacgaacatctcggccttctaatcttgaatgctgtctgtctcccatctcgtcccaagtcattgggatgatgtccttagcattggctttatcacccagtatttctgtttcggtttccagctctctttctgttatcggagtgatagtctagccctgctttttaattcttcagtaacctttgatttcagggaaggacattcttggtagacacctcgttccttaagtgatgtcctacattttagctttggggatatgtttactcctaaccctgtatagaaaaatatcttctccaattcctattactgtaatagacggaaactgtaaatctagctcttcacctggtttaattgcagggaaacaacccaaatggtatcgatgcagctttgaagttatttgtggattaacaatgttagctggccaggcgcggtggctcacacttgtaatcccagcactttgggaggccaaggcgggcggatcccctgaggtcaggagttcgagaccagcctggccaacatagtgaaacgccgtccctactaaaaatacaaaaattagccgggcgtggtggtgggcgcctgtaatcccagctacttgggaggctgaggcaagagaatcgcttgtacccgggaggcggaggttgcagtgagccaagactgctactgcactccagcctgggcaacaagagcgggactccgtctcgaaaacaaaaacaaaacaatgttagctgtcctgaaggcaatcgtggtcatttttttcttatccaaaggttgggcaggtacagggagttttgagaccagcattatgtagagaaaatgcaatagattgaggagaacaaattaattttcatacttgattt

SEQ ID NO: 7032 - DNA, 1076 bp, mus musculus
atatgagaatggattggaatttacaagctcaagctcagccaacacagaccaccaaagtgacgggcagtctggaaaccaagtacagatggactgagtacggcctcacgtttacagagaaatggaacaccgacaatacactaggcaccaagattactgtggaagatcagcttgcacgtggactgaagctgaccttcgattcatccttttcacctaacactgggaaaaaaaatgctaaaatcaagacagggtacaagcgggagcacattaacctgggctgcgacatggttttcgacattgttgggccttccatccggggtgctctggtgctgggttacgagggctggctggccggctatcagatgaattttgagactacaaaatcccgagtgacccagagcaactttgcaattggctacaagactgatgaattccagcttcacacaaatgtgaatgacgggacagagtttggcggctccatttaccagaaagtgaacaagaagttggagaccaccgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtatcaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgttatcttttaatgttgtatgtctgggatgcaagtattgctaaatatgttacccctccaggttaaagatgattcagctttaagatgttacccttccagaggtacagaagaaacgcatttccaaaaaaggttctttcagtggtagactcggggagaacttggtggcccctttgaggtgccaggtttctttttcatctagagatggctgcgagtggaagctgataatatgtaggcactttgtaaattcatattgagtaaatgaat

SEQ ID NO: 7033 - DNA, 1500 bp, mus musculus
tctaatgggactggccaatcatctttgaactcatcttgagttctgtgactttctcttccctaaggacaaattatttaacaaaggttatttggcccgttaggtagctaggatcttggcattgttttttcaagcagttctccaagtatgctcagacatgttaaaagcctaagtggaacagtggttgaggatatgctgatatcccctacaacttttattatactcttccatgtataaaaaaactttatagtacatgttacagtctatatcttcactcatgaattggctcttccaagaatcagataataagcagccctttatctgggcactgtaagcttggttaataggctcagattctcacataccaaatcacatcctcccccaggataaccagagtgatagaacaaaactgggctattatccaggtttcaaattactcctagtgtgaattagcactctttttcaagatgagcattttcccttcagttccttgttctcttaccttagagacacaggcctccaggttttgtttcttctagaaattcctgaggcctctctagaaaagcctatgttcaaagaccactgtccattacaaagtctatgggtatgggtaggcagactcccttacttatgatgacaaccactccaatctcatttctaactctctctctagcttagtgtctctgtttcccatggaaatgagacatagtcaactgtaaacttttcctaggcaaaagacagcctcatccaccagtcttagttcccaagcactgggatcacagacatagaaagtcttctccccaattaatttatagttaataaatcctacttgtagacccgctgtattagatccatcctatttcctgccaactgtttttatacaggctgtggccacaaactttagccccactatataggatgtaagtgtacccctgacattcatttcatactgaaaggggagacgcaaagtctacaatagtactcatcacccatcttgaagttactggtaccaaacttgagcactgacagtactgttgtgactcacagcggtatttcatctgggaatttccaggtgtagtttctcacttcacttacccacatgctagatcaagcttattgaatctccattctcaatagccaatccaaattaggggtctgtggacagtcagccccccaccaaataccccaaagtaaaaggtaaacaaagtgggcattttttagaaccttcatagccacatgataagaatgttatgtgctggttccattaacccttttctctgcccccactgcctgcttcctagtatgtacagcaaagtccaatgaaatattttaagttgtgaatcataaagaggatgttctggatttttgtgtatccactacctctagagtactttgcataatagtccatatatagaggtcacctggaatacttcgcataatagcctatagagagagaagcatttcttccataaaatctaggcaactgtgattagagccctttaa

SEQ ID NO: 7034 - DNA, 242 bp, mus musculus
tgtcatataccatcatgaagaattattttggcggtgttggttctttggagatgatctacaatcttcagtttgaatatactagtttagagagcatgaaatgttattatataatgttttaaagatgtggacttggcttcaaaaataataacttatacaagaattcaagggaaaacatatcaacaatgtatattagatatgaaaatctcaagattagaggacaatactttctcttgtaatttttt

SEQ ID NO: 7035 - DNA, 656 bp, mus musculus
ttgttgtggttgtgttgcttttttaatggggaagggagggtacaggaaggtgacagaaatgttatttatatcaaaaaaattaaatctaatgaaattcaaaacaatttcaaatggtaagtgtgttttctaaccaactattgaaaaaatattattcatctcaatgaagtatttaatgatcaataagccatttaatttctaacctctctactttataaatacagaatacttgacttttataagaagctttggaataatcgagaatatataatcaaataattatttcattcagaagaatagtaaggcaaacaatgattcattcttctgttattctcaccatcatcgtttcctgggctcattttcatcaataatattatattttctgaaggataatccccaaatgggataaattgagatagagctgcctggagatatttatttttagatttgggatactttcatatggccatggttcccagagagggcaatcaagacttactgtgggtgagtgtttgctgagaacttgatacctttggtagtatttgctttttaacttagtctgactgctacttccaggcctcttgaaacttgctagtagaaaataacttcaaatttatgagtgatatgtttcaagagttcagtcaatgtaattggcctta

SEQ ID NO: 7036 - DNA, 943 bp, mus musculus
acatttttatctagagaggtttgatgtatatataataatgattaaaggtttactttttctttttcagtcatacattatttatgcaaagagaatatttcattaaacaaatgggcttattaaaatatacaattcaccattttgcaagaaagagtatagggcatagtgaatagacttctattgaggccactatttggagaaacattgtttcagtcatttatactgtaggtctaagatttgtattaagaaaacacatgtagcaataaatccattagtcagtgctgagtttacaaagtaaatagaggtaatgtgtttaagtagtttatagtgcacatcattcattatgaagtcatctcttgctttgtggtaaagccctatttaaaatatgactacagtagtcctcccttatctatggttttctttttcatggttacagtaacttgcagtgcagtacaataagatatttcgagaaaggccacattcacataacttttattacagtactttgtcataactgttttattttattattatgttcatttcttaactaatttataattcaactttttcataagcatgtatgtataagaataaatgtagtatatatagagttcagtactctctgcagtttcagacatccactgggtgtctcagagtatattatctgtggatacgggggcctactctattctatacttcttgtaacttcttcacttcaaaaagcattgaatttttattataacaaatgtattatctatagattttaaaacttgcaacagagtcccaacaatcgtagggcccccaacaatgccttagaacctttcttttgaattcccagaagtctgccccacttttcaatttttttcaccaaaaaagaccccttaaaatctgttgagttcaataaggaaacaacattttatacgtggggaatatgttctgaatgcag

SEQ ID NO: 7037 - DNA, 207 bp, mus musculus
gtttttggtgtttgactttaataccctcaaaataaataggcagataaaaataaaaatcagctaccattttattgtgaatgaattatgacagttaaatagatggagcaatagtgtaatttcactcaacaattcatgttcaggatttctggacacctacactaaatattttgtctcatcttcgagagattttagtttctagcatgccga

SEQ ID NO: 7038 - DNA, 1234 bp, mus musculus
agacaaatgtggattcattcctggctccaccacttaccagctgaatgactttggtcaagttagttaacctctccaaattaaaattttcttatctgtaaaataaggacaatgtaaaaatagtatctgcttcatggtgggattatgagataatgcatgaaaataacttagctacttgctggggacacaggaagcttgtcaagatcaccagtgatccacacattgccaaatccaggagttgattctcaatctccatcttatgcaatccatcagtaacctttgacacaggttaaattccttcctccttcaatctcttcacttggcctgtgggatatctcttgctcttggttctcttacctcattcactggctttccaccttaatcttctttcctacattctcctaaccctcttaacatcttctaatcttaacccaaaagactcatttgtactcagatgtttagtaagcaattcaaatttaacacatccaacacttaatgattcgtttgttttcccctaaacctgcttctcccacattttcccctatctcaataaatgtcacctccattcttccagtttctcaagttgaagagtctctctcacaagacatagtcagtccatttaggaaatcttgtctattctaccttcaacattatccagaatctggtaccttttcaccacttctacttccaccatcctaactaaagccctcagcatgtcttctggagtattgtaattgctttctaactggtctccctgcttctatcccttgtttccctatagtttcttttccccatagccaagagtgatttttttttttttgagacggagtctcgctgtgtctcccaggttggagtgcagtggcgcgatctcggctcactgcaagctccgcttcccgggttcacgccattctcctgcctcagcctcccaagtagctgggactacaggcgcccgccaacacgcccggctaattttttgtatttttagtagaaacggggtttcaccgtgttagccaagatggtcttgatctcctgacctcgtgatccgcccgtctcggcctcccaaagtgctaggattacaggcgtgagccaccgcgcccggccgagtgatctttttaaaaacatagcatcattcactcctctactcaaaattgtccagtagcttctcatctcacttaaagccaaaatctttaccatggccctgtgtgacctagctttccattgtctttttgatcacatc

SEQ ID NO: 7039 - DNA, 509 bp, mus musculus
acactgaataataatccgattttctaaatgtggcagtgataatcacaaacttaccatattattgactttattatattttcaaatggaataaattgaaagtaggaggagacaagctaagctttaaattatcaagtttttaaatccaggaaattatccttcctagataataatacaaaaataatatctaattatttaaagtattctttacatacctgagagtattattataacttaataatttgtcatttgaagttgttcataccatcatcaaatagttaaatattatcaagcactccacaacagacaacactgtacaaattgtgataatctccagcccttcactataatttcaatatgtaatatcactggataagtataagattaactccaccctataagtacctggttagttacagctttatgactgtgcatatttgcatggttaaatcactatgtcatatcacttatgtaattcatgaaatgaatatttttagacaacgagttatata

SEQ ID NO: 7040 - DNA, 851 bp, mus musculus
aaattctactgagaaagtataagccgactatagactttttcatagttgaattaaaaaattaaattgtgtgtcatatatcatcaaactcagttccttacttgctaccatagagaaagtgtgtctctgaggttctctgttttattgatacagtcatatcctcatttgtgctatattacataaagtacatgtggcctttatagttatatgaaagatatgttaccagccacattgatctctatgtaaattaattacatatttctagttaggttacacaacaaagcctacttgctgactagcctataaataaagattctttaaatgcatttggaacaattttgcctgcttgtatagagtgaatgactgctgtatgtggtaacctcagaagcttgaggaatagatttcctaccttttacagcaagcatttacttaggttttacattcacatttgtaatgccatccgttttgatttaaaatctgtcatcattgaaagaattgtagctggtgagtaaggaattagcttcgtaaatttgagaccggaagaggtcttaaagatggactaattgcaccccttcattttaattatgaggacactgaagccagagagaaaaactgacttggccaagtagatatagagagctgacgtaataccagacccacgtaatcatcctatagtatgtcactctgctactgtacattggacttgttacttttaaatgtgctcattattgtgcacattctgagcagaaatcctacttctcatgtgtttcaaaacaactcgtaagagcgatcagcattccaaaggcagttttggagaactgaaagtgtgttgttatttctagttttgtgttgtt

SEQ ID NO: 7041 - DNA, 1018 bp, mus musculus
tattaaagatcatcctacagagatgtaacagtgtcactttaatattcttatgcctacttcatagtaaggcaaataaaatcttcagaattgttgctggctgcctaaacatgggttactgtttattaatattttctttttcttgtttgttacctttctagaaacttgagattttcatgtgatgctctctttctctttttttgtatgcccttaagtattttgtgtaaagcaattaaaacagtaatttcagtaactagtttatgtcatgtaccaaattcaaaaatgacagctaagaatgaaatttagctctagcaaggaggctttaattaaaggatccttgcatctatttcagtgacttcctgttagtaattcaaccatctcctggttcactatttctgcagtgctctgaaaatgaagcttgtctacttattttttttttgtgtgtttcgtaagaattgaagaagcactcataagaaagggaaagggaaagagggaaagcaaatggacctaggatatcatgccaagtgtgtggggtgttattcaaataaataaatatatatatatatatatatatatatagagagagagagagagagagagagagagagaaggtttataaaacaaaaattgcagaaagtacatttttactatttgtttaaagaagaacccataaaagaagttttctgagataaagttgaaaaatgcacatagaggcaggtggtgccattagccctgctgttgggactgacagatcagtactgaagtggcatcagggtaggaaggtatcagcttcagtaatggagagatgtccaaaggaaagattgctctatcacagtgatgggatcctagcatgttataaatcgaagattgttctttcctgccactgagatgagcagctctttctcctttcgagaatgaaatgttggacacagacaaggaaaagatgaaaacaaaaaagtaggaaaaagttttttctctttaatgtaaatctcccgggagaacagacagtgtagtgccaatc

SEQ ID NO: 7042 - DNA, 909 bp, mus musculus
gctatatatgcattcattctttcatttaacatttatttattgaacatctgctctgtaccaagcaatataagaatacattataacactaaaatagcattcattttgtgagttagagttttcccagattccacctagcctttctctagatgttccaaaatgaagttagactgcttgttgcctttatatatttgaactactgatattcccatcttatgtatttctgtctttgtttccatcatacaatcaatagcttaattccccaatagctcattctgatataagtatcccattttctagtattttctgtaaaacatttagggatacacagggagaaaaggagagggaatattatatacatccttctctgtatctctgcagaagtgctaatatctctggatcacactgatgggatggatttgttgtttgtgcctttgagtttcccaaaagatgatggcttccctttcctcagcttatgaagcatttctaatagacagatgtgaaatttggcctgagaaagatttaaacggacagcttacaaggaagaaataaagtgcttcagatgaaaattctgtggtgttcattccttaaaaggttcttaagctggtttgtttattctagctatatcatggcaaaattgttttttaagaatgtcagatgccattcatgtcttcaggtaactaagcccatgaagattcaattcagcaatagtacctacagcactcaactcgggattagcaaaaccaaaagtagaattacatctagtgttgacagtgtgaattcaatctcataatataaggccaattaacttcattgcatcattggtatcagtatccctcttttcatgatgcatttcaaattttcactcacttagattggatgctaagaagtggtcataaagagatgtcctag

SEQ ID NO: 7043 - DNA, 909 bp, mus musculus; identical to SEQ ID NO: 7042

SEQ ID NO: 7044 - DNA, 346 bp, mus musculus
aaatcaactttgtcatgctgtattatttcttaatatggagtgattaggtttcctaaaggttaatacattttgcataactatttatgagtgatatttttctgtaattttcttgtaatatctttgtgtagtttcggtatcactcacctcttagaatgctggcctcctagaatgagttggaatatattatatcatctttaactctattgagtaattcacatatatttgcatgacttctttgttaagtgtttgatagaattcatgagtaaagccatctgtgcttgtgattttctttgtgggaacttttgcaactaaaaattcaatttatttaatatacaaaagtttattc

SEQ ID NO: 7045 - DNA, 547 bp, mus musculus
aatccttgtttcctaagaaacagttaacagaaattattttttcaaattcccctgtaagtactaagaagtttatatacccaaagttatttaaatgatatttttttcaaaatttattagaagcttattttttcttcacgtgcaccatgggaattttaaaatttggtatagagatgtctgtgtgcttacttatggctaacaatgtttagtagtaaaattatgggtagtgttttggatattctggactggcaaataatgtcctagatatcactttctttttcctagatgacacactatctggattgtatctcttcttgattcctcacagaagtcagctaatttggaaacctaagacaggatttttcagaagagaagagggagaagaataaaaatggagaagaaaagaagaggaactatacataaatagatgatggttgtaacctgaagactcataggtaggtagatagatagatagatagatagatagatagatagatagatagatagatataacctaagcattacctcccattccatagttaaaaatgga

SEQ ID NO: 7046 - DNA, 396 bp, mus musculus
tccaaattatattgacatttcatggttattgtgatagatctctgtcatgatgtaaaataagcttcattttgaaaaagtatatatcataatcttaaatattttcttatacaaaacaaacaggcaagagtaaaatctgacattaaaaccaatttatagtaaacagaatgtctaatatggtttgtagcaagtgttttaagaatgaggtttagaggagatttttttctaacttgctgtgtaaagaattaacttaggaatcacttcctcaggatcaatgtcaatgggttagtttaataaagttaattcttacacaatcttttaaaaagacaatcttctaaatttatatgtagttgggggaacatggcatcaatgatgtatacaatctaaaatattctattt

SEQ ID NO: 7047 - DNA, 370 bp, mus musculus
atatccagaaaaagacccagttatcaaaagccatgcatgagctacgtgaacatttcctatgctctggtcactttttctgtcacgaatcttaggttttctattttgctgtgatcaacctctttatccattttttttcatgttcagggtctcatattgacagccaatgctgtaacattttaaattaaatcttgcaaatgaaggtgaaagaaaatgataagatactgaccctactatagtcttcctcaagaaacgaaaacaaatctgacacataaaagagcaaaataaaaggtttttatagaataaattgatatatttattttaaattttgtcgtattattctggactatttgttttgacactctcaatacta

SEQ ID NO: 7048 - DNA, 361 bp, mus musculus
acaatagcttcatttatgggtgttgaaaattcagaataaaattcttctcattctggctggcatgcaagttttgaggggagagggagtgttggtgaggccacagcctgacatccagcttcccactttctcatagttaattaaaatataagaccttatatactatactcattaaataagctaccagtttgatgtcatgctcatatgaaaaatcagacttaaaaaagaatagagggaaaccataccagctacctagaattttcttctaaatataaacagacaatcacagatcactaggaataaaaaacaaaccttctgcatgaaaataaaagttgaaataattaaaaagtatactcaggcgaaa

SEQ ID NO: 7049 - DNA, 596 bp, mus musculus
ttcaatccagattgtgcattatgtatgatttaaaatactctcacaatttttgtgtattttattaatgagttaatatttgtgaattgaaggtcaaatttacagcaataactacaaaccaaatgtattgcatttaataaaatcacttgtctttcctcagattctgtagtttcagaagaagccattattgagcataatattttccacggaagaagtcctcctaaaagataacatcgttttaatgaaatagaactttagcagcaccaaaccaggttagcataatgcacccccataaacacacacacacatcctcaacatacacatgtccaacctactgacataaagcaacaatcacagctgaagccaattatgttttctttctacagaaatttgggtggcatattttaaagtcattcaaatctaatagctgcaatttaactttcatacaatacatactggcacaaattaaaatgaactaatgttgagattcagagaacaagcactgttttctatagaacatcattctttccttcttcaaagagttaaataacatcctagggttttggccatcatatatgaatgcaaggcccacctattta

SEQ ID NO: 7050 - DNA, 2010 bp, mus musculus
atgagagtaaaaagatttttagttacatttaaaataacacataaatgcaaaaagtaaatgaatgattactaaaataaatgtataatttccacagggaaatacattaaaaaaaaagtagagttgtcaaggtaaaacttgagtaagaatttttaaaccaaaggggtacctgaacaacattcagaaatattgaaacaaaagtttcaatctccatctgaattttgattactagtggaacaaccaactaatccccaaaaagagaagaagaattgctgaggatttggaagtggattggatctctctcatctagctatgtgtgttacatctcctattccacaatgttttcatacaaaggagttggagaaatattttattactttgcacccagagtcaacctttcttatatgagtaagaaccagcttcatccaaatagtgaacatgatttccaatgtgatgttcactactctttagtaaaatgtacccacatacataagcacctcccttgaattcctgttgaatcactaaatcctgagatcaagaagtaaaaatttcttttttttctcttagtttaggaagtttttctgggcaactacccggccctacagatgactactgattaaccaatgctacttataaaataaaaaattaagaggcattataattattcatctgtatgttcaaagagaggaaatgaagtctgtttaattctactccagctgaacaagaagctttattatggcatttcctccctccttctacttttccctaccttcctccctccattccttccttctttcttttcctccctccccccttattttcatacctatttgagtgcctccttcatatcaggcactgtgacaggagaagaaaaaacaaacaatgtagggccaaaataggtaaagttcgtttcatgtggctgaccatcttcttaggagaaatgacattaataaaattaccaattaattattaatcattactaataaatatataattagaactgtaaaaattgcaatgaagtggaggaaaatggtactatggcaacataaaatagagattttacctagtcaaaagccaaaggaaagttttcacaatggactctcacttaagagctaaaggagtagtatgagataactgagtaaacagggaaaaactattgcagtggaatgcaaaatcagtgaaagagagagcctgactagaagaccaaggtaaaataaactgctaaatatgatacctaacttattggagaatatctggtagaatatatacagagggagaaatatattaaagtcaaaactgaatagaaaacagatgtgaaacacaatgatttaaaaatcaatttaaaaaatcaatcttagcaattatttgtgcaataatttaacatttggatttcattgcttttgaatcattttggtgattatgcatgattattcaataagtactgtctagacagtgtgaaccatttgcttaatattaaaagttaaatagatattcctcacttatcaactaaatgtttcatttccatacacacacattcacacacacacacaaacacacacacacacagatgtaaatatgtcaatataggagataaacagtagattttaatatttccccatggtactatttgttaattaattatctatccaacattctttgctcttatactatttctactgaaactttggataagtaaacaaaacgtgtattgttagcttaaacttttcatggttggcatgaaaaaatgcagttgtttataggttttgaataaaaagttaattaattggagttaaaatatttgatagacttcaaatgtacaattccctgtacaattcaaaaacttaaataaaaatttataatttgatttttaatctcactctccaactgtcctattgagagtttggaaaagcatgtgctacaaaagctagaaaagcctctgaggacactaccaatactccctctacaggccgatatgaaaaaggactggagagtgggatagtcatcagtatgcac

SEQ ID NO: 7051 - DNA, 804 bp, mus musculus
ttagcatagtccctaataaaaataattgaattaaatttaagtatctagtcaatagaattaatagcaattgctataaacctaaataattatggtgataataaaaatcaagttaaatacaagatgtggtatagagttcagttagcttaataatctaatgttttactagtccacattcaattttagagtaatgatgttgaaaatgcaaattacttattattaggttccttaactttactatttacttactttttagtttttttaaagttttattttaggtttaggagtacatgtgcaggtttgttatataggtaaactcctgtcttgggggtttattgtacagattaattcatcacccaggtactaagacaggtaagtacccaatagttatttttttctgctcttctctctcctctcaccctccaccctaaagtaggcccaatatctgttgttcccttctttgtgtccatgagttatctttatattaattatttttatttcactacttggcagtttgccaaatcagaaacttgattttgataagagaaaaatgtctatttcagaagttaaaaatccgtatttaccaaatgtttaccagtctactatcattgatagggttcactatatttcaatatatatatcccagtgttgtcaaatttttgaggtattgtgattttattagtgtttgataatgaaaacataacttcaaagtctattacctgagcattgctttaatatccaggattctttgtacatgccattatgttcctgaaagtacatttagcataatatgtatagctaatttat

SEQ ID NO: 7052 - DNA, 804 bp, mus musculus; identical to SEQ ID NO: 7051

SEQ ID NO: 7053 - DNA, 804 bp, mus musculus; identical to SEQ ID NO: 7051

SEQ ID NO: 7054 - DNA, 804 bp, mus musculus; identical to SEQ ID NO: 7051

SEQ ID NO: 7055 - DNA, 323 bp, mus musculus
tgagaatgctctctagtcttctggttatgttatactgcctgacctaattttcaagactgtagtattacctataatctttatgagatttattgttttacctgtcttcagcttctattttagagatggaatggatccttaaagatcatgtagtatcctagtctgcctctattatttgacaaatgatggaaccaaggcccagagaaagaactgacctttaatgagcagctattttatgtcaggtaatgtgctaggtaccatacctatgttagttctttatctcagagaggttataacattagtaagtggcagagagacagtctata

SEQ ID NO: 7056 - DNA, 323 bp, mus musculus; identical to SEQ ID NO: 7055

SEQ ID NO: 7057 - DNA, 1534 bp, mus musculus
aactgaaacgataattttcttcatcattatcatgactttctcctttatacaataaaaagttttaatattgaagatgcagtatcttatatttgtactccatctactgatcttggattctaaatggattggagcttttgccttgagtaaatgtattcctacaaaaaccatagaattttagagagaaaaatgatattagaaagacattatatacccaaccctctcttttgattgatgagaaaactgatgccaacttagttatgaattacctggatttacatgaacaagaagtgaaactggagcttaggtctcttgattcattttctggagcttttcctactccacaaactccttttattatgaattctgtactccaaatattactataaatgaagaattcaatgtaggatttttttttcatcactaaggcaagtgttagttaacaaatacagtcaaggagaaaatgaaatatttgaaattagctgaagttatactaaaggcacaaagaaaaattctcagacattagtaggtactcagtaaaagagagaaattcagcatcataaagctgtaaacgccttgataaatgtgaggtcaatcaataaaataatggcagtgaactcgtgtggctcatagcatagcacagaagataaatctgaaagagaaacagcaaaatgttgtgaacaatagcagcatcgttgaaataaatagtccccatttatactagtctgtagttagagttctaatgaattaataatttttattgatttcagtttctaaaagaaattgctattcttgtcatctttatctgccttggaatctgataaaatctaagttgactacttctcattaaaagaaattattaggccgggcgcggtggttcacgcctgtaatcccagcactttgggatgccgaggcgggcggatcatgaggtcaggagatcgagaccatcccggctaaaacggtgaaaccccgtctctactaaaaatacaaaaaattagccgggcgtagtggcgggcgcctgtagtcccagctactgaggcaggagaatggcgtgaacccgggaggcagagcttgcagtgagccgagatcccgccactgcactccagcctgggcgacagggcgagactccgtctcaaaaaaaaaaaaaaaaaaaaaaaaaaaaaaagaaattgttgaagcagaatctccgttattaaaagtaacgcaaaaccaaaacaaaactctttaatacatctgaaggttacaaataaaacatacatttatcagttttattacaaagatatattattaaagcatgaatggttttaacatgaattgtttcttcatttattcacggtagtttatactgccattgtaaattttagagtttccctgcattttttttgcaaatatcataggagctattatagatatttcatgttctatatctgacttacagttacccaattttgatcatgaccaagcaataggatcctaagggtccatttgaaaggatttggaggaaatatagcttcatgttgcaatatagttttgcaca

SEQ ID NO: 7058 - DNA, 1534 bp, mus musculus; identical to SEQ ID NO: 7057

SEQ ID NO: 7059 - DNA, 145 bp, mus musculus
aagacacactccctgttggcttaaactgtaaactatagcaaggatttgcatacagtttaatgggaattctataatttgaccgttatttcagatatccacaattaatcataccctgtgacttttccttttctctcttttaaggtga

SEQ ID NO: 7060 - DNA, 145 bp, mus musculus; identical to SEQ ID NO: 7059

SEQ ID NO: 7061 - DNA, 1121 bp, mus musculus
catccacccactccaagtcatttatacttccctaagaattactgacaaattaaaaataccaactctataaataatggaagtctttaatgcatttgtatataggttgttaccttttttgtcacaatgatatttaagtggctaataaaaatatgcctttgaaatataaattttattatttttttcctcaccccaacagctgcagaaataactgttcaaccaactgtggaagaggcctctgacaactgcactcaagaatgtctcatctatggccattctgatgcctgctggatgccggcatctctggatcattccagctcttcgcaagcacaggcctctgctctatgccacagcccaccactgtcacaggcctctactcagcaccacagcccacgagtgacacagaccattgctctctgccacagccctccagtgacacagaccatcgcattgtgccacagcccaccaccgatacaggtgtctgctctccaccacagtcctcctctagtgcaggctactgcacttcaccacagcccaccatcagcacaggcctcagccctctgctacagccctcctttagcacaggctgctgcaatcagccacagctctcctctgccacaggttattgccctccatcgtagtcaggcccaatcatcagtcagtttgcagcaaggttgggtgcaaggtgctgatgggctatgctctgttgatcagggagtgcaaggtagtgcaacatctcagttttacaccatgtctgaaagacttcatcccagtgatgattcaattaaagtcattcctttgacaaccttcactccacgccaacaggccagaccgtccagaggtgattcccccattatggaagaacatcccttgtaaagctaaaatagttacttcaaattttcagaaaagatgtatatagtcaaaatttaagatacaattccaatgagtattctgattatcagatttgtaaataactatgtaaatagaaacagataccagaataaatctacagctagacccttagtcaatagttaaccaaaaaattgcaatttgtttaattcagaatgtgtatttaaaaagaaaaggaatttaacaatttgcatccccttgtacagtaaggctta

SEQ ID NO: 7062 - DNA, 1121 bp, mus musculus; identical to SEQ ID NO: 7061

SEQ ID NO: 7063 - DNA, 206 bp, mus musculus
tttgttaccttaagagcctcacaacggtgttatgttcaagctcgttgtgcctgggcaggaacacatatctctgcctaatttcactcaatattccttgttctgtgttccagatcttatcagatctactttccaatgcttatcaattcttccacttctttctgtccaaagcacaattatcttagtttggtcttccatcgttcaatggt

SEQ ID NO: 7064 - DNA, 720 bp, mus musculus
atatatgtatttttctctacataatgaaagctctatgcaatactgtaaagagaaaattgtcattaagaaaagataatgttcaaggttacacagtttaatcaataactgttgaagatatacaatgggctaggccttctagaaagtacaaagcaattagaaggtattgtcttttcttttaaaaaactgataatttgattcatggagcaggtctaaaacaaaataaaataagtaatacaagataataagtgatcaaggacttaaatcatgtaataaaggctaggtgttacagaagtttcgaaaaggagcactgaattactcaaaggaaactccacagaggaagagggtgttgctatggtctgaattctggtgtctccctcaaatccatatgttggaacctaatacccaatatgaaagaatgaatagatggagactttgataaacgattgagccataagggctccatcctcatgaacgggattagtgcctttataaaagaggctcaagcatgccctctttcacttctgtcacatggaggcacagctagaaggcactctccatgaaagagagaccaagtcccaaccagacatcaaatttgttaatgccttgatatttgactttccagcttgaagaactatgagcaataaatttctgttgtttataaattaccaagtttatggtattttattatagcagaatggactaaggcagtttgttagctag

SEQ ID NO: 7065 - DNA, 432 bp, mus musculus
aaaatgtacacttaaattaggcagattttattgtttatataatatatctcaatacactattaaaaataatgcgcaagaaattatcttaggacaaattcatatagtgtgaaaaacttctatgaaaatagaaaagtagatatatttagatgtcatatctacaacagaaatgctcatttttttttttggtttgtcaaccactcttgtgggaaaaaaggccctcatgccctactccattcaatcctaatttactatggtaaggaaagctacaccaagatccctccctgaagactggggaactttcagctataggaaacagctgcttgattctttcacaggagacttaacttaaaacttttagcagtaaagtgtctcagaagttctttttttttttctcttttctactcctgaacttgccctagattcaaatacctc

SEQ ID NO: 7066 - DNA, 194 bp, mus musculus
gctttgttgcaatcagttttgttactgagtgttaataaataagaaatacattcccaacgttgattttacaggatgagcttcagtacataaaaagtgttcaggaaagattgaaaggttccttgctagtactagcagtggatacattaggcagattaaaatccagatgccattaaacagcagagatagtttgattt

SEQ ID NO: 7067 - DNA, 334 bp, mus musculus
cattaaatatcaagaacacacacacaaacacaagtggcttaaatttatataaggtttgagtcatagggctcaatttacggaggaaattgtagaaatatcctacatagtttctgaaaaatattgcattgaaaagatagttcaggacatatttttcattgtggttcttaaatctaaaactgtaaaaccattaaaatagtttagattactttaaaataagaagacaaaaacataagaaagttagcaaatgtggcaaaatttgtcaaagtatatataaataaatatacatttcaggaaatggaatgcatttaaaagaacttagtaagttaaattattt

SEQ ID NO: 7068 - DNA, 1586 bp, mus musculus
taattatttttttcttatttaacaaacatggcaataaatgacttataatacaactgatgatgaagtgcatctatatttcattataattttttttaatatactttaagttctagggtacatgtgcacaacatgcaggtttgttacatatgtatacatgcgccatgttggtgtgctgcacccattaactagtcatttacattaggtatatctcctaatgctatccctccccctcccccaaccccacaacaggcccccgtgtgtgatgttccccaccctgtgtccaagtgttctcattgttcaattcccacctatgagtgagaacatgcggtgtttggttttttgtccttgtgatagtttgctgagaatgatggtttccagcttcatccatgtccctgcaaaggacatgaactcatcatttttatggctgcatagtattccatggtgtatatgtgccacattttcttaatccagtctatcattgatggacatttggcttggttccaagtctttgctattgtgaatagtgccgcaataaacatatgtgtgcatgtgtctttatagcagcatgatttataatcctttgggtatatacccagtaatgggatcgctgggtcaaatggtatttctagttctagatccctgaggaatcgccacactgtcttccacaatggttgtactagtttacagtcccaccaacagtgtaaaagtgttcctatttctccacatcctctccagcacctgttgtttcctgactttttaatgatcgccattctaactggtgtgaaatggtatctcattgtggttttgatttgcatttctctgatggccagtgatgatgagcattttttcatgtgtcttttggctgcataaatgtcttcttttgagaagtgtctgttcatatccttcacccactttttgatgggtttgtctttttcttgtaaatttgtttgagttctttgtcgattctgcatatcagccctttgtcagatgagtagattgcaaaatttttcttccattctgtaggttgcctgttcactctgatggtagtttcttttgctgtgcagaagctctttagtttaattagatcccatttgtcaattttggcttttgttgccattgctcttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttgagctttctccatatggctagccagttttcccagcaccatttattaaatagggactcctttccccatttcttgtttttgtcaggtttgtcaaagatcagatggttgtagatgtgtggtactatttctgagggttctgttttgttcatttcattataatttttataattgttagttttctatagtcaataaccactgaacatacatcataaatgacattgttgtctcccaactatttaaaacatccaatgttgccaatgctgtagaatcatttctattaaattgagaaatacttttggttaacaaatc

SEQ ID NO: 7069 - DNA, 435 bp, mus musculus
acatttttaagccattcatcctttaatgaacacttaggttgattctctgtcggctattgtgaataatgttgttatgaatatgggaatgcagatatctctttgacattcttattttatttccttttaatcatttcttattgatgtgtagtcaggttgtttccaatctatcactattacaaacaatattagaaaaacactcatttacatatatatataatagtgaatgtttgcaagcttttctgtagaacagattcctaaaagtactgtgtgaggtcaaatggtaagcataaattattttgaaagaacctcacctaatatctagtgcacccagacaaatattaaccttgtgattacagaatctataaggcacagttcttacccttgtttgtccatcttgggaatcagaatcttgtttgcagtagtcaggaggtcaac

SEQ ID NO: 7070 - DNA, 1279 bp, mus musculus
gccttctgagaaaaaattatgctaaaaactcctgtcttgaataaatttaatgatttcaactgatgaattcacagcttgagaaaggagattacatcattatgtggagaatataaatcaataacatcattctattttttatttcaaatgaggaccatgcaaattaattataaaaaatagaagatcttcagttagctctgaaaacggtgctgtagcaatcacaaatttcctaaaaaacctgtctttattaaattttcagattaagtttcaaatgccaaccttaaagatgccatccaaatccctgcttgaataatgctagtaatgttgcataaacactcctaagctttataaagtaggctatattcactaatacttatttaaacagataattccttttctttttttctatgtattatctaaagagctagtatgctccacttctaagatattcttgtatatcctaaatctaatgatttcaaggagagtgactagcattgccacagatgtttgtagaattttaaatgttgctaattaatgaagagaataagaccagtgctgtgaacaaaaacacaaagcaaaacaaaacgcccactgtgattgcttcaccattcattagcccaggacatcaacatctttttcacaagttgtattccagcacagtggagatactgattaaagggtcatccatatgttagcaatatggataacctgctgagcaacaagagtgaattctacaggtcaaatgacaaatttattttgtgattgtgaataacttcacatttcgacgttttctacacagttgcattagtgaagtcatgtacaatttttcttagaaagaagcacagtcaagagtttttattattttaagaataaatgtgaaaaacaaatcgatttgtacattgaagtcattctaatctttaagactccagtaataaatttctaattaaaaacctcaagttagcccctgactgggcagctctccatcccaattggtttatatatacattatctgcatcatcacctaaacaaaatctaaagcagaatacattttcatgttctaaaaagtttacagactattttggaaacaaacatcatgaaattaaatgagataaatcaatatatccacaggagcaaagaagccactgaaaacttaatttgagtactaagggaatgtagagtaattactgagtttatcctctcaaggccctctttcccataggaccccaaaatctccatttctagtcctggcttatcatcctctttctgttcctttatgtcccat

SEQ ID NO: 7071 - DNA, 799 bp, mus musculus
ttcatttttgcagaaatgatattatgaaactataaatcactcgctgtattaaaaggatgtaggttttgagaacgcacaaatgtcatataatgtgcctagtttcttcatatataaaattaagtcttcattaagcacacattttagaacacaagacttttcacaggaagcctaaaagccattaaaatgcataccattatcttgaagaaggtgataagtgttcaaaaatatatatatactaaaataaagtcactttgcttctcttttagaggtgatatttaattttaaatttcacatgacattaaaagagcatgagatttgatgtttactaaatggaaattgcatttaaaaaatgttgaatcattgctgtagaaagttttctaggataagatagtagaaattactgcaaaatactttgaaaattgttaacactgagtgggcttgtagagttaatgcccttccacatggtgatttgattataagccaaaggcatcccttctccagtgtggtgaggtggaaagagttctgaacttagaattagtagatctgacatctagtctttgatctgcaactaacaagcccttagaccacaggcaagtgactttttctccctggcctttgtttcttcagttttgaaaaggagcattttcataagatttctaaggtcccttccagctataatattctatgaccgtatcttcctcactgagtctactaaaatttctatattatttacttccttgggttaaaaaactgagtgctctttttaaaggcaaatattgtctgagaaatgtcccacatt

SEQ ID NO: 7072 - DNA, 1274 bp, mus musculus
atattctcataagatctggattgacagtagaaatgcatatgtagtaataattatatgccccaatagcccaccgaaatttaaacagccaaatttaatttgctgacatttgaaatggctcttctagtaagacttgttactagtcaactttatacctctcagacttctcctgctattggtatctacatcttcatatttgggttattttagagaaaaaaaatgccaagttaaatataatccttaaacatcatgaatacctgataaaaaaagaaagcaaggctggatgtcattgtttctaaggtgaatcaaggtagggcctataatcttgtgttgctggaaaaatacatttaaaattatgtcatggcagagtaactagtctctaatacacattatgtatggacctgctgaaatccccacttttgaatatacttagagataaaaactctcccacatttggtcggctttggtctacagccatcctcaaacctggcttgtcatatgaatcccttgaaaggcactgggaaaaaagtcctgtactccaacactcctggaaaatttgattcagtaggtctagtttgggaccaggcatctgttttttaaaactcatcagggcgactctactggtgaggcagctatgagaaccacggagataactaaatgggaaccttttaatctgcagattcttaattctgtaaccagtgttacagggagagctcatgaaaccctatggttttatgattattgtaaagagtatatgtacatgaaccagtcagtttttacttcataatatcccaaagatcatcaagatagtatataagatagtatctgtaaagatatttttaagatagtataagatagtatatataaaggtatttttatagttttctttaaagcacatttttattgaatttaagttatatgaaagaagatcaaacacttgttttcaaagaagcacaggagacacccccactgtatagaccagcagtgttcctgctagttaatacactatgacacattagtatagtaggggatgtaacattgttttcaatggtggacttcgagatgaaattgaaattagaaaatagtaaaactcctaatttatggaataaattacattttctctaaattactttttttattttcctcaaatccattagatttctcacttgctaatcccacaatctgtattcttaccaataatgtggcaaatcttaccaatcgtctgttgcgaaactagccctgaagggctggtagaattttataatttatattaatga

SEQ ID NO: 7073 - DNA, 977 bp, mus musculus
atgttaaaggattggtaagactttgttaattttagctttgagataaaagactggcattgatttggcaggcattaatttgttgcttcatagagattccaaagttgatgtactgatgtcaggagctctttttaagatttgcaaagtattattaaagcacttgatctattctcatcacagaaagggcttcatgtaacttactcgttcctctgggcaatagacatagctcaaattataaatgaaaacttatagttttgagtctgacttattttctgtcatgaccagtattttccagttatcatgcaaaaatgtctacaggatcaatgatccccttgaaaaaaaatgttacctcatcagatgtcatggatagtgatagaatgagattctgtgaattccagcccctaaatgtgtgatagcagtttcaaaacaaacttcctatggaatgctctgccataatgggttagaaaacatgagcctatatcttctaacaagaaagtatattcattctttgacatctgaactatatcataacatactcaaagcatgcacattacccaatcaactttgtattttattttttaagtatctaccacatgcccagcatactttcttttgacttttaggtaacaaattacctcctttagacaggatgttcttcttactcttttgtacactctcaaagcaaactgcggtataacaaatattaacaaatgatgggcatatgcatcactgaagatgaccagagaaatgttaacatcctgacaatgtcacatttacttggccataaaataataactaaagttaggcagtgtgatagactcatagagtcatgacactgaaaagaataaatgctcatcaagtctttttcacagaccataagctgaaacaaatgtaaaattcctaatgtatcgatgctgactccttcctttcccccttaacaacccttctcctcctgcctcctaattatgaacagcaagaga

SEQ ID NO: 7074 - DNA, 2288 bp, mus musculus
ttttattatgaaaattatcaaaataaggctgggagcggtagctcacacctgtaatcccagcactttgggaggcggatggatcacgaggtcaagagactgagaccatcctggccaacatggtgaaaccgtgtctctactaaaaatacaaaaattagctgggcatggtggcgcgcgcctgtagccccagctactcagggggctgaggcaagagaatcgtttgaactcaggaggcggaggttgcagtgagctgagatcgctctattgcactccagcctggtgacagaacaagactctgtctcaaaaaaaaactattaaaatatatagaaaactagaaagaactataaaccacaagtacttttatccactgtccagaactaataaatatcaacactatcatactttacaatttgtctcttttctttaaaataaataaaatattacaggtagagttcaagttcctttgtagtcttcctcaaaccaattcccctccatccctacccagagccatcaatgatcatgaaattggtgtgtatactccccatcatgttcttatacattacaagtattcattcagtattgtttaggctgccttaaaaataagttaaatgcccatcaacggatgattggataaagaaaatgtggtatagatatacatgtataccactgaatactattaagccaaaaaaagaatgaaatgtctcttttgcagcaacatgaatggagctggaggccattatcttaagtgaaataattcagaaagtcaaatgctgcacattctcattataaacagaaactaaataatgtgtacatatagacataaagtgtggaataatagacactggatacatggaagagtagtggggtgggagagaagtgagggatgagaaaatgcctaatggataccatgtacactattcgggtgatgattacactaaaagcccagacttcgccactacacaattcatccatgtgccaaaactgcacttgctcctcctaaatgtatacaaaaagttaaatagcataggcatcatcctttgacttacattttggctcaacattatgtttttgaaatctatgttaatatataaaggtaactcattaatttataccaatctatccatgttaattatataaagatctagtttatatcattttaattgctatataatactccatctcgtcaacatatcatcatttatcaattcactatgataaacatttaaatttcttcctattcttagtattgtaaagcttgattaggcaaccaaccatgtgtagatgtgcatgaatttctctatgttatatacctaaacatgaagtattgagtcacatgatatcagcactttcaaccttattatatattgtcaaatttctctcaattttctaatgctttatttagaaattttgtatttatgtccagaaaagagacttactataactttcttttgttatgctttctttgtctatttttcagaaactattcattaatagtttcataaagtaagctgggagcatacccttattttctagactgaaagagatttatgtaatagagattattcctcaaaagtgtaataaaaatcacatccacttgggcctgatactttagaatggagtaggaattagggcaatatttttaaatttcagttcaatttctttaatgataatcagtctacttagattttctacttcttccggtatcactctgatcatgtatatttgtctggaaaactgaccatttgtttaagcatgaaattatttcctatatggtaaaagcctgagacaaggacttctaggcagataatatatttgagtggtattatcccagggaatgggtgtgtgagattggagaggagtgaaagaaggaaggaaaaatagcctttccaaggttgcattattgagttgatcatgactgtggccaagtgggtctagattccactagggatctgatggaaagccatatagaatacactttagaatggtttaccattcacccaatagctcctttacctcatcagacaaggatgaccccatgggctattaaatccctcttacttccagatggcatatgcatatgagtgctatggcttcctgcacattggaaagaaaaatgaggtgaccacagctattaggtcacacccatgcaaagctgtttggcacaacaatgactacagtaaaatgtgggttgactgcatggaagatggagaaaggtgtccaatacatcatttcatggaggagtcaggaagagatctacattattttaagcttctatagggcacaaactatat

SEQ ID NO: 7075 - DNA, 448 bp, mus musculus
gagataaacagaagtatttatccagcaagtagtaagatactccccatcacctgcagtaacctaggcctgtcccaactcctcccagagaaatcataactccttaaagtctgcattaaagggagttgtccttgcccccaaagacactcatagagataagtaccaagaccctctctctgtcattccatattagatcattgttttcaggtagcatttttcagcatgcaatttacgctatcacctataggctatgtgctgtagataactgttaattagacaaagaccctaatcttccacttgtccaaagatggagtaagtatccaggccaacaggcttgttttctctgaaaagtactaattaagttgggccagaaagcttctcaacatacgagagaacccagtgacccctcaaacacaacttgacaaaatgttcagggcgtgattgtagctta

SEQ ID NO: 7076 - DNA, 225 bp, mus musculus
gggttcttcttgattatatcagaaactgtcaatacaaggttttaaataaacagtcaggattcatattcttttcttccgtaattttgttgagtgaaacatgtagagattataattggccagccatgcttccggtagcaacaaccatgttcatgcatgtgcagcaggggaaatcatggtatgactgttactcagccttcagtgattgtagaatgccatcaattctaa

SEQ ID NO: 7077 - DNA, 548 bp, mus musculus
tccaaaaagttacctaaagaggcagaatatttcacagacctgcaagccttcttgattataacctgattgcaaatattgtattaacagtgtctcaagcaacagagaggttggtttgatcagttattttctagatgagagctactcaaagtgtgatccttggactggtgcccatatcagaactgtttggtatgggcctatgatgagatatgtacttaaactaagaataatcagctgggcgcagtggctcacgcctataatcccagcactttgggaggccgaggcgggtggatcacctgaggtcaggagttcaagacaagcctggccaacatggtgaaaccacatctgtactaaaaatacaaaaattagctgggtgcggtggctcacgcctgtagttccaactactcaggaggctgaggcacaagaatagcttgaacccaggaggcagaggttgcagtgagccaagatcacgccactgcaccccagcctggacagcagaaaaccaaaaaactaaaaataatcaattagaacttttattgcaatttgacaaa

SEQ ID NO: 7078 - DNA, 275 bp, mus musculus
acctaccatatactttaaaggcttctatcaataaaaaggctttatcaggtgtcacttctgtagaatctgttgtaagacctttgattaatcaatgtaaagtgatttttttaaaatatttttgtctgaaacttcagataggcaactatattcatttggcagtgctgctataacaaactacaacaaactgagtcccgtaaacaacagaaatatattgtctcacagttttggaaactggaaatcagagatcaaggtatcagcagagttggcgcctcctg

SEQ ID NO: 7079 - DNA, 987 bp, mus musculus
agctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggact

SEQ ID NO: 7080 - DNA, 987 bp, mus musculus; identical to SEQ ID NO: 7079

SEQ ID NO: 7081 - DNA, 987 bp, mus musculus; identical to SEQ ID NO: 7079

SEQ ID NO: 7082 - DNA, 935 bp, mus musculus
aacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagataatttctcttcctttaatgtctgtgaattatcatccactgtgatgcatttaaaaatgcaactcaacaacagtagtctactgacaaacaggtgactgctgcctgtgatgtgttttcagttgttggcttttctaagtagttacttgtcagagagaaaggaaaaaggatgaaaatatccattttgacacctcttgaaatgtgtttgttgactgtctctcttttaaatcgccctgtacctatttggcatcactaatcacaatgctaagtgactttttactttactaggcattaaacttgtgctgcttaacctttgagcatcaaacaggcctttccccagcaccctgctgtatctttagtacaaaactcctgaatcattatccatcttgaggatctgccttgccttagaggtactctgacatttgctaagacttcccattggaccttgcagacatttccagatcatgacagtgtcatttgatattttggttttaaacatcatcagagtggcttgtgctgaagaaccagaactagaaagaaaat

SEQ ID NO: 7083 - DNA, 924 bp, mus musculus
aaaaataaaagtctaatattttagttcatgtattcataattccatatggtggccaacaggtccaacatactgtgacttccacctccctgactgtccttaacttggattactctctcgcttgcccattacgcttaagtcacactgtctttctgtttctggaacacaccaagctcatttcctctccagggcctttgctcattacacttgttcccttttcctggaatggtctcctcttcttcctcaaattaccccctatgccccattatcaatttaacacctacttatcctacagctcttagcccaaacgtcattttctctggaaggactttcctgactttccagatcaagttctcctcttacatttttatgaactggaagaaagccagtgtagcttcagcatatgatacaagagtggcagtggtgcaaatacctgacactgggtgatttataaagaaaagaggcttaactgactcacagttcagcatggctggggaggcatcaggaagcttacaatcatggtggaaggcacctcttcacggggtggcaggagagagaatgagaattgagtgaagggggaaaccttttataaaaccatcagatctcatgacaactcactcactatcatgagaactcactcagtatcatgagaacagtttgggggaaactgcctccttgattcaattatctccacctggtcctgcacttgacacgtggggattattacagttaaaggtgaaaatgggtggggacacagagacaaaccatatcagagagataggcaggagacagaccaagcagggccttgtagaactaggtgacactttagttagtaatagtgtaggaacagtggaaagccattcaagagagtgatcatatttgtgttttgaaaaggtcactgtgtctactctatggagaatctgctta

SEQ ID NO: 7084 - DNA, 230 bp, mus musculus
tatatacttagaaaaaagagaataacaatgtgttaacaaaatgttaacagggttgtctctggatggttgtattacatgtgatatttattttattttgtgctgtgtctgtgctttcctatattatactttctattgtttatgcttttttacattatgttttctctgttttacttacataataataaaaaagtgttattttatgaaataaaattataagaaattaaaatgta

SEQ ID NO: 7085 - DNA, 460 bp, mus musculus
aaatggtcttctatatttttatttttttcctttaagtccccttcaaaatgatcagatatgtctatttgacgagctgtatgtgtagataatagcaagagaggacttcttacatgcttttaaaacaatgatttttctataaagtaggtcttttataaataacaaagatgtgaaatttagttaataaatctaaagcaatgacccattaaatcaaggagtaaagaaatacaaagataattaagtagctttcattctaaattataaaaagcacattttaaacaaatcacaattaggttttcaaatgacaataagcagcaatttcacaacaggaagttagaggcctggcaggtagcagaaaaaatggagaaaaagtattgaggaaggggatccttctttattacaattttcacagctactggcctggtaattgctttaatttatttagcatttaattttggagaaa

SEQ ID NO: 7086 - DNA, 689 bp, mus musculus
aaatgtttccccaatttgtctttttatgttgcttttatatttttggcatatggaagttttaaaaatctatggtcaaatctattggtcttctcattgatttttttccattgcctttatactttaaaagtcctttcccattcaaagatttaaaaaaaaacaaaaactctatttatgtctttttgttatttcatatttttacacctcatttcccttttaaatagagtaattaggctggaagctcatagatgcactttagacacagtttacctggatttccagaagacatttgtgaaaatcttcaatatctgccatctcgctggctattttcctatgcttacaatgatgttcaatttgtccctattctgaatgcaaaaatatttttttaaaaaaaactttcttaaaatgctcttcttacttgaccttcatggcaaaattgtcctctctggattctcctgattcctcttttgaccattccttctgtttttgttttaccccttttttggcaccttaaaggctggtgttcccttaaattctgcctttagttagctacacagtctctctggtgatttcatccactatcataccttcaactatcatctacatgtggatgttcacagctcaaatttctcccatgagttctacatctttatatacaagtgtcctctggacatacccatctggttgtccta

SEQ ID NO: 7087 - DNA, 519 bp, mus musculus
tgaataacctgcatctgggcagtcagctagaggtgatgatgaaagggccttctgtttaaaatctgtatttgtaaggtccacttatggaactgctactaagatatacttctaggtattacttcccagcacatataaaagccatacttgcagtatatcgtagtggttagaggcccaagctttggcaataagtttgaattttaatcctggctccaccatttgttgactgtgaccttggtcaactcattttaccttgctaacctcagtttcctcatctataaatacagatagtaatagtatctacctcataaattcacctgcactttaaatgagatgttttatgcaaactaatcatccaatgtttggctgtttggcacacagtaagcaactaataaacagtagttatcagttatcatacagtctcccaattctgtcaaattattctaccttgtacattcagtaaaaggggcatagatggggcagagagcaagttgcagcccatcagcagcttcacagaaaatc

SEQ ID NO: 7088 - DNA, 1204 bp, mus musculus
cagaagtgacagaaaaatcattttagcagcatggaagttatgtaccttttttcgaatgagaagaaaacaatgacttgccagctgggaaaacatcctgttttggggtccaagagtttgcatattggtgcactggatttgggggaaagcctattaatttgtgtctgttgtctccgggctgaagccagaatggccatagaggaccaatgacctttcttccaaaagctgggagttgagagggttagggagagtgtcctgtgtcacaggagataccagctgggctgagcttggctgatctcttttagcaaagatcacaaaatgcagtgacatcagtagcaggccatatccacccagagacagcaacctaggcagcagtgatcaaattaagtcttgtacctactgatgggttagtaagaaaactaatagtcatagaggacagtgaggccagtttgaggcctgtgcagctctgcgtgttctctgcccggggaaatggtggaacttgagaaagcctcgctgtctggctgtgcagtttcatttgggagaacaggcaatcagttctggaagcctgactgaagagagtggacagaatgatagctcaaaatgagatccatcaatgactttgttgcagccccagccaaacaatcaaaagcaaatagtcagcttctaaaatcaatgcttcatgagatgatgagccagtggagttcacgtgggggtggggtgggaaggaggttatggagggaggatagaaaaattccctctttcaagccacccaccaaagcaagcagctgcatttccttgaaacagcagatttggttcctagcaaaatcagaactgcagtctcctagcagagcaaaacaaaggagcagggggcgagacaattttgaaaacaggaaggcgttttggcaacaatcacagaagggctggtaagccattgtgctcttgggatccatctgctgagctccagaacatcctccccccactccacccccattcagagctcagattgcatgcttagggtcaagaacagggtcattcaggaagaaacggtaaagtggaaaagacagactcagcctcaagatgtgaagcaagaaaagccaggcctgatttcttccatccatggaggatgcagtgaaagacacaggcaagcccttctcattcttggtgccgttgcaggggagcaaaagttggcttgattaaattaatggaa

SEQ ID NO: 7089 - DNA, 1876 bp, mus musculus
acttctcttcagctgatgggcgccatgcagttgttgaagtagaagatgtcccactagctgctaagctggttgacttgccttgtgttattgaaagcctgagaacgcttgataaaaaaaccttttataaaacagcagacatttctcaggtatggactagttttctttactagcctcacatccttcaaggaattcttttctcttcctatttttctttctttcagtactcctttccacttggtgaatggctgcttggcatttctaatttccagattgactgcacaggaatgaaatgtcatgttctcgtttggtgtttgatccttagctttcagtattgtattttgaccaaatagcctatagagagtcccatttgccacttatagtgacttttcattaattgaaacatatgagctgctgggatcttctgaactttgtattaaaacagtatgttgttaactctggaggtttaaattggttcttattcatcatctctgctgttgatttcttatttcctctctaaatcaaaatgctgagataggccagacacaatggctcatgcctataatccctacactttgggaggctgaggtgggaggatcacctgagcccaggagtttgagaccaacctgggcaacatagtgagacctcatctctacaaaaacaagattagccaggtgtggtggcacacacctgtagtcccagctattctagagattgaggtgggaggatcacttgagcccaggaggtcgagggtgcagtgagccatgatcacgtaccactgcactccagcctgtatgacagagcaagactttgtctaaaaacaaaacaaaaaacctaagctaagttccaagatctgtttccaatatattccctctgtagtggtaaacactctcgtggaaaaaaaaaaacaaaacaaagcaccttcagagttcatatgtagtgctgctggtggctggtggtggggaggagagggagagagagagactgcaaaaatgagagaatataaatgtacattacaaaatacttggttttctggaaatggcaagtatcagtctcttctgtgcatttctagtggtaagaatgattatgattgctaacccaaaattcgtggtcatagtcaacttctttgtctttgttaaatgtagatgcttgtgtgcactgctgatggtgatatccacctttctccagaagaaccagctgcctctactgatcctaatatagtcaggaaaaaagaaagggggagagaagaaaaatgtgtctggaagcatggcagtaagtcaccagccccttgctcattcctgctgactaaaatttatttgctgaatcctaattccttgtgaaacagggacgtcttaccacacttaggtgtttggttcattaggttctcagatactctttaagaggagtcacgtcagctgggcgcggtggctcacgcttgtaatcccagcactttgggaggccgaggcgggtggatcacctgaggtcaggagttcgagaccagcttggccaacatggtgaaactctgtctttactaaaaatacaaaaattagttgggtgtggtggcgggcacctgtaatcccagctactcgggaggctgaggcaggagaatcgcttgaacctaggaggaggtggttgcagtaagctgagctcgcaccactgcactccagcctgggcaacagagtgggactcgatctcaaaaaaaaaaaaaaaaaaggagtgatgtcatgaccctttggtttatagcatgatctttgtctttatcaaattcagctatgtgactaccatcagtcatataacgtttcactgtgttgtatttattttagttacgccaccacttaagaatgtcagaaagaaaaggttccggaaaacacaaaaaaag

SEQ ID NO: 7090 - DNA, 1876 bp, mus musculus; identical to SEQ ID NO: 7089

SEQ ID NO: 7091 - DNA, 894 bp, mus musculus
cactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaa

SEQ ID NO: 7092 - DNA, 295 bp, mus musculus
agttttgtttatggttaattttgatatggcgggctttaaattgtaaatattggattgtatagatatttttctttctattgtatttcattccttttatgcttaaaaatgctttcctcatctgaagagtaaatacatattcacctgtgtgttgaagatgactgggctttcatctcttataatctttttaatgaatcatgtggtatgagcatgtatccctctttgtatgcatccttctaactatgtttcaattggttattgttaagcagtgtggtttataggttgccagccctttagc

SEQ ID NO: 7093 - DNA, 295 bp, mus musculus; identical to SEQ ID NO: 7092

SEQ ID NO: 7094 - DNA, 1090 bp, mus musculus
ttaaagagtacctgaagtgaagactaagctgtgactgtgttggagcacagcagggaaggccaaaatagaatgagttatgtgctctgagcttgtctggattctgggaaatgcagcagcagccacagtctgcaggtggtccccattcaggccaaatggtgttcatccctcctcagcatggtgggcacgatggaatcatagcttcctagagctagaagggacctcattcatggttctaccacagccctcgcccccaccatttagggagaaaaatgatgcaaatagaggcaaggagaggggtaggaggctgccacacctccagagcctccagggagtgaatgacagcataagtcttgcccagacccaagcctggtactgtctcccttcagcccaggtctggacccaccttccctgtccttgtacgtttccaacagcttgagttgctacctggcctttcctcagagccccttccttgttactctgagcatatacagtgtgtgtgtgtgtgtgtgtgtgtgtgtgtgtttgggccccagttaggatgaggccacaggcagaaacagaaaagaggaggctcctgtcattgcttttcctacttgggaatttcccctggggcaggggtaggggaggagcccatgagagtcacaggctggacagggcctgctgcagtcaacaggtccaggtctgagagcaggtactgccattagtgccattaggaaagaatgcagaggcagcagccacagagggaacgtctgggctggagagggcagaactcctcaagtccaggcagacagggcctgcaaagtgaaaccaaggggactcgcaaagaaggagggttctgttcctgccacagaagtgcagcctccccagcaacaggaatccctggagaagaaacccaccctgggctttctcagatcccccagagaaaggccacaccccctggatactgttgtcatggcagcagctgcccagtgctaactcccttctccctttcctgcatggctgtcctgcctgcgttctgatactttcagctcctgcttcctgaaaagatctgtgctgcccaccctggcagtatgcaaacgtggctggagcc

SEQ ID NO: 7095 - DNA, 1158 bp, mus musculus
tggtattccctctttttcttttatctgaaagtgtttgtataaaattgagattatctctttctagaaagcttggtagaactcaactataagacagtcttgacttagtatttcctcagcaggaagattttaaccactgcgttgaattttaagatagttataggatgattcaagattttaaaatttctttttatgttcttgtaagttacatttttctagccatttgtccatttctccaaagttttcaaaaacgtcggtttttggtgttgatggcattgttttattatctttttttaaatttatttattattattatactttaagttttagggtacatgtgcacaatgtgcaggttagttacatatgtatacatgtgccatgctggtgcgctgcacccactaactcgtcatctagcattaggtatatctcccaatgctatccctcccctctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcatttttgatggctgcatggtattccatggtgtatatgtgccacattttcttaatccagtctatcaatgttggacatttgggttggttccaagtctttgctattgtgaataatgccacaataaacatacgtgtgcatgtgtctttatagcagcatgatttatagtcctttgggtattatattttaaaacactgttctgcttagttataccttcctttccattaaaacattatttgcatcttctctcttttctctctttattaatcttgccaaatatttgtcactttttttcccaaagaaacacctattgtttttatatctttgttttctatttcattagttttcagtcttatatttattatctttttctttctactttctttgggcttattctcttggggtcgttgttttaataactccttaaaatagacacataacttcttgggcttgcttcctctttattttgggtatttaaggctataaatttccttcaaaatactgcttttattacatcttagaagttttgttac

SEQ ID NO: 7096 - DNA, 480 bp, mus musculus
ttcaaccctcaaaataaccctatgtggtaggtactattacactcattttccagatgaagccaagactccaagaggttaatttactagaagtcacacagctagaaactgttgaaacagagactctagttcaaatctttttgaacctagaggcctttgctcttaatagccacactagtcattctcaaccctggctgcatatgagaatcaccagggagtttttaaaaaatagtgatagccaggcccaactctgcagagattctggttcaattgatctgggatgaggactaaacattggcagcttttaaaagctccccaggagattctaatatgccaccaggtttgagaactatttcattacatttttcagcctttgagagtacacctgggccttgtaaaagtttgcagtttagatggacaagagaaagaaggacattctgggtgggaattctgtttaagctttaaggtgatacacaactatct

SEQ ID NO: 7097 - DNA, 277 bp, mus musculus
agaaaaccttatttttctaatgatttttgagaaatagaacttatcaaagggcttgagatcttgtttgtttattcatttgttttccttccttgaatttgctacagtatcagttgctagttcttatgttttaacgtcagtcttattcaatgactgtagatcgattaattgatgttatatgtagcaaatcaattcaccttataaaatttcagacagtaaagcttgttttagtttccttatcattagatggtctctgaaatttacaaggaaagtattttga

SEQ ID NO: 7098 - DNA, 849 bp, mus musculus
actcaaaaagggtagctaggaggtagtatgtcaggtattgttctttcctttcaacagaaagtcaaaactggggctctgagattctgaatcatttattagaatccagtattctttctattacaagagtgactcctaacctgagttttctgcccacaccctatccctggggggcatctgtgaaggtaataatgagaatctatgagttattttcaatatttgaaagaagcctaacagagagcattaatttactcgtgataaattacacaacctgactaatatgtcaagtttctttgcttttgcctgaaattatatcaactcattttggtaatactggctatctcatgctgatgggaaactgattggcagctatatatgcctttgatgaatagaaatgaggaaaacgaattttatatcataaatgcagttgatctgggagatattcttttcagcttgggagaacatagagaaaaataaaatgctcctttgttgctgaaactattgagaagcactgtattttacaccatgctttctgattcaagggaaaagggggtttaaggggcttagaaagataggcagttgtggtcagagagaatttcagactttgagagcttatgggtaaattgttttcatataacatacctgattgaaaggaggatatgacgtgtttttcttctgtgagaaagagatgaggcaactgaggcctaaagagggataatgaatcagccaagttaaaaaagcagcttgtaacagaaccaatatttcaacccagtcttgtgactctgttccatagctctctctactctgaatcaaagaaatatagtcatcttgtcttgattttgccacaatgtc

SEQ ID NO: 7099 - DNA, 388 bp, mus musculus
catttccctgaattctaatgtggctgagcacttttgtatatatttattttattattttttttaatttagagacagagtatcaccatgttgcccaggctggtcttgaactcctgggctcaaggaactttcctcctgcctcagcctcccaagtgctgggattacaggcatgagccaccacgcctggcccacatatatttattagctatgtgtatttcctcttttgtaaggtatctcttcagtattttgcccattttcctaatggttgttcatctttttcttattgatttgtaggagttattcatgtattttagttttaagttctctgataattctttgtgtagcaaatatcttttcctatcctgtggggttttttttttttggtccatct

SEQ ID NO: 7100 - DNA, 388 bp, mus musculus; identical to SEQ ID NO: 7099

SEQ ID NO: 7101 - DNA, 317 bp, mus musculus
aaattgtacaatttaataagtttaggcaagtatgtacaagcatgaaagcatcaccacaatgaagataatgaacatgtccattatctgcaaaagttccctcatattcctttgtaataccttctctcactcttctctgccaccccccatccttggacaataacaaatctgttttctgtcactatagataaattttaatttgctagaattccatggaaatggaaacataaaatacatgtgcttttctacataattaaaaaataattatgctttttactcagcataattattttgatactcattcatgatgctgcctgtac

SEQ ID NO: 7102 - DNA, 317 bp, mus musculus; identical to SEQ ID NO: 7101

SEQ ID NO: 7103 - DNA, 271 bp, mus musculus
atattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttat

SEQ ID NO: 7104 - DNA, 164 bp, mus musculus
aggataaattgtatgaatgggatatggaatctgttatctttggaaagatatgctttctcttctctccccaaggattgctggcatttctcaaagtgcttattttccttgaggagtaatgttttcttttgcatgatgttcaacatataagtctttgtatcttacct

SEQ ID NO: 7105 - DNA, 1226 bp, mus musculus
tgtcaggatgggggaaagaaacttttagtttgggcactgccattttttttttttttttgccattctttcacaaccgatgatttccagaagcttcagaaataatgtgagtaacaaaccttttcctctgattgacaggcatttggaaacaccaccgtctgtgtcgggaaagcagaataactctccagtatctcgtcattagcttgctggaagcaggagggctatgttcctgggactcgggcgcttttctcgccttgttctctggtttgcggctttcaggaaactgctgggacaccatggccttgcatctgccaagttcctgtggtgcttgtgccttctgtctgtcatgtcccttccgcagcaggtgtggacactcccctacaagataggggtggtgggcccttgggcttgtgattcgctgttttcaaaggccctgcctgaggttgctgcgcgattagccattgagcgaatcaaccgggacccatcttttgacctgagttattcttttgaatacgtgattctcaatgaagactgccagacttcgagggctctctccagtttcatttcccaccaccagatggcctcaggatttattggacctaccaaccctggctactgcgaggcagcctcgctcctgggaaacagctgggacaaaggaattttctcttgggcttgtgtgaattatgaattagacaataaaattagctacccgaccttttctcggacactcccttctcccatccgggtgcttgtaactgtcatgaaatatttccagtgggctcatgctggagtcatttcctcagatgaagacatttgggtgcatacagccaatcgagtcgcaagtgctcttcggagccacggcttacctgtaggggtcgtcctgaccacaggacaagacagccaaagcatgcggaaagccctccagaggattcaccaggcagacagaattcgcagtgagtgctttctcccgctgaaatttaaacgtgacttcagggaaagagattacaatctccaaaaggtttcctaccctcacaccctagggtagcacatcccttcccatttctttacacatttgccctttttcactcacacacaggtcccaagactgccctgcttcaacagagcctattttatgaactgaataacagtacaaagaactctgtgcttcatatgcctgtgaatgctagtgcctgctcttagcgcctgagtgaagaatggtgtcaagagca

SEQ ID NO: 7106 - DNA, 10520 bp, mus musculus
agaaattatgtatcctggctgggcgtggtggtgggtgcctgtaatcccagcactttgggaggctgaggtggtcagaccacctgaggtcaggagttcaagaccagccttaccaacatggtgaaaccccttctctactaaaaatgcaaaaattagctgggtgtggtggcaggtgcctgtaatcccagctactcgagaggctgagggaggagaatcacttgaacttgggaggcggaggttgcagtgagatgagatcgcaccactgcacaccagcctgggcgacagagactccatctcaaaaaaaaaaaaaaaaaaaaagaaattatgtatcttttaaaggtaagataatctgtgaagccatctggtcttggtgccatttttcaatgggtaaacccttaatcacctttctgatgtgttctgtggtaatctattcaaatctttttgggtcaattttggtcgtttgtgttttgctgggaaattatccatttcttctaaattttcaaatttgttgccaaatatttagttgagcatgtagtatcctcttattttataatttaaaaatatctccttatctgtagtcatgtattttttcttggacttgatcttgtctgtttttgtgttctctcctctgtatattaatcaggttagtaagcacttatctgtttttggttgctacatagaaccatgttttcaatttatttattctttctaccttatttattttttctacttaattttcagcttttatcttcattaattccctcttctgtttttttcttaatctctcaagcacaaggacaagtatttattcctttatttattttttgtctttttttttttccaatttttcttctagatccaagggttacatgtgcaggtttgttacaagggtatgttgcacgatgctgaggtttgggacatgattgaacctgtcactcaggtagtgatgagcatagtactcaataggtagtttttcagcccttgtcatcctccttccctcccctctcttgtagtccccattgtttgttgtttttattttatttttattttttgacaggttctcactctggtgcccaggctggagtgcagtgttgagaacgtggctcactatagcctcgacctcttgggctcaagtgatcctcctgcctcagcctcccaagtagctgggactacaggcactagctgtgacacctagctaggtaattattttagtttttgtagagatggggtctttctgtgttgcccaggctggtctcaaactcctgggctcaagaaattctcccacttcagcgtcccaaagagctgggattacaggcatgagctactatgcctggcttgttttaactatctttatgtctatgtgtatctaatgtttagcttctactcacaagtgagaacatgtggtatttgattttctgtttctgtgttcgttagcttaggataatggcctcagctgcatccatgctgctgcaaagggcatgacttcattctttttatggctgcatactattccatggtatacatgtactatattttctttatccagtccaccattgatgggcatctagattgattccttgtctttactattgtgaatagtgctgcgatgaatatacgggtacttgtatctttttggtagaatgatttattttcctttgagtatatacccagtaatgggattgctgggttgagtggtagttctgcttttaattctttgagaactctccaacctgctttccacagtggatatgaactaatttacattcccatcaacagtatatatgcattcctttttctctacagcctcaccagcatctgttatttttcaaatttttaataatagccgttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttactcaggattgctttggctatttgggctgttttttggttatctatggattttagaatagttttttctaattctgtgaagaatgactttggtagtttgataggagtagcattgaatctgtagattgcttcgggtagtatggccatttgaacaatgttgattattctaatccatgagaatctaatacttttccatttgtttgtgttagctatgatttcttttagcagggttttttagttctcctcgtaaagatctttcatctccttggctggatgtattcctaggcattttatgtttttgtagctattgtaaaatgggattacattcttgatttgattctcagcttgaatgttattggtgtatagaaatgctactgatttttttatatgattttgtatcctgaaacttcactgaagttgtttatcagttctaggagccttttgttggagtctttagggttttctaggtatagaattatatcgtcagtgaagagaagatagtttgaattcttctttcctatttggatgccttttatttattcctcttgcctgatttctctggctaagccttccagtactatgttgaataggaatggtgagagcgggcatccttgtcttgttccagttctcaaggggaatgcttccagcttttgctcattcagtatgatgttggctgtggggttttcttagattactcttattattttgaggtatattctttcaatgtttagcttgttgaaggtttttatcatgaagggaagttggattatataaaaaacctttttatttgactattgagatgatcatatggtccttgttttaaattctgtttatgtgtcgaatcacatttattgatttgcatatgttgaaccaactttgcatcccagaaatgaagcctacttgattttggtgaattaactatttgatgtgctgctggattcagtttgctagtattttgttgaggatttttgcttctatgttcatcagggatattggcctgtagttttcttttttcactgtgtctttgacagattttgttatcaaggtgatgctggctttgtagcatgatttagggaggagtctctcctccttgatttttttttttttttttttgtaatagtaagattggtgccagctctttcttttttatccatctgatagaatttagctctgaatctatctggtccatggctttttttggttggtaggttttctttttttacaattactgattcaatttcagaacttgttatttgcccaaggttttagtttcttcctgattcattcttgggaggttgtgtgtttccaggaatctatccattttctctagattttctaatttgtgggcatagaagtgttcatagtagtctctgaggttctttcatatttctttgggatcagttgtaatgtcacatttgtcatctctgattgtggttatttgggtcttctctcttttttctttgttgatctagctatcaatttatagatcttgtttatcctttcaaataaccaacctttttttattgatccttggtatggatttttttgggtttcagtttcattcatttctgctctggttttagttatatcttttcttcttgctttggagttggttcttgttttctagttcctctagacacaacttcagcttgttaatttgagttctttctaacttcttgatgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtaattgggtcttcttggtattgatttctatttttattccactgtggaacaagagtatgcttggaatgatttctagctttttgaatttattgagacttaactttatggccaaacatatgtttgatcttagagtatgttccgtgtgcagatgagaagagtgtttattctgtgattgttgggtggagtgttctgtagatgtctattaggtccaattggttaactgtcaaatttaagtccagaatttctttgttcattttctgacttgatgatctgtctaacaccatagtggagtattgaaatccccattattattgtgtggctatctaagtctttttgtaggtttcaaagtatgtgttttatgaatttgggtgctccaatgttgggtgcatatatattcaggatagttaagtctccttgttgaattgaagcctttaccattatgtaatactcttatttgtccttttttactgtttttggtttgtagtctttttatctggtataagaattatcgacccctgttcttttttgtttttcatttgcatgatagatttctctctatcccattactttgagcctgtgggtgtcatcacatgtgagatgcttctcttgaagacagcaggcagttaggtcttggttgtttttatccatcttgccactctgtgccctttcagtggacatttagactgtttacattcaacattaatattgatatatgaggttttgttcctttcatgatgttgttaattggttgctttgtagtctcgattgtgtagttgctttttggagtctatgggctgtgtactaaaatgtgtttttgtggtagcagatattattcttttgttcccatgtttagaactcccttaaggagctcttgtaaggctggtttagtggtaacgagttcccttagcatttgcttgtctagaaaagattttatttctccttctcttatgaagcttagtttggtgggatatgaaattcttgtttggaatttattttttctaaggatgctgaaaataggcccccagtctcttctggcttgaaaggattctgctgagaagtctgctgttagcctgacgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaaaagttcacagaaaatggaattaaagataaagataaaaattataaacttcatttctcaacagaagctccgtgaacgtcaatttaattcatccctaaagaatgcaatttaattcatccctgaagaactgagggtactgggaatgtaactgtcaatgtattcttttttacattattaactaaagataaatgagggcctttaagatatatatttttttaagtttaagaaacaaaaagaagtcagaaagagccatgtcaggactttgagatgattgcctaatgatttcccgtcgaaactctcagagaattgcccttgtttgatgagaggaatgagcaggagcattttcctggtcaagaagtattccccggtgaagctttcctgggcagtttttcactaaagctttggctgactttatcaaaacactgtcataataagtaggtgttattgtcctttgactctcgaaaaaatcaacaagcaaaatgtgttgagcatccccaaaacctgctgccatgacctttgctcttgaccagtccacttttgctttgaccggaccactttcattgcttggtagacattgctatgattgtactttgtcttcaggatcgtgttccatctcctgttataattctttgaagacatgcttcaggatctttatcccacctgtttaaaatttccattgaaagctctgtcctcatcttcagctgatctgggtgcaattttgaaacccatcatggggaaagtttgctcatctttaatttttcagtcagaattgtgtaagctgagccaattgagatgtctgtggtgttggctatcgtttctgctattaatcattggtcttcttcaattaagaaatgaacaagatacgaattgatgtaggtagtctgccactgcaggcttcatcatcaacatctcaccctttcttaaaatgatgacactctggggactgctgtggggtagggggaggggggagggatagcattaggagatatacctaatgctaaatgacgagttaatggttgcagcacaccagcatggcacatgcatacatatgtaactaacctacacattgtgtacatgtaccctaaaacttaaagtataataataattaaaaaaaatgagttatcctgtaaactgctgatttcttctgggcattgtctctgtaaactttttataaagcataaatgatttcaccatccttccacccaagcttcactataaatttgatgtttgttcttgcttcaattttagcagaattattgttgttctggtaggggctcttttcaaactggtgtcttatccttcttagtgcctcaaactagatcctgttcagacatgttagaataagttagcacgagtttattttggtgctgaaaatttgaaatccatgcatagttttttgtaataatatgtatttcccattaacttattgaagacctgttgtctattaagtataataatgtagaaaaaataatataggaaaaaacacaaagaaatcccatgtaccttttacctaatttcctccactggtaacctctggcaaaactatagtacagtatcactgccaggatattttcattgatacggtctgataaagcagaacagtcctgtcaccatgcagatctcttctgtcattcttttatagccatacccaccatctacatatctaaaccccatccctgatccctggcaaccatgaatctattcttcatatctataattttgctattttaggaatcttgtgtaaatatagttataccttatattacctttgaggctgactttttaaaaatcacctagcataattccctggagagttatccaactttttataatacacaacatttttttctgttttcgagaccacgttttgctctgttgcccaggctggagtgcagtggtgcattcacggctcactgcagccttggcctgcttgacttaagtgatccttccacatcagcctctcaagtagctgggaccacaggtgtgcaccactatgcctagctaataattttttttttttttttttttttttttttgtagagacggagtctcattatgttgttcacactggtctgaaacttctggcctcaagtgatgctcctgcctcggcctcctaaagtgctgagattacaggaatgagccaacacggtggctgatacacaccatctttaatgggtgcatattattccattgtgtggaaataccatgttgagttaaaaatcagtattttaaaaagtagagagcccttaaaatactttaactttacattagtattgttctttactgtttaaaagttctttgctttaaattttctcatctaatctttaaaatagtattgggggatagcgaatacattatccatactataaatagagcagtaggggaccaagaaatattatataacttggctaagattacttcgtggcagagtcaggattcctattctttcttctcttgccagtgatcataacataatcaggtttactgtgtgcctaggcatggtgggaaacacttaacattgattattttatttaatccttctaacaaaactgtgtgggaagtactaatagtagtactggtactattaatagtagtttggtcaagagaactggggctcagaaagtttacatgactggatgtggcttgcatgtggtacatgcaggatttgatccaaagtttctctcactccagagcccatgctgctaatcatgaccttgtgttgctgaagtgaatattttctactatcccattgttgtttaaattgttaaaagtatgaaagcatcttatttaaaattccctatgtctcagtatacatggatgagctctgttgtgatctttatgcccgtgtgttctttgggtttgttgactagcatcatatacctatctctcttgctttctctatgggccctttgctgtgccagccacacatgagtttaccagcttcccagctaaccaggggccagcatgttcttcctggaggcatgcccagccactataggaaaggggtatgacgtgtgcagcaggctgcatgtcctgtgcttggcaaaggctggcaactcccactggggtggagaagggacaggattctccacatggttcccatggtacacttgacaagagggaatgatagtaccacagtgttatgtctgggtcctggaatgcttcatttatatgtacctcagttgacatgtgacttgctcagtcctgctgctatagcctgctgctggaagggctgcctcagtggaaagcatgcatccagggtgtggagccaaaattagaagggccaaaattctacctggcccactaccacagcaaccttgggcatcgttttcttttgatctctagtatctccaactcctagaattccagcctggcagtcttctgcctctgaaggcctcttatccttcctgttcttggctcctcttctctgtgaatgcttacatagcagcgtcagagttgtttgttgtattgtgtctgtacatgcagtgctgttctgtatctctttgaatctgagccattttcttttgactcatttggctgatgtgaatggtactttcctgaagagctatctaccagtgccgttgacatccaagccacagaattcttttcctcacttcggtttgaataaaaccaacatatcct

SEQ ID NO: 7107 - DNA, 10520 bp, mus musculus; identical to SEQ ID NO: 7106

SEQ ID NO: 7108 - DNA, 10520 bp, mus musculus; identical to SEQ ID NO: 7106

SEQ ID NO: 7109 - DNA, 973 bp, mus musculus
taccctaacagcacactccaactctgttgaaactgccagatctatgggatggtttctcggttaattatcataaaaacaggagagtgcattttgtgactgaggtacacacatgtaagaaataaacaccaaggacatctcgatgttaaagcagctaacaagtcattgttatgggccattaaaaatcaacagccaaacctgtgtcaattccaaactctgaggaggctgatcacctgaccactacaatcatcaggatagaattttaaaataagattgtaaattgttcactaaaacactgttagtggggaggagaaaatagagtttcaatgtgggaaaagcaaagggacttacatatttttataatatttgaaaagccattaattactgccttcactttccttttttgaaaattgcatcagggtttttgggaggtaacttccttccctccagaagagaaacccctaaaaacgatcctcacacaaaacctgagaaaacatgagagcaatgcttttgtttctaagatgttagaatccacatatttattaggtttttagacctcttctccctcaactccttttttttccctccttttctttaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaagtaaagtatcagtggccgggcattgaaaatgggctagtttattctttcattttcactttctttcttaggtagttgtttcttgaggattgactgttcagggcctgccggccctttacatctacgtcttcagaggttgcattttgtcagagaataatgtttgattgatttactgtggg

SEQ ID NO: 7110 - DNA, 973 bp, mus musculus; identical to SEQ ID NO: 7109

SEQ ID NO: 7111 - DNA, 973 bp, mus musculus; identical to SEQ ID NO: 7109

SEQ ID NO: 7112 - DNA, 431 bp, mus musculus
tcagcccagacatctatatttaccagttacctggagggacagaaattttccctgtgacctctttcccaagtgttcacttgaatcacagggacttggatgggaaggggaaatagaaggtccctattaggtctgtagcctcctagatgtgctgtgtgaatcatagaggaagtcaataaggaggcaaatgaagaatattaacttgagcaggatggtgagaggaaggcagagtgcctgcaacagtcgctgaacctgttcactgtttactgggatagaagttggggggtgatgtggggcaagatgaaagtcagagctgagacaacatgcaagtgcttccagtacctatgttccagctaccttaaatcatggttttttttgatctgttgaaatggggtggtcggggatggggtgaaagagatttgcaaaatttgggc

SEQ ID NO: 7113 - DNA, 377 bp, mus musculus
tgctatccttcttgtattttataacaatgattccctttccctctgcttctctctctttcattctctttctctgatctctctccttttcttcctattcttctcagttttgttgctaatgggtctggatttggctatccaggctaatccatcggatattccctctttctaggaaaaagaggggtgaggtggtttgtgtgaaatttggctcattacctctggccagtgaaataccataaacacaagacctataaactatgcacctttaattaactcttggctattttcatgatttcccttatttggcgggttctaggttgctttgaatagctgaggttactagacatctgaatctgaaaaatcatagctctatgttattt

SEQ ID NO: 7114 - DNA, 193 bp, mus musculus
aatgtgtgacaatccaggattcaaatacaagtaggatttggaatggaatcatttataaaaggtgacaaaagtgccaaaattaatcagggaccctttggatattccagtgaatatggcacactgactagcccccaggattgttccagtctcttttgcaagagtgtcaatatagtgaggagaggtttccatagct

SEQ ID NO: 7115 - DNA, 466 bp, mus musculus
aattatttgaatcaccttttctttaatacttgggacacatttttaatgactatttaaaatctttctctacttaatccaacatatggaccactttacaattgtttattactgattgctttttgcttcacgatgggtcatatttttctgttccattgtctagtatttttaatagtatattgaccttttgactcacatgttgtaatgattttggattcttctatcttcctctgaagagtgttgatttttttttttttaatccagtaagcagttcaattactgtctaattaccaggaatttggataggcttggtattttcattgtgttaagacagatttgtgaaaaatctgaagtgttctcaaagcccccaaaacatgaaaaaattcaacctccaaactcttctcacctaggattttctaaggccgtggttgtaggcttacttaatgtgactctgtgttaagtcttactc

SEQ ID NO: 7116 - DNA, 612 bp, mus musculus
ttgccagggagtgctttgtatatacttacttgtctatcgatcctcataacaaccttgtaaagtaggtactattattcttccattttatagatgagggaaaatagtacatacctactatatgattgttgtaggaataaataaagtcatacatgtaaagtggcaggcacatacctgacattcatttattcatttaataagcatttaaggagcaattactctgtgccagaaactctccatgccagtaatactatagcattgggcactcaataagtgttaatctctttactacacctctactccttcaaaaactaaaataataaagaacattcaaaatgtaggacgccaaggaaaaaattagtaaatgtcctgataactgtgggtaaagacattatctgacatattgcatgaattttttgattcagtctatactagaggatattttacattgattaccactgcaatgcagtccctgaaatgacacattggtaactggttgaattacagccagcagtcagaattatccaagccaaacttatgaaatgtatgttggtaagtcaccaactatatgacatataccaaagattatacaaggagaacagagggaaagtaggg

SEQ ID NO: 7117 - DNA, 251 bp, mus musculus
agaagtctcattcaaagcattttcatcaggcttagttttttagtttttttgcaaacttctaaactagcttcctaaattaatattacactaataggcatataacactgatgctgagcccccagtcccacaatggaaagttttccatttcctcaacagatttgcatctcctttctgtgattattgaggattgtaaatacacacaactttttacctctgccataatttgctctttattattcaccattgtttct

SEQ ID NO: 7118 - DNA, 238 bp, mus musculus
aattaatattacactaataggcatataacactgatgctgagcccccagtcccacaatggaaagttttccatttcctcaacagatttgcatctcctttctgtgattattgaggattgtaaatacacacaactttttacctctgccataatttgctctttattattcaccattgtttctaccataggagtcaacattctataaaatactgattatttctcaccaatttcaatgttttaat

SEQ ID NO: 7119 - DNA, 171 bp, mus musculus
ccaggattagtttgaggataaagtcttgagcatgaaaaggattgagtggggcacaactggaaactactagtgctgttattaaatacaaacctcataaagcaatacgacagcttatattgctaaaccaaattgcaaatcaacaagaaaagatagccatcggatatgctaaca

SEQ ID NO: 7120 - DNA, 1320 bp, mus musculus
aaggccttgagtgactgaactgctcatcacattagtcccaatggaagtgaatgggcagtggcaaatattaggaaagtgcaggcagggcttttctgattgcctactgatttcctcccttgagagggacaggcattttgttttcttttctttttcttttcttttttttttttttttgagatggagtctcgctctgtcgcccaggctggagtgcagtggcaagatctcggctcactgcaagctccgcctcctgaattcacgccattctcctgtctcagcctcccaagtagctgggaattcaggtgcccaccaccacgcctggctatttttttgtgtgtttttagttgagagatggggtttcactgtgttagccaggatggtctcgatctcctgacctcatgatctgcccgcatcggcctcccaaagtgctgggattacaggcgtgagccaccgcgccgggacaggcattttcttggttgcccacaagcctgactgaaagaccactgggctgtcttgaagaaagacagtgcttgagggcagggggtgttggttacacactctagccctcagccttgggctgcccccatcccaagtccctttccagtcaacagtggatgaagaacaaaatggattccaaggacagacctcaggggcaccaagctctggatggtgcatctcttgggaggaataagtgggttaaaaatagaactggactggggcgagcactcttgggaatgcctctgggcccctcctctccctcttggtgtgttcactacaggctctctgctccccaaggcagctgctgcaaggcaagaagggagccaggggtggttagttagatctacctcaatctgagctaaaggtgtcctcgggttaccccacgagatcccgcccagctcaccacgatcaacctttgtcaagggttttctgatcctaactagtactaaagagtgtgcccttgactgctgtgtcttctgtgtagtgtgtatgtcagggcggtttgctcagaggtggcagcttaaatctgtatcttccctccatcccactgaagttcaatctcattcattactggagggcccttcctcttccgaccagttacccaaggattaggggcacctctgtggggtcttcagtacatcgtgattgttcctgctaccctcactgtccacatggtttcttgaagatgggactgctccagggcaggctgctccagggatggtggggcatgagaggtcaggtgaggaagatgcttcttctacctaggcttggcgctctgatgtctgggatccagcctcctgtgtaccactaagccatttccctgag

SEQ ID NO: 7121 - DNA, 205 bp, mus musculus
acataaattgagcaagctcctgaggtttccaacttattgtacataatatccagagttgttttttttaagataaagcattgttcttggttttattatttgtataaaaatttcccatttattttatacctaaatagtagataaggttactacaggattaaagagtttgactctgaattaatggggcatacactttggggtaaggatt

SEQ ID NO: 7122 - DNA, 205 bp, mus musculus; identical to SEQ ID NO: 7121

SEQ ID NO: 7123 - DNA, 110 bp, mus musculus
aagtggagtggtacaatgagaagttcattgcttcagaaagactgaaaagtagactttgatggtcaagctccttcccttatatccacgaaatggtcaacagctccccaaga

SEQ ID NO: 7124 - DNA, 178 bp, mus musculus
tcccagtaatttttgttttaacaagctctctaggagattctgatcatgctgaagtttgaaaaccactgctctagaagttcaggaaatgagggattattgtttattgaagagtagtgaaagacttcatggagaaggtgagatgagctaaacactagagtaagatggacttttgaaaagg

SEQ ID NO: 7125 - DNA, 764 bp, mus musculus
ttaatgcaaaagcatccatgaacaaacatatcagaagagttgctcttaatctttgatttaaaagtgttttcgctttaagatgagaaagactatcagtttcaaaggttctctagattttgagcatttgaagtcaaatctatggataaaagtggaatttgtgatttgaattgtatttttttcacctctatgaatgacatcatacagatatagcctttatattatttctggaagtatgattcatattctggagtcttatagtgaaatacatttgtaacaaacattgtaacaaaatgcatttttggtaaaacaaaaatataagaaaactcttttgggcattacagacttaatatgatacttggtattgaatacctgctaggaaatagagtaccttttcaattctcaaagaaatgtcacatgctatttagtctacatttagtgcttctcatttctggcagaagtttatcatccttaaatccagggagttacataacaaaatttaaaaactgtacttcacagattcctagtgaatccttatgagtatctcattcacttatttatttattcaaaaatatatcttgaatgtctactatgtaccagacactatgctaagtgctttgtagaaatgaacaagaggaggaggagagaacgttggatcataaggagaaaaggttggctctctgccactgcttcaacctgaggtcttctttcactgttgtgtattttgaacttttgtaaaagattttcatgggtaaaacatgcaaaat

SEQ ID NO: 7126 - DNA, 285 bp, mus musculus
ttaaaaaaataagtaaaattaaaaaaaatcttgttttaacaacaaaaaaaaaacaccaaatacattcaaatatccttaaaagaataaataaaatgaaaaacaagcgagattactagaagagtacttagtgactcattggacatagaaggattggactgagtcaatgataaatgggataatgatagtgacactagcaaaaaaagtgaagtcaaaaagaaatgacccttaaatatatgaagatatatttatcacatataattaaagaaatgcaaattaataatacac

SEQ ID NO: 7127 - DNA, 290 bp, mus musculus
taagactttgctgggtacaagaattgttcagttgaggtattcaacattggacagtgactaatgaatcagtcaaatactcaaatactttgttttgtgtagcttgcatatgagtcatataccttagaacttcctaccattcactggcatgtctgtgtgcctcttctcatcatccccttaacttggaataccttttaatcttcctccccattggtaaatttttaaacctttaaggcttatttcaaaatgttatctcctctgtgaaggctttcctgaactttcaggtagatttg

SEQ ID NO: 7128 - DNA, 785 bp, mus musculus
tcaaagaaataattcctcttcctgcccaagaggatcactccacaatcttcctcccatttccaaccctgagtacatgtctggactccagatctgtatgactaaaacaagttcgtgttcttttcattagagtggtgtctttcaaacttttttgaccacagccttcagtaagaaatatatttgacatcattatccaatgcaaacacaacacacactctacatagacagatatagatgataaataggcagataagtagatggatgatagatagatagataatttatatgtctatatgtggacctataaaatatgaccacataactgacataaaagttttataaggtaatactaccattaatgtgggcactgtactctagtattttctactgtaccctgtttcactttaaaaataagaaaaacaagagaaaaaagaggtaggtcttttcctactaaattattttacatctcatcattgggctaggacccacagtttgaaaaacagttcactatagtatagtccaccattctcccttccagatacagttggacagaacgtaggatgaaaaagagatgtcagcctgagtttaagcattagccattggaattttcaaagtagaaaactacaggattgcatttgcacactctgcctctgaattgtttttctctatattatactctaaatggctttttaaacactaccccaaatacttggaaaaaaaacttgctgattttgttttgttatacctacagtattcaacttgtattctgacaccattctggactgcag

SEQ ID NO: 7129 - DNA, 953 bp, mus musculus
acacatatttgcactccatgctgtcaacatttgatattgctgaattttgttttattccaaagaaaaaaacatggggatacatttgataatttcaataaatgctgcatcaccagataaacattaaacttggagtacttctacatgaaataatataaatgtaataataatattagagatttatttctgtaaccagctaaggagatgaagtttgaaatattgagaaaggaactgtgagtagcaatagcatcctagacacaccgtaatttaaatctcctttcccaaagacagtttctccctgaggctgggaaaaaatgaagatggtggcatggatagcaatcaagtcactgtagccttatgacccctttcaaaataaagcaaagtggaatggggaagaaggagattcaggggagaaaatatttgtggtctttgactatatgagtctgaaataacttaatctggctacctaaacatatgtctagttcctcccttgaatattcaataggtacttgaaacctcagtgtctaaagtggatgccaccataaggggtcaactgaatatataggtgtggtgttgctccagatgttagtgatacctgattttctgccaggagaaaccagcagaactttaagaattcacctagctacaaaaagcacagtttctttcaatgtagtttacagcaaataatttatttaacctcacagttggagataaccattttatctatacagcacgtgtagtagttgatttgcctgaaccttcctaagctccttctcagagcttgttctcacagtccctgatgaggctgattgctctcccaaccaccataattgattaaacctagcatggaaaattgaccaataaccaattgacaaataacaggttcaagaccaagctgtgccttttatttgctgtatgacattgagcaagctgcttaagcttctctgaacttcact

SEQ ID NO: 7130 - DNA, 1306 bp, mus musculus
ccagagccggcaacaactgggtgaaggggcactacacggagggcacagagctggtaggcactgtcctggacgtggtccagaaggaggcctagaactgcgactgccttcaaggcttccagctgacgcacttgctggggggtggcacggggtccgggatgggcacactgctcatcagtaagatccgtgaggagttcccagaccgcatcatgaacaccttcagcatggtgccctcgcccaaagtgtcagatacggtgtggagccctacaatgccacactgtctgtgcaccagctggtggagaatacgaatgagacctactgcatcaacaatggggcactctatgacatctgcttccgcaccctcaagctgaccacctccacctacggggacctcaaccacctggtgtcagccaccatgagcagagtcaccacctgcctgtgcttcctgggccagctgaacaccaacctgcacaagctggccgtcaacatggtcccctttccttgcccgcacttcttcatgcctggcttcgcacccctgaccagccggggcagccagcagtaccaggccctgagggtgcctgagctcacacagcagatgttcgatgccaagaacatgatggccatgtgcaacccgcgacatggccgctacctgaccatggccaccgtgttccgggccgcatgtccatgaaggaggtggacaagcagatgctgagcctgcagagcaagaacagcagctacttcgtgcagtggatccccaacaacatgaagacggccgtgtgcgacatctcgccccacggcctgaagatagccgcaactttcatcagcaacaacacagacttccaggagctgttcaagtgcatctctgcgcagttcacggccatgttgtggtgcaaggcgttcctgcactggtacacaggcgagggcatggacgagatggagttcaccgagactgacagcaacatgaatgacctggtatctgagtaccagcagtaccaggatgccacagccgaggagggcgagttcaagcaggaggccgaggaggaggtggcctaggctgctcccatcgcttcctgtctgtcccctcgaggcttctgacctttgaccccctaggccctccatctctgacccctagacccccgctttccctccaagcctgactcatccctgaccctaagacttcaccctgaccctaacaataccttcggagctcgctttacctctggctacttcatctccgaccctggctccccattgacccttgagccctaatttatctttgacccccttgagctcttccaaccttgacatt

SEQ ID NO: 7131 - DNA, 1080 bp, mus musculus
ataacagttgttttctgccagaattgccaaaatacactgaagtttgatattaaatatgtttaagtatttattaatgttaacatcagaaacaggcagagtttgtgttggcacagaaaagaaagtgtcactactctcattctcttgtgttgagattctcttattagaattatttatagtataaaattggtaaagaagggctccatgtaatggagctaatttaatgttctagtaagagaatctacttataacctagtctgtacaaaacaaaaagaatctcaagtgtttgggtgctttctagtcaggcactctgtttggaaagaacttgagttcgtcttcatcccatactcaatactaaattgctaattaagattttgtactttcattcatcatcagaccttttctaccgagattcatagagtgttatggtaagaattggcctttaaacattatctcggtctttttggtggaaacgttctaaccacccaaactctgacttgaaccaaaaaaggagaaccctgaagcatgcgggaaggggagaggacaagggattagtagtgtggtagttactgtgaatggacaggtaagaaattgggtgcacgagtcctctttgttttcattacttgggattccaaacactacttgataattcattataaagaggctgcaatcagatacttgtttctggatctgcaaatacacagtttcttcagctcaaaacaatacatgagttctatgacttttgttcatagaacttataagagatttaacttacaagtaagagctctttgtaatatttcagctcattacatctggctttgatatcagttcttaatagcttattatagtattctaaaatattacttaatgggcataagtgctagaattttaattgaacaacctaacttttagtatatatactaagagtcacatgccattcttgtttagtgaacaagggagagttgctccattcatcatctgcttttacttttagacaagtaattattagattttacctaacattcctttctcagttggagtatatagaaagcatcaatgtaagtcattttgcccagattttac

SEQ ID NO: 7132 - DNA, 1080 bp, mus musculus; identical to SEQ ID NO: 7131

SEQ ID NO: 7133 - DNA, 719 bp, mus musculus
ccatggcgatgaattttggggaccatgccagcggcttccgccacaatgatgtgatcaggttcattaacaatgaagtcctcatggacggcagcggcccagccttttacgtggccttccgctcgcggccgtggaacgaggtagaggacagccttcaggccattgtggccgactctcaggtgccgcgcgccatcaagagggcctgtacctggagcgctttggctttgagcgtgcgagtggccacgaggcagcgggaggagctgctgcaccacgttcggcggctgcaaaggcatgcggaggagcgccaggcgacctcctgggctctaacgtcccagctgcagcagctgcgcctggagcatgaggtggcggcaacacagctgcacctcgcgcaggctgccctgcagcaggcgctgaatgagcgtgatgggctgtacgggaggctgctccagatcgagaggtttccccaggccgctccactggcccatgaaataatgtctgggccgcaagcagagcagaatggggctgcggcatgtcccctggctacagagcagcagagcgatatggtggccatggggacacatgctaatgcccagatgccaaccccgacagatgttctttatgtgccaggacctctgagtccctgggcccagggcatgcaaccccctctgccagtgccacatccattcccacacccaccaccattcccaatgaaattcccatcc

SEQ ID NO: 7134 - DNA, 352 bp, mus musculus
cccactactggtaatgttaactttgatcatttaattaatatggtatcttccaggcttctccactgtactcatcccatatgcacttgtaattaagaagtgttttgtgaggaggtactttgaagctatgtattgctcatcaaactttcaatttattaattcatttattcatacctgtgataactcaggatttttcatattattcaatgaattatagtttcttgctatttctgtttattttgatgctcaaattgttttgtaaacagtgactgactgccacttcaaggtggactttgcatgtttttgacatgtcctcatctttctctgagcactttttgtcttaataggatattcc

SEQ ID NO: 7135 - DNA, 470 bp, mus musculus
agatcccaattgttttatcctttggggcacagtgccatttcagttaggcatcatcacgtgacttgctctggcctatgaaatgtgagcagatggtatgtgtagcatttctgagtggaagcttttaagagccattgcacaaatctccattttcttttagcctgccttggaaggccctaaaagcttcatgctgagatgacagtgtcctaagttgtgttcagagcaccaccttctgaactgcattgcacatgtagcatgaatgaaaaataagcatctgttgtttccacccactattatcttgtggggaggtgggtcatctgcaacctaatctaacctatactgactagtccaagtgtcccatcaagccactgctgtagtggaaagagtctgaagctaagagtcaagagtcctagatctagttccagcactgctactgagtaacccgtgactttagtcaaatccctcatttcttt

SEQ ID NO: 7136 - DNA, 140 bp, mus musculus
gtgaagcatgaaacccagaacccataaaggaaaaaaaaatgacagatttgataatgtaaaaattgaatgcccataaacaacagtaaggggggatgggaaaacaataggttgggagataatatctggtacatacaaaatgc

SEQ ID NO: 7137 - DNA, 357 bp, mus musculus
cactgcatcctctaagacaggaagtaaattacaaaatatagtggtgagaagttaaagtagtttatgacttgatggtctcacccaagaaaaatgagagacagggttatgtgctgaaagtgtgaatcaagtcaaaggcttcagatgagtagtgaggtaagtttttgacgaggccaaaacagaattgcacatgcctatctagagctcaggtgaggtggaactgtagatggagatgtgggaacattaatgacaataaatattgttgaccactatgtgccaagtactctgctaactgagcttgcatatattttttatttagtccttatttgcaaccctgtgatgtaaagataattatcatgg

SEQ ID NO: 7138 - DNA, 1300 bp, mus musculus
acaccacagggcctttgtacatgcttctctttttcctagaacactgtccctcctcctttgcttagtttactaatcataatttcctcagggaagtaggttctgaccttcctaactatgtcaaatcctcatattatatgcttttatatagcgctgtatcttcccttccatgtacgtaccacaggtataataatacagtttatatgtgtaattattttaatactgtctgtctttaccactagactgtaagttccatcatggcaggaatcttgtctattgtattctactgcctcaatacccagcccagtgccttgttcttagttcaataaatattaatttaataaatgaatgcatgaatttccagaagttcacacagttagaatccaagtttcctgagtcctagcatagaatttttcaaggcacaatgctgctcctatttaggccaacaacacaggattgggacatttagcatttttctatttgttggctacaaactaagcccctaacttctgccagatgctacacgtatgcatcgaatttttcaccaaggggagtatatgaatgcatcagcaattcagtcccactactacaataataaatcatatgccttgaagaaggtgagtacagattgttgttattatcatcaaagtagtatgtatgttaattttaaaaggaaatatttgagcactaaccatagaaggaaaacatgtagtgctgttataagcatatttaagttccttttgaaaaaaagtttcccaatactttcaatttgctgacctgggtttctgaattttatttttctttaaaatacctacagttttcatagaaacatcacaaataacctttcatagactaagttgttactcatttggaaggaaaaaaaaccaaagagaacactattctttcttgaaaaaatccaagttgaaatatgtgcactttatactttttaagctaagtgaaataataaagaaaatttatgaaatgctcttctggaaaatctacttatggaaggtttttattttaaaccaataagtggacttttaatagtgaaatctgagaattgtgcatattctttagaaaatccaagttataatcctgaagtactataatcatctaataggtgcctgatctttcaaattctttaatccttcttcacattaactttctgacctagctttttgcaaacactcctaagtccctgaaaatattttcatgacacaaaaccgtaattaattgaggttgccctatgttagcaactaacttacagatgtagttgggttctgagtggttcataggaaaacgt

SEQ ID NO: 7139 - DNA, 302 bp, mus musculus
tgatggtacctaccgatttagattactatgaagattaaatgagtatgctagttactgctaatgctacactaataactgtattgcccttttctcctcctcctgaacacacaggttgactgcatttctcagctattaggtatagccatgtgactaaattcttgctaatgaaaaacggtcacgtggcactgctaagcatggcccatgaaaacctcccatgtgctatccttattttcttttcccattcaccggctaaatagaaagaacttctagaactcagaggaggccacagccacaagacggaa

SEQ ID NO: 7140 - DNA, 283 bp, mus musculus
aagtttatgagtatgcacaaatacactgcactcgacactgaaaaaatgagattgacagcaatcattagtcacatatactcacagcccagggaaggaggacactgcacaccacagagtcacacaggggttgtgctcaagaatagagtgaacaaccatgggttgtggaaatcaggttttgcagtattaagagggaggatcctcccacaggatgatgttcttggcttatttgaaaaactgcaggctgacagagaaccaaaacacactactcagggatcagaggaac

SEQ ID NO: 7141 - DNA, 223 bp, mus musculus
aaagtgttttgaaagcactttgagaactaaacaaactaaatgtgaaatacaattcttttatattatcccttgcccactactctctcttacttttaataaacaaacattaatatttctgttaattcttcagaagtattaaagatagagaaaaataaatcccttgaactctaaattcctgtggcatttccacctcaatctcactttcattctgatcttagataaa

SEQ ID NO: 7142 - DNA, 653 bp, mus musculus
acacagagccttcctttgtgaacataacacatgattttgaaccagcttgatagtttgaagggtgaagtttgtaatactggaactggaatttcttttaatgtgaaagcaaaccagctcacacagagaacaagtgcagaatcttggtttatttgacactatgctggagaaagttgagttaactgtttcagaccatgatgatcagggaccaaaaaatcatcttgtaggcttttgtttatgtgtttgtattttaaaaaataaactgtttttctaggtatgccttaccaatattctatagctttttttgcattttaatattttaaatgacatgacatcttttataaattataaaatacttatatgtgcctttctaattattaaatcagtctttcacacttcacacaatcatgcaacttcagaattatcaattgaatttcaatgataaaccgtgtttaagatacgcaataatacacttactcacaaacaaaacccagtgtcttagtttttttacctggtaaaattggctagtggagaactaatataatttcctcacaagtgttctaatgcatccaactctagccaaatgttttgtccgcattgtgacctattgtgcttaaaggggtaataaatatgaaataatacagtgcccaaagttg

SEQ ID NO: 7143 - DNA, 1738 bp, mus musculus
tgccttattaggactgtgtgtttgctgatcttggcactagggctctgaacagaaaaaacttttaaggccaactttttttaaaaaacacgcactcattgcatgtactagtggcctcaatcagggtagatgatctttttaaatcaagttagatttgaaaacagaaatctaggaaaaaaccatggacttgttctttgttcttgtattattgcaactattaattagtttcagtcttaagctgttaaacaaccaagtaacacagcatctgtggccagagggagattacaatgaactttgtgtttagagaagctttgtttgttggttctcacttttgggccacaagctccttgagtctaggggctatgtcttctttgcctttgtatcatccacagcctcttacagagtacctagcttggtctcatgaactgcaggcattaaagttgtcatgttaatcaataaagaagtacttgcattgtcaggaataaaagctagtaaaaatttggctattacatactgtgtgagattttagtgaatacataagaactgtttgtaattaacatgttagatgttcaaaagcatactgacatacctaagaacctttggaaatcttcttgactattttaaacaaactcgaataatccagtttatataatttacttaggaaatatttttctacacaggtagttaaaaaggtaatcttctctctaacctatgtgtgggttattaataactcagaggtgtagagctagtgagactctacacatatttgataccaaaacatccatgctaagagaaggtagtgatgatgagataatactgacgcaaacaaaaatggttactatgaggatttcaaaagtcaaatatcactatctgtatggaaatcctcctatggcaaaataaatataaattaatttcttaaggattcatgtaagtgaactaaaaacagtatggatagttaaaagctttagttaaaatgtgtttaataattgattataaaaggtttgaacaacaatttgtaagtaatgctcttagaagtccaaaaattttaaaggacctgagaagccactagattagaacaaatctccctttgccaaacccaaacacctactcaggatttctgaacatgtagtaaatatttctttctttagaaaaattccatgaggctgccgggcgtggtggctcacgcctgtaatcccagcactttgggaggccgaggcaggccgatcacgaggtcaggagatcgagaccatcctgactaacacggtgaaacctcgtctctactaaaaatacaaaaaattaaccgggtgtggtggcgggcgcctgtagtcccagccactcgggaagctgaggcaggagaatggcgtgaacccaggaggtggagcttgcagtgagtggagattgcgccactgcactccagcctgggcaacagagagagactctgtctagaaaaaaaaaaaattccatgaggtaactgtaagaccccgttgattagtgagttcatactctatttcctgtttgctattatttaagttcattagacaatttttgattgagaaagtttgacttctttgcaatgctatctttgtcccttgtcctttgtaaaatgtatcatcttggaccctaaattaataaaactaccaataacggtatgctaagtttaactttcagtgaaaagtcacacagtgaaatgcttttttaggacattcaagcaataacaagtatataagttcttgtagtaata

SEQ ID NO: 7144 - DNA, 880 bp, mus musculus
gatccagcagtgaggcacatgttgttagttgcttttgccaatactggtggtgatatagccacactctcacctgtttgttctcatcaattaccacacagagtttgcaggacagctggtggcagagaagacaggactactgcctatagctgtgtaatagaataatgctgcctggcccattttgggaaagtatcatgctttcacgattctcatgctttaatacatggaataaatgactacagactcctcaaaaacctggtatatcttccagaagcactttttggacatcataaacttagagagtttttcacatgcatagccaaattacatttggaaagtgagcaaatgggtaggattttctgatgactgtctccccagaggtcaacatgacaatttccttataagctagatggaaacagagaaaaatcatctttatgtctttatatcctgaattcttatttgaagcaaaagagaaagggtgtattttaaatgatactttgccttcatttacacatctgcaaaatttctttaaaaaaaaccccacagcaacacaattttggtagatcaaccacacttttttaaaagtttcagatggggtttcattatatttcccaggctggtctccaaccactgggctcaatccatcctcctgcctcagcctcctgagtagctgggattacatgtgcatgccaccattcccagaaatcatatttatattaaagtcataattgctgtgcaaaagtaaatatatctttctacagaccttacttagcatttcaatactgtcatcaaaattttttgagaggtaaataaatgatatctggaactgtgtcatgaataaagaggctatgggtaatgaaaggcatttataccttagctactt

SEQ ID NO: 7145 - DNA, 1142 bp, mus musculus
aacttagggatttagataagtttgataacaattttatgtaattttgtctagtctggttatgactctggagttaactcaaacaaaatgactacacacataaacatcagcactaaccagggttgtaaactgaaatatgatttcaaattacaagtagattatttttcaaacctctttttcacttttcaactccactttatcagagtgccctgaacattctctaattttatttttttcttttgagacagagtcttgctcagtcgcccaggctggagtgcagtggcacgatctcggctcactgcaacctccgcctcccgagttcatgccattctcctgcctcagcctccctagtagctaggactacagacgcccgccacgatgcctggctaattttttttttttttttgcatttttagtagagacggggtttcaccatgttagccaggatggtctcgatctcctgacctcgtgatccacccacctcggcctcccaaagtgctgggattacaggagtgagccactgcgcccagttctaatttaatttttaattaaatgtttaaaatcttgacatacaaaattgtatgtatttatcaagtacaacatgaggttttgcagtatgtatacttgtgaaatcactaaatctagctaattaacatatgcattacttcacatagtcatcatttttgaaactcaaacaactcaatagcaagaaaacaaaaacctgattaaaaaacaggcaaaagacatgaatagatatttctcaaaagacatacatatggccaacaggtacataaaaaaactgttcaacatcactgatcatcaggaaaattcatataaaagctacattatcataacttcaggtttcctatgtgagctgcattgtccatttgtggctatgcccaactcatgaaatttttgtaaaagtgattctaataacataagtttaaaaattagtaaactgtgacgtgctaaataaatggtaataattatttttccaaatacaaacatgaggaacacgaggacttttcaagggtctagtatgtgtagtatgatcaagagaataggtagttaatttttttgagcaattataatgggataaggacagctaaattctttatacacattgtttcatttaatctttacaa

SEQ ID NO: 7146 - DNA, 281 bp, mus musculus
gaaagaaattatatacagatttttgggctttagctctgaagattaagatgtattgagtttagaatgtggcctcaaaattcactcattaaaaaaaagctctaagaagattcctatatgtgcaaagatttaggaagccctgcatcacggtaagtaaataaatatgcaactttgaaatccataagatgaaagatatgagtatgttgaataaaagcaaatattaccatgcaactaatgttagtttctgctatatttatttttttctttttggttgtaattaatga

SEQ ID NO: 7147 - DNA, 153 bp, mus musculus
agcttggatgtaaagttaatggcttcgggctttgagttgaagtccagcaattcctcagtcttgcctgcacttcagaatgacctaggagcttcaaaaataaataatccagtactctaacccagactcataattctgaatagccgaggtggcgat

SEQ ID NO: 7148 - DNA, 174 bp, mus musculus
ataagcaaagagggctgccagttttaaacatatggaaaactaaagaaggattgagaagactgcagatgtgaaggagaaaaaaattcaacttcatctgaactgaattgtttcattctttacattacagccatcaacattatcaactttatcctacaacatgcttacctttttttc

SEQ ID NO: 7149 - DNA, 43 bp, mus musculus
tttgggaataagtaagtccttccaattgtcagtgttcttccat

SEQ ID NO: 7150 - DNA, 974 bp, mus musculus
agtgcccccttagcattcagattctggtctctgatactattctttcactgaaaggaaccatgactccttcaaacatgagtgattccatgtctggggcagaaaggtacaaggggagcggggaaaatatgattgtaccagaaagcaacaaaactttcaatgagtagtgggtcatgttataaggaatggagcaaaagtttttaaagtcttccacattaaaaagaaaataattactataggtgactgaaatatagtaagtctatgaaaaaccatgctcccataatgatacacaaaaagaaaccataagaaatgatttcaaaagtaggtgaatagaacagaatggccgggcacggtggctcatgcctacataatcccagcactttgggaggccgaggcaggcagatcacccaaggtcaggagttcaagaccagcctggccaacatggtgaaaccccatctctactaaaaacataaaaactagctgggcgtggtggtaaacgcctgtaatcccagctactcgggaggctgaggcaggagaattgcttgaacccaggagacggaggttgcagagagtcgacacagtgccactgcactccagcctcggtgacagagtgagactctgtctcaaaacaaaaacaaacaaacaaaaacagaacagaatgcatttctatggagttttatttctcattcatgaggcattattgattaatttattgtatcaatagagaatatagaaactagtaaatacatcagttgaagggcaatttctgatgccaggggaatatcagaatggccaataaactgcgatctcaagtcagacaaagcaaaatgaaatatctggaattcaattgtatataaatgtaagtattcttaagatatgtatggccctaagaatatgaatcaatgggaaaagtattaacatatctcaagaacccatcaacttccaagttctttagagtgtggagaaatacaatacaa

SEQ ID NO: 7151 - DNA, 997 bp, mus musculus
gaggattcgttctgcacgcatctgcgaggggagctcaggctcactgttgggggcgtgtgggaaaggagattttcagggggccgcgagttgtgggttcccgcctccacccctgtccgcgccccacactcaggcaacagttggtcgtgcggggccggcccgggctctgggtggggaaggggagtctcgcgatcgttgagggggggggggtggaggaaggggggagagtgacggggggaggccatgacgtagggtgggtggacggaagtggggcagggttgagggttatttaaagaagggggggcctgagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggaggtaaataggaagggggtgtgtgtgtggtggacaaatcctgtgcctggcccctctgaggggcccaaaccctgacctttcggcgccgacaggtacccgcggagctttgcggggctaggggcggcgggtgcgggggtcggcggcggaaccgcctggcgttcgctcccctccccctttccttctcgccgcctggaggacgggggcggggctgggcgcgggcgggagcggcgcggggtggaggggtgcccgctctcccggggcctgggggctcgggagcccctcgacagcccccgaccccctccaccttcccggaactcgggtaacggggtgggggatggggctgtgcaggaaaaagcctccgcctctccctctcctctcgctcgctccctctc

SEQ ID NO: 7152 - DNA, 1037 bp, mus musculus
ctaaatgtacagttcagtggcatcacattgttgtgcaaccattgccaccatccatttccagaacttttttattatcccatgctgcatgtgtttcttcaacattattattattatttttcttttttgtgtctgtttttaattttattattattatttgttcattttaacattatttttaatgtcagccttggtttttatcttgcagatcaaaggatcatggacagggaagaatcgcgtccagaatccctacagccatggcaatattgtgaagaactgctgtgaagtgctgtgtggccccttgccccccaggtgctcagggcactcaaaagtcctgggactgttgggatgagcagctcaacctgatcctgttaccttgtctgatgtgtttttctgagtgtggcctcttggtgtcaaataggtctttccagggcttgccacttggtaccatgtctacatggaccatagaccatgggctggttgttttggagggatgatctttcattcttaatttcatttgtttgttccctggttaatgtgacatttcctggtttgtggaagaaaaagtgaatgggagataagaggcatgtgctgtgttcaggctagattgccaaaggacaggtttatattttccagtctatgcagcaaaattccgtaggccaggtgggtggaggggtgaatgcccagttctttgttaactctcttatctccttcagtgtgctggatcgaaggggtattttgccactggaggaaagtggaagtcgacctcccagtactcaagagaccagtagcagcctcttgccacagagcccagtaagtgttcctgacttaaggctgggtcgatatagagagggcggaggctaatttacagcttggaaatataattaggcaatattgtattctaatcaccccagcttccctgcctctacacctgccctgatgttgccttcagatctttgtgtccttgatgtagattaagatttagtcatttctttggtgtatattgagtgactctgtgccagccactgtactagctgcca

SEQ ID NO: 7153 - DNA, 1037 bp, mus musculus; identical to SEQ ID NO: 7152

SEQ ID NO: 7154 - DNA, 809 bp, mus musculus
agaagaatgttttcaaaataaggagcttcccagacctgtgttagaagggcagcagtcagagaggaccccaaataatcgccctgatgcccctaaggagaagaaaaagaaggagcaaatgatcgacctacagaacctcctaaccacacaatctccctccgtgaagtctttggcagttcccacaatagaggagctggtgagcagagccagggtggtgggccattgttcagaaagtgtcgttcttgcgcaaggagtaatgaagctttgttttgctgggggcacatttcagtagtttagaggtccagaatagtatagggccaggctagtcccagtgacgttttaatagatgcagatatatgggtgctgccaagacccctatttccgaaagcctgatccacaaaaactcctctggggtgactctaaaactgctctcagaggtaagagggagtaactcagagttctgaccagatcccaggcaggacaacttgaaggtgagtcattgaactgttgcgaaagttttattcagtgggatctcagatggtctaagactccccagttaatctgaaacttaaagtgaagcgtcctggcacctgtcttttcagggatataagctggaggaagcctacagtctggccacttagagctcctgctgctaacacgggccattccttcctccaccctgcagcttccttactgaaaagtttaaaattgtgtcatatgataatgagctagggatatttaccctagagggaagaaaatttgagcatgattggctgtgcactggtttgtatcgcaagaccatcattgttcag

SEQ ID NO: 7155 - DNA, 176 bp, mus musculus
tatggatatgccacattttatttatctattcatcagtttatggacatctgggttgttttcacttctttgttattatgaataatgctgatataagcatttatgtacaagttgtttgcatgaataatacttcagttctattgggtatatatcaaggggtggaattgctaagtcatatg

SEQ ID NO: 7156 - DNA, 131 bp, mus musculus
attcctttatataaatttattgatcaattctacacaaatatttgtgtagtttgaagctattataaagagtactactatgaatattcttgtacatttctgttggtgcacatatatacatatttctatttggt

SEQ ID NO: 7157 - DNA, 231 bp, mus musculus
cactgattaataatagataggctggtaccatgctaagtgtgttatatatatattatttcatttaatctctgtgaactttgcaggtggatattatttctatcacgtaggtaagaattcacttgactacattagtgaatgatcattaagtttcaagcccaattctaacttcagagcctgcttccttaaccactaccatatactgtaattactcaggagataggataacacaaa

SEQ ID NO: 7158 - DNA, 946 bp, mus musculus
ttgtgtcaacaaacccctcaccccgaagttgttgccttcagtagtgtgacccttcaaccactgagtggcatctggaactaagatgtgataccagatgggttattttccctctctctctgacacaactaggctgacagaaggtttagaataaaatgttggaaccattttgcgaggtttgaagggtgtgaggagtagggacaagctcatttctgaagaaggggaaggtaaatgaaatctcatgttttctttgtcttcaggaggtctccaggaggggatgagtcactggaaaatcttttgacagagcctttaatgaaaagtactcaggaacttctaatgctccctaccaggtcttcccttattaagtcccctaatgtgtgaccagtgtgtaaagcaaagggatttgccccaagttgactctctgatgttgtaaaatggtcagtagtgtaataatggtgaccctattaacagacaaagtggcccttttccatgttgtcccaaaggattgtcaggcctggcgccagcaagaattgctactgagggaggaatcttgcctagaacttttttgagacctgccaccatccagtctgctctttgttcccctttgagcctggcctcatttggctgttctccctctggtatgcccctagctagcgtgccagccaagctgttgcccttcacacaccccgcccgcagaccgatatgcttgctccctttgcttggctgccagggagaggatttatatcaagattgctcaactaggaaatgccgagttccatacaattccaatgcttgctttctgtcacatttttgttatttcatagtcttgacctttaacctttatgtcgagaaatccttgtggatgagtctacctttgaatgatttgtcttgcagcctcaggtttaatattctgtgtctcgaattattttagatgcctgggctagtctgc

SEQ ID NO: 7159 - DNA, 1401 bp, mus musculus
tagagtataaggtactactatgaacaaatttatgtcaaaaattaaaatctagacagacaaatttctggtcacatgtaaattaccaaaacgtattagaatatacagtcttagtaattgtatgagtccactctcatgctactatgaagaacttcccaagactgagtaatttataaaggaaagaggattaattgactcatggttctgcagggctggggaggcctcaggaatcatggcagaaggcatctcttcatagggcggcaggagagaaaatgagtgcccagcaaagggggaagcccttataaaaccatcagatctcgtgagaactaactcactatcaggagaacaggatgggctaaaccacccccatgattcaattatctccaactggtccctcccacaacatgtggggattatgggatgtacaattcaagatgagatttggttgaggacacagccaaaccatatcagtaatccaataactattagcaaaattgaagcagtgattaagaactttcccaaaaaagaaatacaagaccaaaatgattttgctagtgttttctctcaacatatcaaagaccagattatttccatattaaataaccgttctaaaaaataaaataggaaatactagctaaatcattctatgaaattattaaaagcaatggcaaaaagcaattacttttgcaccaacctaatattgtaatcttgctatccaatccagaaaaagacaatatgagaggagaaaccatagtttattctcactcgtgacccagatgtaaaaaattctaaaactaaaaaaataaataattgaattcaacaatatataaaaataaatagacagtgaccaggctggatttatccctagaagtcaagcatgattgaccttagaaaatgagtaaatattattatattaatgttttactaacaagaaaaaatgtaatagccttactagacacaaaaaaacacatttggtaaaattcaatgccaatgtataatataaatttttagcaaattaggattagaaggaaaattccataatccaataaaatgtatctagcaaaaccctgatcaaacattatatttaacaggaggacattaaaattattccttttactatcaaaaattttaaaatgatgctatcactaactttattcaacactttcctagaagtcttggtattttcagtaggacaagaaaaagaaattaaaggcatatgaatgcaaaatgaaaaaaacaaaaatgttattattcacagattatatgattgcccatataggaaattgaaacaactatacataaaaattcttagaagtaataatttagcaaactgaatagctataatatgagctttaatatatctattgcatttctatacacccagcaacatgtaaaaaatataat

SEQ ID NO: 7160 - DNA, 1080 bp, mus musculus
atgaagtgtcatcaaggactcaattttccatcttaaatcaaaagagtgtccaatggatttatatattttctaaacaatttagttgattgacctatatgtggagacacagatagatattatttaataggcagggaaggtacattgatataacatgaatacttggctgtgtacaacttctcagagaagtaatgcatttacttttaaccacgaagttggtttctctattgtcagaaagaaagaacatcaaaacagccaagacacctgctgtggaaatgtctctttcattgatctctgaaatctctattttatgctgactttcataagaagtatctaatcttccatactcgttcacctgggaagctgggatgttaactgccaaaaacctgcattgcaaaaacaaacaaacaaacaaaaacaaagaaactgaagaacaagaagaagctccatgtggatcagcaagcaagggcagtgtgagtccctttctaggtgtacctcatgaatttgcaagaggaaatacaagccttgcagatggcatttcctttggccattagttttcagaaggctccctgcaaattctcagcagaggaaatagcaggaatgataagtctatttccaaagccctttccaacaaccttcagatttcccgcattcagattgcacttaaaaatatcaaacgacttgccagtcttttcagcagccttctaaatacgtttctgttcaaagaaataatgggagtgacaggctgagaagtcaggaggcactcgataaatgtttctatgaatgagcgagtgaagtgaatgaaagtatatgggcatgaacgaaaagcctacaaatgtgagtctaaatctgtaaatgatcaaaaaagtatttttcctgagagaattatctcatctcaatttggaaacactaatttctggcctcggagagtgcatataatctattttctcatccagtcgattcacatttataaaagtaggtttttcttccagacaaagcacactataggaaaaagaaaaaaaaactgataactgtgttatgccctctgtctgagccttcaaatctctttggttcaaatgggaa

SEQ ID NO: 7161 - DNA, 331 bp, mus musculus
gtgtaactgtaatcccaaaataataaaagacagaaaatgggagagaaaaatagttgaagataaagtggctgaaatttcccaaattgaaacaaaagcataaattttacaaatttaagatgtccaaatcatcaagtaaagtaagcatgaaaaaggccattccaaggcaaatcatagtcaaattattgtcatccaaggataaagaccaaatctcaagagcagtaagagacaagcaatattatatgtatgtgtgtatatatgtatatatatatatatgaaataattatattaattctcatcagaaaatatagaggcaaaaattgagtagaagaat

SEQ ID NO: 7162 - DNA, 1161 bp, mus musculus
cctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaa

SEQ ID NO: 7163 - DNA, 1161 bp, mus musculus; identical to SEQ ID NO: 7162

SEQ ID NO: 7164 - DNA, 575 bp, mus musculus
cttccttctccctatcatcagtgttctggaaagaggtattttgtccatttgtactctctcttttcatttataaatgggaacccagtgtgggttctagacttgaagtattttggaatgtgagagtaatcttttgaactgaaggctgaagacaagttatttctcctggcagcagattaaacaactaactcaaacccatcagcttgccatttgccaaatggagagttcctcataagagaacacatatgttttggaggaaaccaacaacctacattagaaaacatgacccaaagttcatgcactgatgggaatcagtagcaccatcagaagcaatgatcatgatgagcagttatcacatgaaaagcaccacactagctggcactacacaggcagaggacactggaatgaatgagacaactgccctcaaaggggttaacaacaatatatacaggaagacatctttcagacttttatgatggagtgagctgagtttgaggagggaagagaagtatgaatttattgtggaactaaccttctgacatccaaagtgaaatattggtggggtggtgtgctctaag

SEQ ID NO: 7165 - DNA, 8269 bp, mus musculus
agggtttacaataaagtagaagtatgatatatggcagtaatagcacaaaggccaggaggtaagaaatgaaggtatatgattgtgtagttcttatactgtgtgtgaaatgggataacaattggaagtaggctctgagaagatgaagatgtatccaataaaccctaaagcaatcactaaaacaataaaacaaagagatatagctaatgacttaacagaggaaataaaatgaaataataaataaataatcccaaataaggcagaaagagatgagaaactactaatgagatgatacaattaaatgtaactatatcagtaattacattaaatgtacatggtctaaacacttcagttaaaggcacagattgtcatattggataaaaaagcaacactcagcaaccttctgtctataagaaaccaactttggatataaagacaaataggttaaaaataaaaggatggccagattggtcaaagggtacaaacttgcagttgtaacataaataagttctggagacataatgtacagtatggtgactgtgagagttttcagaatcaaaatgaagtcacttatgccaaaccctaacgaaatggagtcaggaggccataatggaggggctctaacacacacatgcctgtgataaaaagtattccaagtactctccgaaaaccataactttgcacaaggacgaccgcaatcttgcacaaaaaatacttatgcagactgggtgcagtggctcacatctgtaataccagcactttgggaggccaagacaggcggattgcttgagctcaggagttcaagaccagcctgggcaacatggagaaatcccatctctacaaaaaatacaaaaattagccaggtgtagtggtgcacaactgtagtcccagacactcgggaggctaaggtgggaggatcaattgagccagggaagtggaggctgcactgagccaccattgcaccactgcactccagctggggtgacagagtgagaccctgtctcaaaaaaaaaaaaaaaaaacacttaggcgaggatgtctgctcagcaactgcctattcagcctttgactgacgccacccttgttattaattcttgtagccaagaataatcgtttcaaaataatttctgtaacagtcttcattttgcctttgtaagtttccccttgcctcagcctccctggatatgcctatgatccatcatagcacatgtcttggattataatcctgctaagtcctgaataaacccattatctttgcagagtctctctccattgttattttaggttggcatgataatagttcataataaggtattctatacttgagatttaccaatagaatagatcttaggtattttcaccatacacaagaagaagtagctatgtgaaatgatggatatgttaattagcttgattgtggtaatcatttcacaatgtatatcaaaacatcacattgtacactttaaatatatataatttttatttgtcaattataactcagtagagttggggcaaagtgaaaggatggaaaagtatatactgtggtaacactagttagatgaaagctggagtggttacataaatatcaaagtaaattcaaaagcaaagattactgtcacagataaaggaagttgtttcataatgacaaaagggtcaattcactgagtggaaataataattctaagtgtttatgcacccaagaacagaactccaaaatgtatgaggcaaaattgaagaagcagcaaggataaataacaattatagtcagaaatctcaatacttcttcctcaattattgctacaagtaggtagaaaattgtgaaggatatagaaaagttgaacatgcagccataaaaaggatgagttcaggccaggcgcggtggctcacgcctgtaatcccagcactttgggaggctgaggcgggtggatcaccatgtcaggagtttgagaccagcctggccaacataatgaaaccccatctctactaaaaatacaaaaaattagctgaatgtggtggcaggtgcctgtagtcctagctacttgggaggctgaggcaggagaattgcttgaacccgggaggtggaggttgcagtgagccgagattgtgccactgcactccggcctaggcaatagagcaagactgtgtttcaaaaaaaaaaaaaaaaaaaaaaaaaggatgagttcatgtcttttgcagggacatggatgaagttggaagccatcatcctcagcaaactaacacaggaacagaaaaccaaacaccgcatgttctcactcataagtgggagttgaacaatgagaacacatggacacagggaggggaacatcacacaccagggcctgttggaaggttggggggtgaggggagggaacatagaggacaggtcaataggtgaagcaaaccaccatggcacatatatacctatgtaaactgcctgcacattctgcacatgtatcctggaacttaaagttaaaaaaaaaaaaaaaagcccaaccagttgggggaaaaaaaaatgttgaacagtactatcaaccaacttgacataattggcatttatagaagactctacccaacaaaagtagaataacacgttttttttccaagtgtctgtggaacatttaccatagtgcatacactgtgtcagaaaattaggattgaataatttaaaaggattcaaaccatacagagtaggctgtttgacaactagggaattaaattagaaatcaataaaaaacgttctcttgaaaatcccccacatattggaaactaaacaacacatttcttaataacatacgggcccaaaaagatatcagaagggaaattagcaagtattttgaaatgaataaaaatgaaaatacagtataacagaatttgtagagtgctactaaagcagtgcttggggggaatttatagcactaaatgcctatgttagaaaaggagaggccaggcgtggtggctcacgcctgtaatcccagcactttgggaggctgggggtgggggtggatcacctgaggtcaggagttcgagaccagcctggctaacatggtgaaaccccatctctactaaaaatacaaaaaaattaggcaggctggcggtgggcgcctgtaatcccagctacttgggaggctgaggcaggagaatcgcttgaacctgggaggtggaggttgcagtgttgcagtgacccgagatcgtgccattgcaatccagcctggacaacaagagcaaaactctgtctcaaaaaaaaaaaaaaaaaaaaaaaggaaaaagaagaaagaaaaaagaaaaggagaaaggttttaagtcagtgacctcagttttcactttaagaaactagaaaaaggagagtaaattaaactcaacataagcagaggaaaggaaataattaagatcagagcacacgtaaatgaaatgtgaaacaacaataaaaaccaaaacaatgcagaaaaatccaatgaaatcaaatgctgcttctttgagaagatcaatgaaatcgataaatctccagccatacttaccaggaaaaaaaaaaaagagaagagagacaaatcactataaattctacagatattaaaaggataacaaaaaactattataaataaatgtatgcccataaacatgacaacttagaaagacacaaatttccaaagttccaccagttattaaatgtgaatccttcaacaagttattttaagtgtctagacctcagtttctttgtattaaaatggtcgagtttgtgaagagcaaatgtacctgaagttattagccattattattattactattgttatcttggattcagacttacagagcaaatgaggatttggatgggactgaggaaaaaaacatgtgattcacaaatagttactgcaggagctagttgatttggtaaaatgctcttgattggacctctgattttgttcaatctcattgtttttgttttaaaagttttcctgctcactaaagagtacttattgatgccttgtgtattaaaaacctgattgatcactatcattaaattgtgctgataaaaagatttctttttttttaaattatatatatattttttttctctctctctctctctgttttttaaacttctccttctggaacagagctaccctataggcagtgtgcccagagtatcctttttttttgaaacaggatcttgctctgtcacccaggctggaattcagtgacatgatcacagttcactgcagcctcgatctcctgggctcaaccaatcctcccacctcagcctcctgagtagctgggactacgggtatgcaccaccacatccggctaatttttttgatttttagtagagacgaggttttgctatattccccagactggtcttgaactcctgacctcaagcaatcttcccacctcagcctcccaaagtgctaggattacaggtgtgagtcacggcacctggctagatttcttaattaaatagctggaaatttcaataatctttactatctagggaaaaaaataatctttaaaacatttagttttcattcctagagcctacagcaataaataaagttaattcaaacaattttactaacctatgactcaaagtgaaatttaaggaactactcatcaagtgatcaagtaggtgaattttttttttgcctggtgtgtagtctttttcaactaaattcctcatatgaactgctgaaaagagaaaattatttgagtgactatttcctcaatttccttcatttctttaaggagaaatgactggtaccactctagatgcataggaaagaagttaattcattacacagggtggatgccttagggcatcagggcttaatcgctttacagaacctcagttgaaaatgctgatctacagaaacaagacaccatccacccatctcacagggttgctccagggatgatcaaaatcaaatcctttaaaatctcatgtgcaacaaacttaatgctgcactctaagataatgcagagttactcattcattataattaggatgaaacttttaaaaatgtttatttttttaaataaagaacttatgccactatcttaaaaacaggaaatacaaacaaaaaatatctttcataaacaccacctagagaaagtcaaattaatatttaaagtgcatatccatcctgattaaaaaaagtatatatatacatatatatatatatatatgtatatatatatattttttttttagatggagtctccctctgtcaccaggctggaatgcagtggcacgatctcagctcattgcaacctctgcctcctgggttcaagcgattctcctgcctcagcctcccgagtagctgggaccacaggcgcctgccaccacgcccaactaatttttgtatttttaatagagatagggtttcaccctgttggccaggatggtctcgatctcttgaccttgtgatctgcccgcctcggcctcccaaaatgctgggattacaggcatgagccactgcgcctggcctatttatgtataatttttaatacaagtgacgtggaagtttgaaacctaaagaatagcttttccttcaacaccagtgggtacatagacttaaaaattgatacataatgattgtacatattctgaagtacatgtggtattttgatacatgcatacaatgtataatgaaatcaggacaactggggtatccatcatttcaaacatttatttttttgtgtgtgctgggaatattccaaatctaagacttttgaagttgagaaggatttggaagagaaaactgaggcccagagactggaaatgatttgaccaacacagggaagaacttgggctggggctgcagacttctgctgcatagccagagatctttactctctcttcactgtgctgcctgtcatggagatcagtgatattctggcttttatcaagtatcttttccctaaaatatcttttccttttcctggtaagtatgcttaagaggaatctgctagagaatagaggaagaaggaacttggttaacatttttttttttctcttgagacagagccttgctctgtcacccaggctggcgtacagtggtgagatcttggctcactgtgacctcctcccgggcccaagtgattctcatccctcagcctcccaagcagctgggactacaggcgtgcgccatcatgcccggctaatttttgtatatatgtatgtattttttttagtagagatagggtttcaccatgttggccaggctggtcttgaactcctggcctcaagtgatccacccacctcggtcttccaaaatggtgagattacaggcatgagccactgcgctcggcaataaacagcttttgataacttggttagttagatttttgtctggctcaacttttcgttgttgttgttgttagaaaattggattggcaggtcagacatagtgctagtgagtgaaatagacctaattactttataatgcgtttttaatttaatgttcaacaaaggccagttactctacacacaaatcaataaacaaacaaccaaagctgattgttgggccgcaaaaaaacattgcaagctgattgctggttgcctggtttcctaagcacggcctaatgcaatttgagataaccttgaagctttacacaagccttactgaaagagctattttgaaatagttaagagtggcctgtaaacaatttcaggtagcctgtaaattgtgtacaacatctcaaagcacctttccaaattctgaccatgttgagcaggagttgaaaatgaagctcagagatggatgtatgacagcaaagaaagtgggaagaactagaatggtgtggtttaaggggcacctggaaggctttttgtccaaaaagctctttcccattacacgtcaaatgcctgaaattctttcattatagactggaaccaaatgactaaacaactgccttagtggggattagttttgggagccgaggtgagaggaccacaaggagagcaattgctgtgaagggcaggtggcttcaccaggtcctttccaactctgtggaaatgaaagtgtggaggcttttgtcgaaagtttcttccctccctccctcccttccttcctttctttttttcgagtctcactctgtcgcccagcctggagtacagtggagtgatctcagctcactgcaacctccacctcccaggttcaagcgattctcctgactcagcctcccgagtagccgggattataggtgtgcaccaccatgcctggctaatttttgcatttttagtagaaacagagtttcgccatgttggacggctggtcttgaattcctgaccttagatgattcgcctgcctcagcctcccaaagtgctgggattacaggcatgagccaccgcgcccggctgaaggtttatttctttctaaatgcgattgacttctaaaacaagtcactttatttttttttcgccaatagagcatcacttggtttaacatgcagttctcatgaactatgtaaaactgttctgctttgcaactcaaattgttcaaatgtactgttttgcaagttcaatttttgatttgttttcttaaagtgaaaactatcttaatatttcaaaacaaatgcatttaagtaaaataagaatatttcattcctatcataacatatatctcaaaagtcttaaattactctactgaatcattaaaatatcagaacaaaatttatccttatagcaatgataagagctgtgtcccaagcctcacctaggatagggagaagggagatcaacatcactgtctaaagggttagaattttaccagtgtcctttataatagtgttttaaaaatacatgtcctatcagtcttcacccagctttaatgttttcttaaaatgtgaaggcatggattttaaatgactcattaaaaatataaagtataggccgggtgtggtggctcatacctgtaatctcagtactttgggaggccgaggccggcagatcacttgcagtcaggagttcgagaccaggctggccaacatggtgaaacctcgtctctactaaaaatacaaaaattagctgggtgtgatggcatgcgcctgtatacaggctcctgagaagcctgtagtcccagcttctcaggaggctgaggcaggagaatcatttgaacccgggaggtggaggttgcggtgagccgagatcgtgccactgaactccagcctaggagacagagcaagactccctctcaaaaaaaaaaaaaaattagagatgttaaaaatgtgtgacagtatggatttaatcaggaaatgaagacaggcagaatgaaccatt

SEQ ID NO: 7166 - DNA, 542 bp, mus musculus
aaaacctcatctaacaaccctgtccttctggctttttatggaggcttcaatacttaggcatgattggctacatctttggccactgaggatcaattcaacatttagcccctctccctccccggagctgggggtcaggtagagctgaaagtcccaactctctaatcatgccttgatgatctttctggtgacgctctagccatctgtcatttcattagcatacaaaagatattcttatcacttcagagattctaagagtcttgggaactatgttccagaaatcaagggcagagacgaattatatatgtcttattacgtcacaatattttaagggcccttgtctatcttatatactgtagcatctctagtgactaggccacagtgcctggcacatagtaggtgctcaataaatgatcagtgactggacaaatgaatgatcaagtgcattgcttaaaatggcaacttgtttgattgtttatttcacttccttttcttgagaaggatcaggagggtacagtcaccttggaccccaacaattacctaca

SEQ ID NO: 7167 - DNA, 383 bp, mus musculus
gggttttcaaattcctagagaaaggcaaatgactatcagtaagaattcctaccaggcagaaggttcaatagtataaggcagatgtgaaagagtggagaaaagggaacgaggttcatattttgttagatgttggctaagtctgttaacctatattatcctatgataaacacctcttagagtggcaccccaacttacaattctcaatctgagaatggcctcaatatgcataggtgaataggcaacaagtggtcatgtttatagtatgggatcttggtctcttggccatgtttgttgatccaggggtgggcacaggatcctaaccaggtaaatgagattctttgtctcatgaatttaaaatctagaacaaaaaggcacagtgcatt

SEQ ID NO: 7168 - DNA, 265 bp, mus musculus
atgttttcttgtgaatattaaactttaacttgtttcacactgaaaagtgttttggaataaaaggaaaagggtgggaaagaagtcaattaacgttcccttgatctccttcaacatcctgattgtaacccaacaatataggtatttctgtcccagtagatgtgaagacaatgcagctatgatatctatttccactttagaaatttttacaatgagaacaaaaggatattaaggatatttctcactaccactcaatagtggaagagtg

SEQ ID NO: 7169 - DNA, 164 bp, mus musculus
attcaggaataaaataattgatgtagttgttgaggggctttgtgtttcattctaacgttgatttttctttcatgaagctgtaagtttgaggtttgagcactccacactcaacacctgtagtgaatgccagtgaaaccctacagtcagaatgttaattagtattc

SEQ ID NO: 7170 - DNA, 673 bp, mus musculus
ttcattctcctatacctccttctacatctctgatagtgtcttctcaggattcatccgtgacttctctagtcctcaaaacgtaagcatttcctaaagttctgtctttgcattttctttctttctttctttttttgagacgaaatttcgcgcttatcacccaggctggagtgcggtgctctctgatcccggctcactgcaacctctgcctccaggttcaagcgattctcctgcctcaacctcacaagtagctgggactacaggtgcccaccaccacacccagctaatttttgtatttttggtagaggcggggtttcaccatgttggccaggctggtctcgaactcctgaccttgggtgatccgcccgcctcagcctcccaaagtgctgggattacaggcgtgagccgccgcggccagcctgcattttctttcttatccctatgggcatgtacctgtttatcacatgagagcgagtataggttttatgtaaatgtccctcaaatccatctctagagtaatttccttgacaaagcaaaatgagtatagttgtgaatgaagagtgagattatttgagcttaaggttagagaaataaagccgtttcaggtgttataggctcatgagctataatttgctgaccccttaaataagggagtgaccaataattagttggtaga

SEQ ID NO: 7171 - DNA, 163 bp, mus musculus
tataattaaaaaacaaaatgagacactgtcaattaattcttgacattttacaaaacatttcaaatatattttatcattggggcctctcagtgagcctataaaataagtcgtagtatatttatccccattttctcctactttttactacaaaactccttcagtt

SEQ ID NO: 7172 - DNA, 314 bp, mus musculus
tggagaaatctactttatgcccatggaaaattaattattagtattggctataaatgctgagaacaaaatggatatttcaggagagaagcactgctagaggtcacaggaaagtgaattcgttaacaagacaatgtgtggtagtaaaattgaatgagaatcttgagtctagagatctgggattaagttagggctccattgcttcgaaatatgagaagacctcacttcccttagcataggtacccaaggctgtttgtcctttgaatgtatccttctataataatattctgctggacacttttcagatcattttactt

SEQ ID NO: 7173 - DNA, 283 bp, mus musculus
aggtctaggtattaggtgaaagatcagacaaggctcttcatggcatggattaagcttcgtctactctggctccaaacttgtatacctcccagatccaagcaaaagtcatacagttaattgggtcaattctacttaaaaggaagttttgtggccatgttttagtatcggagcatgatctttggggggctcaccattctagatccaacctaattgccacagtgaaatatctatttcctcaaaattgcactcttcctgaaagatacttagataaatattatgtcct

SEQ ID NO: 7174 - DNA, 689 bp, mus musculus
cagccaccatattgcgagacactcaactggctctatggagaggtcctcctaataagaaacagagaccttctgcctagatcaagcaaggaactgaggccttctgctaacagccatttgagtaagccatcaatcatgccttcagaggattgcattccataggacagcttgattgccagaactactcagctaaggcatttgcaaattctgtacccacagaaactgtgagaaaataaatatttgttgtgtctaagatgttaagttttggggtaatttgttacatagtaacaaataactaacacaatcttttagctcaccattttgacatagtcaatttgatgtcaataatttttttttgcaatctactatttctcataggcatttttatgtaggttcattttgacaagtctgttttgtttcacattctaaaaaaataaccaaataatacatgaactacacaattcaaacactcctattgccagctcttatctaaatggtcagggttggatgagataaggggtaggctgatgacaagagttgatgtgaggctcaggaataactagagagtagagtgaggcttagggatggacaagggatgagatataggtcagagattgataagaaactgggataagtctatgtacattctctaataagttttaagaatgtgagaacaatttggctatgacatc

SEQ ID NO: 7175 - DNA, 290 bp, mus musculus
atcattattttaaaaaatgaatttgattccagaacctcctctgctgttgcctgctcaaacaaaataccaaaattaaattttattgtcatgtctgccacattacctttccatttcttcctactacttagcaattccttccaggccgagtctctgtcgttatacactagacttgagcttacacatagatacacacatattaagctcatgttgggcccagagcacatttccctatcttgttagtaagcataacaaacttcctgggtaaaggagtccaaacttttgatctatag

SEQ ID NO: 7176 - DNA, 974 bp, mus musculus
agacgtggatctgaggctcggggcagtggcccgcgggttggtcggagattgctagcgctcggcaagactaggaataccagaggaagagccggtgggtaactctaaaagctctgcaaagccaggcgagcgctgccagcgcgactttgcaaggggcctaaatgttgagctgatttctggcatggtgagagcaggatttttgtagctggccagggagggagaacaggcaagggggagcctgggccgccgctcgcagccacaaaaccacagggtcactctgcccgtggcaagcaggtcagtgactccctagtgccaacgtcttcgaggcggcctgatctggcctctcttcctcctcacccaccgcacgcctgggtctagagaggtccactgaaactccggcagctgccccttgtgggacgggagcgcgcggagaaatgtgtgagcggcgggactgaaggcccccgcgacatcccgcgcggtaccccgcctccgctacacggaccgccaggctgctgcttgggcccctgacgcggagggggctgagcggccggctccgggaacagggatgcggcaaaacattgcggtacgcgccagcagcccctccagcctcctcgccgcccgcccgaggtagcgcacccgggcggcaatggccgggtctctccgcgaacctcttccacctccatccgagccttaggcgggccagcggggtttcccgagggagctctcggggagccacctcggcccaccgccctgaagcccatcagtgttctgcccccctcaggccgcttctctcctcccagtcgcggagtgccaggcgctgcactccggtggatgcaggatttgtttttggtcgggctaggtttgttcagtcctggctggtcgtgagagccaagggtctttcagggcaccgagaggaagacggacagctcccagcagccacagagaaggctcttggtacccagctggtactttgtggg

SEQ ID NO: 7177 - DNA, 974 bp, mus musculus; identical to SEQ ID NO: 7176

SEQ ID NO: 7178 - DNA, 974 bp, mus musculus; identical to SEQ ID NO: 7176

SEQ ID NO: 7179 - DNA, 1163 bp, mus musculus
aaactacttgaatataacagaacaatcaatgaatagttaactaaggtaaatttttagataatatggactaagatgctatttccactgctcgtgggttggttgcataagccacaaaaaattgaactttctaaacctcttgatcgcatttgtaagtcatttcattaccacttttagtgaatgcatcctcttaggtaacctcaagtcatttactattgaagataacagaataataaggcttagtcagcctttgcatcttgctgccggcagatgtagcacagacttcactgagtcctgaggaaaggtccaaagtttcttaagttcagctgactataaatgtaaagattgcactgtgcagctcagtgactctctcagtcactatatttggtggggcatactttgtgacagtctcagggaaggaaagtatctggtgtcctggggctggggataagatgatgagcttaagacccatgcaggaagctgcagcaggttagtggttggttagctaattagtgaaagattagtgcttggctaagggcctagaagataatgcacaaggcaagcccaaggaggaagagacagctggctaaacagaataaaagtcacaaacaaaataaagtgggacaaggattgtagggtgtaattcacagcagggagattcaatggctaaaaatggatgatttggtaagttcctataataggctcaggatggtatgaataatgaatggtggagatattttgaaaatgagaggtgaatctgctctgatcatcatggaagagtaggtgaagaataaatgttcttataggagtgaagggaagttgaatcattagatacagtggccagcttttcgtgctagagtgaaccaagaggttaagaaaacactgactgctacactttacaacctaaatatttagttaaattattctaagcccttttcagaaacaggaaaaaaattctaaaatttgtatagaatctcaagggtccctgaattaccaaaacaatcttgataaacaagaatgaattggagacctcattcttgctgatttctatacatattacaacactatagtaatcaaaacagtatggtgctagcataaagacaggcatatagaccaatagaacagaatagagagccccaaaataaattctcatgtatatggtcaaa

SEQ ID NO: 7180 - DNA, 422 bp, mus musculus
tctcaagaaaaaaatcacattctatataggcaatgcattaaaaagagctaaatatacttttctggatgggtaccaaaagaaataaattatatattttaaaacatttcctgagaggaaatgaaattttaaaaaggcttgtgtaactcacatttaagtgagcaaggaacagcaaaatggcaatttctcacttcatccaggaagagaagacatgctgaacaggaagaaagcaaccgtaatgtaagtgacttttgagtggtgcagggagagactcctaacagcattcaaaatagaatttgtccattcagggaatcacataaaactacctctaggacagctgcattgggctttaatttgagtgtacaggcagctgcaaagacatttgcagagctggaggagtcacatatcttgcatttacacagatt

SEQ ID NO: 7181 - DNA, 575 bp, mus musculus
ctagtaaactaatacacctggtaactctaccattaaaacacattcatgatttaataacctttcatcatctgcattgctaagtcctttatctaatgggtttcatataagcttttttgataaatataatatactcctggaaaccatgcatctacatgaaaaaccattgaatttctaaaatagtattaatttaaatagtaaaataattatgcattctacgccagccaaaaatatctcaacatttatcacagaataaataaaagctgagcaatgaaattcaagttcatgtaagtaatgcatacaaatttcaatttaaatgaagattttatacgttaagtgtgatgcagtgaggatttactatactcaccaagggaagaagaaaagacgtgatagtgggtggtgattggttgagaaggagaggcacaatatgtctttagaaagtggtgagaactcagatgactgaccttcaggtaggcatttaatatcttcttatacccagtagggtgagctaatcccaaagagaggtaaatattttctttccacatcttttcaagcctcttcatcacaaccatatttta

SEQ ID NO: 7182 - DNA, 1483 bp, mus musculus
gaaggtagagctccttggcttggtgtggcgacttctgtgaattagtttgggttggtagcacttgttgcagctttcttttttgattggtttctgcagtgtttgacgctaccgaggaggattaattccacccaaaggggatgagatagggatacaggagagtcaatgatgtccctaaaattctttgtgtcaaatatttcaacaagcatttgggcaatttttgctgcttagattcatagtatcgctcatggcattctcttttcaattacttttatttttaagatgtatacctttcagaacaactcagtttaggaaggttctaggcgagactgtttttttcatacttttacagcttcactgacaagcaccaaaaagtttagtgacaaagtcaggcagtgagtcagagagcagcaagggtcctgggtaccatcatatattgttggcgtaaccgcttctcttgtaaatcacagtgttttgtactgaaaaagacttgcaatagtgacttaaggagagattttgaaatgggctttttcttaaacaatgcattctcaaggatgtttttgtaataccctatcagtatctcttaacctctgagctatttaaatgccattcatgcatcattctcacagaaaagtcacgtaggcatttttgggggtctgtggaagaggctagttggctgtttgaaaatatagcatgtgtcacacgttgaaatttatccaaaaattacttctaggttacttttaatactcatccaatataaattgttaaatacaataatatacttctttaagcaaagcatgcttcagactggattgattaatattaatttattgaactctgtctcagataagctaggcaagaatcaattagaaattgataaggcatggcccctggcctcagggagtttacagtctggcaagattgatatggaaggaagcaaacacagatctgaaagtactactaggacaaggtgggtgcagtgtctgccttagcttttctccttccgacactaagcagtacaggaaagatttcacagggatttgtgcgttacagaatggttagtttgatatgtagcagccattactggaaattgcatatgacactcaacgtaaacacattatagaagaaagtatgatatgtagatttcatggcattcatcaaattcctttaacatttgtcaatttccttcaatgtttgacaacattgaattgtccttcaatgtttgacaacatttcttttaaacatgaaagaaaacacttgaacatgattatctctaaagatttattcagcattgtttttgtaatctgtaagatttgtagagttacaatgtgagaattcctagtgatccaaaataactagatgcctgggcttaatagttgagattggccaatagtatatcgaattgtttgaaagtaaaaaaaaaaaaaaaaaaaaatctattgaaatggctaacacatttgagaactttacattataatgaaaagcc

SEQ ID NO: 7183 - DNA, 509 bp, mus musculus
taaagctcttatagagtaaacctctaaacttcttcaggacttagtgaatctgtttcgcaagggtaagccacaagggggcagaagaacagtatggtttacaatatcccatcctagaacatgttatacagtttaattttaccaataacataattattaactattaatactcaaactctaacatcacaatgtattcctatgaccttttcagatggaattaaaatgtttttcctacactattgatacaaatgcgaaaacaataaatgacacaatagtggagtagaccatgttgtatgctttttctaagacttttcagagacacagtttcaatatgcctgtatttttcttgcagttttgctttattttaattattttttcatttaatagacttgggggatgggtccttcacccatgtacctcagataggtaccatgaaagtagatgaaatcatctagaatcatagaagctcagtatgtctgacctatgaggcggctttagagatcacctggtct

SEQ ID NO: 7184 - DNA, 523 bp, mus musculus
caggatattttccatccactgaacaatgtatatttacaaaaataagtagacctcctacatgtattaatttcctaaagttgctatattaaattatcacaactgggcgcttaaaacaatagaaatgtattatttcaagtcctgtaggctagaagtctgaaataaagatgtaggcagggccacattccctctgaaggctctagaaacaactcctttcttgcctcttccagcttctggtggtttccagcaattcttgacattcttcgtcttggagtcaaatcactccaatctctgcctccgtctttgcatggccttcttctttgtgtctctgtcaaaatttccgtctcctttctcttataaagatgccagtcattaaatgtagggcccactttaaatccaggatgattttaacacaagatccttaactaattagatttttacctcaagattctttattaattacatctccaaagaccctatttccaaataggattaaattctgaggttctgggtagtaatgaatttt

SEQ ID NO: 7185 - DNA, 598 bp, mus musculus
ttttggattttttgttgttgctgttgtgagagaagataacctttatttggtcaggccacctgtagactgggtaatgtataaagaaaaagaggtttaatggacccacatttccacatggctggggaggcctcacaatcatggtggaaggcgaaggaggagcaaaggcatgtcttacatggctgcaggcaagagagtgtgtgcaggaaactgccctttatacaaccatcagatatcatgagacttattcactatgatgagaacagcatgagaaaacctgcccccatgattcaattaccccccaccagttacctcctataacacatgaggattatgggagctacaactcacgatgagattttggtggggacacagccaaaccatatcaccattattcaggtactttgttatgtggctatacattcttagctaatggagttgggattcatcatcatttaatagatgaggaaaatgaaacctaagtgaattaaacatgcctattaatataataacaatagggtgatgcttctttagcattgtgtaggtttcaatatgctaatatatattaagtgaaattttaataagactatgaaaatcatga

SEQ ID NO: 7186 - DNA, 256 bp, mus musculus
gcttgcacagagtaggagttcaaaagtgatacttgaatctaaatcaaacttaagcagtttcgtatatggacttattctattactttagtgccttaaaaaacttagcattttcagcaatgtcaaacctgcataaaagtggcaaaaatgttgcaaagaactcctgtgtatgcttcttccagagaccccattcaagtttcatcaaccgtctcaataatacctgtgatggtaaaagaatccaatccaaaaccacaggtac

SEQ ID NO: 7187 - DNA, 171 bp, mus musculus
agaatctattttctttttaagggtgaataatattctcttatgtgtatataccacattttgttcatttattcatcggttgatggacatatgagttgcttccactttctggatattgtgaataatattgctatgaatattggtgttcaagtgtttgttaagtccctgctttca

SEQ ID NO: 7188 - DNA, 6009 bp, mus musculus
ctattattgtatagaaagttatttaagttaaaaaataaaattaattttaagtaactctggctaaagaagttattttattagacataagaggtatagtttttggtttaataatgaatatttgtatttatttatttatgtatttttaacttttgtgggtacatagtaggcatatatatttatgggttacatgagataattcaatacagacatacgatgcataaaaatcacatcacagtaaatggagtatctatcacctcaagtatttatttgtgttccaaacaattcatttatactcctttaggtatttttaaatgtacaattaaatgatttttgactatagtcatcctgttgtgttagcaaatactaggtcttattcattctttctaactatgttttgcaccaattaatcatccccacttccccccaccatcctccactacacttcccagcctctggtaaccattcttctactctctatttccatgagttcatttgctttaatttgtagcgatgtttgactttctgtgcctggtttatttcatcaacttaacctaatgacctccagttccacctatgttgttgcaaatgacagaatctcattcctttttatggctgaaaagtaatccctggcctgtatgtaccacattttctttatccattcatcttcatctgttgatggacacttaggttgtttccaaaccttatctattgtagaaagtgctgccacaaacatgggagtgcagatatcttttcaacacactgattccctttcttttgatgtatacctagcaatgggatttctggatcatatggtagctgtatttgttgctttttgaggaaccactagagtattctccatggtggtgatgctaatttacagtcccaccaacagcgtacgagggtttccttttctctatattcttcccagcatttgttattgcctgactttgggataaaagcaattttaaatgcttgagatggtacctcattgtagttttgatttgcatttctctgatgactaatgatgttgaacactttttcatatgcccgtttgccatgtgtatgtcttcttttgagaaatatctattcaggtgttttgccaaatttttattgatttatagagtggtttgagctccttacatattctatagagtggtttgagcttcttacatattctgattattaatcccttgtcagatggtcagtttgcaaatactgtctcccagtctgcgaattatctctttgctttatttactgtttccttgctaggcagcagcatttaactttgtgtgatcctatttgtccacttttgctttggttccctatgattgtgagctactactcaaaaaatctttattgagactaaggtcttggagagtttccccaaagtttatttgcagtagtttcacagtttgaggttttaggtttaagtctttaatctatttttatttgatttttatatatgatgacagataagggtagagtttcattcttctgcatatggatatccagttttctcagcacaattaattgaagggactgcccttttcacaatgtatgttcttggtacctttgtcaaaaatgagttcactgtagacgtatgaatttatctttgggacctctagtctgttcctctgatttatgtgtctgtttttatgccaataccatgctactttggttactatagctctgtagtataagttgaagtcaggtaatgtgattcttccagttttgttctttttgcttaggatagctttggctattctgggtctttcattattccataaatatattaggattaatttttctatttctgtgaagtatgttattggtattatgtactgaatctgtagattgctttgggtactatggacatttcagcaatattgatacttccaatccatgaacatggactatctttccttttttttttttctgtcttcttaagttctttcatcaatgttttatagtgtttattgtagggatctttcacttctttgggtaagttaattcctaggtatttaattttatttgttgctattgtaaatggggtaactttattcatttctctttcagattgtttcctggtaggatatagaactaattgtttcagattatttcctggtaggatatagctactaatttttgtgtgttggtttgtgtcctgcaactttactgagtttgtttataagtttgaatcgttttttggtggagtctttaagtttttccaaatatacgatcgtatcatctgcaaagataatttaagttattcctttccaatttggatggtgccctttatttttttctcttgtctggtttctctaccttggaatttcaatactgtgttgaataatggtggtaaaaggaggtatccttgtgttcctgaccttacaagaaagatttaaaatatttccccgttctgtatgacattaattaattaattatgggtctgtcatatatggcttttattatgtggaggtatgtttcttctatacccagctttttgaggttttatcatgagggaatattgagttttatcaaatgcttttacagcatcaattcaaatgatcatatgaattttgctcttcattctgttgacataatttatcacattaattgattttaatatattgaacaatccatgcatcctaaggttaaataccacttgctcatgatgaatgatctttttaggatattattgaattttgtttgctagtatgtttttttgaagatttccacatcaatattcatcagtgatattggcctatggttttctttttttggtgtgtctttgtctggttttgttatcagggtattactggcctcatagaatgagtatataagtatttcctccttttctatttttcagaatagtttgagtagcattggtattattccttctttaaatgtttggtagaattcagcagtgaagccatctggttccatatttttctttgctgggagacttatagctttgatcttatttattttttttttgtacacgttttgaatttcttcatagttcaatcttggcagattttacggatcttaaaatttatttgtttctttgaggttttccaatttatttgcatgtagttgctcatagtagccactaatgtgcccttgaatttctgcaatataagttataatgtcttatttttcatctctgattttatttatttggatcttatttttctttttcttagtctggctaaagttttctgaattttgttttctcttttgcaaggaaacaactttttgttttgttgatgttttgtattattttcttcatgtcaaattcatttatttctgctctaatgtttatttttttctactaattttgaggttggtttgctcttgcttttctagttctttaacatgcatcattaggttgtttatttgaaggctttctttgtttttgatgtacacacgtataaacttccctcttaaaactgcattcattgtatcccactatattgtgtttctgtgaccattcgtttcaagaaatttttcaattttcttcctaatttctttatttatccactggtaattcaggagcatattgtttagttttcattgtttatatagtttccagaattattcttgtttttgatttctagttttatttttttgagcagagaaaatgcatgatgttattttgattttttgaaatgttttaagacttgtttgtgatctatcatatggtctatccttgagaatgatccatgtgctgataaaaataacttatattctctagccattggataaagtgttctgtaaatatctaattggtaccatatagtgcagattaagtctgatgtttctctgttgattttctatctggaagatctgtccaatgctgagagtggggtgttaaagtctccaactattattgtattggggtctacctctcccttcttctctaataatatctgctttatatatctgggtgctccagtattgggtatatttatatttacagtttttatgtcctcttattaatttaccactacatcattatatagtggtctttttctctccttatgattttgaaatctattttgtctgctataagtatagctattcttgctctttttttgtttccgttggcatgcaacatctttttttatccctttattttcaatctatgtgtctctctacaggtgaagtgtatttcttaaaggcagcagatcattacatcttgtttttctcatctattcagtcaatccaggtcttttgattggagattttaatccattgacatttaatattattattgataggttaggacttactcctgacattctgttaatttgtgttctggttgttttttggccttctgttccatcttttcttccatcctgtcttcctcttaataaatgtgattgtctttggtggtatgatttaatttgttgctttttattttttgtgcaaccattatatgatttttgatttgaggctaccatgaggcttacaaatactgtcttataactaattgttttaagctgataacagcactgcttgcacacacaaaaaaaatgaacaaaaagaaaactaaattaaatctctacaccttaattttttccctctgctttttagctttttgtcatttctctttatatcttattgtaccatctatgtcttgaaaagttgtattcatacaactataatagttactattttcaatcagttcataatttaatttttctacttaagagtagtttacacagcacagttacagtgtcaaaatattctgtgtcttttgtgtacttattattgtcagttttgtaccttgagatgatttcttattgctcattaatgtcattttcattctgactgaagtactccatttagcatttattataaaataagtctgatgttgatgaattctctcagtttttgtttgtctggaaaagtctttatttctccttcatgtgtgaaggttatctttgctggatatactattctagagtaatgatttctttttccttcagcgctttaaatatgtcacgccactctctcctggcctgtaaggcttctactgaaaagtctatttccaggcatattgaatctccattgtatgttatttgtttcttttatcttgctgcttttaggatcccttctttgtttttgacctttgagagtttgcttattaaaggccttgaggtagtcttctttgggttaaatgtgcttggtattctaccttcttgtacatggatgttgacatctttccctaggtttgggattttctctgttactatccttttgaattaactttctacccccatctctttctctacctcttctttaaggacaataactcttagatgtgcccttttgatgctattttctagatcccatatgtgtgcttcattgttttatactgtttttcctttgtctcctctgactttgtcctttcaaatagcctgtcttcaaactcactaattttttctttcacatgatcatctctgctattaagagactctgatacattcttcagaatgtcgattgcattaagtacagaatttctgcttgattatttttaattgttgcaatctctttgttacatttatctgacagaattctgaattccttctctgtggattgtctttcatttcttaaaatttcctcagaagagctatttcaaattttctgtctgcaaagtcatgtatctccctttctccaagattggtccctggtgtcttctttagttcctttcgtgaggtgatgttttccttaatgatcttgatgcttttggatgtttgtctttgtctgaacattgaagagttaagtattcattgtagtccttgcagtctggctttttgtacttgtccttcttgggaaggcttttcaggtttttgaaaagacttgggtgttgtgatatacttaagttaatttctgatacatggataaacaaatgtgtatatgggcaaggaaataatatgaagataatttaaacaaaactataaaaagaaagaatgttaacagcactatcaatttgtacaacat

SEQ ID NO: 7189 - DNA, 333 bp, mus musculus
gtccagaagcggcgttaaggtgagatgatcccgaccaaaccccttctctttgccccactgattccgccaccccaagactcctatcctttccttgcctcactcaaaccccctcctcaactcacacccttctcatgaagcctattcctatgcatttcccaccttctttcccaaaaccaacgccctctggcctgactgtgatctccctgtagggcctaaagaccaccaggaaggcgaaaagaccccttcgagggagctcgagccaaaaagccggtgaaactaacacccctgcaggaaaacctaagaaagctagaggaccaatactgcgtggtcgtt

SEQ ID NO: 7190 - DNA, 333 bp, mus musculus; identical to SEQ ID NO: 7189

SEQ ID NO: 7191 - DNA, 1677 bp, mus musculus
ttgtcctaaggggatcacagtacctacttgtgagagggattgtgagaaataaagaaagaaatgcatgccaaatgcctggtgctgtcctggcacagaaggaagccctagcaaacatgagctctcattgttattaatataccaaagaccctataaattagacatgattatttctaaactacaattcatgaatccaaggcttggggaggtgaaacaactggccaaattagcagaaaaaaaggatttgaactcaagtcttcttattcacttattcaagtttagagcgtactccagtccccataccacaactggttaactagtgtatctgtttcctatgacttctgtaaccaattactacaaacttggtagcttaaaacaacataaatttattctctcacagttcttgaggccagaaatacaaaatcagtttcactgggctgaaattaaggtgtcagcaggacccaattcttccagaggctctacaggaaaatccattccttgcctcttcagcctctggtggctgcttaccttcctttgcttgtggctgcatcactcagatctctatctctgtggacacattgccttatccttttctgtgggtgtcaaatctccactgcttcacttttataaggctacatgcgattacatttagggcccacctggataatctagtgtaaattcaccatcctgagatctttaacttcatcacatctgcaaagtcctttttgaccatataaggtaacagagacacattacagggattaagacatggatatcttttgagagccagttattgagtctaccacagctagtatggaaaaacttgtctgggcgacctgcacctagcttggtttctaccccatgccagtttattcaaatgcaaatccatctctattctcctgctggcttagacaactggagccttgccagccaatctgctcccttagcctgcttttgcatgagcctagaacttcaaaagtctgattccagcttcatcctcaagatccacaattgcctttctgcttgggtctgacccttactggtttttcatgcctctccccaacgtatgacctgtacgcccagggaatgcccccaaaagtcaggttaattccatctcattcaacaagggttgatctacattctacagttagagaaggggatagtggtggaaggctctgatgcactcagattgactaggatgtgagtcaaggatttcagggcttacaaccctgggcatcttctctaggataatggtgctttgaggaagttctggagaaggctactgctccacggccggtgctggctgctctgtaggcccctgtataataattttactgatgcttattgaaatacacacatacacatacacacacacaacatacatgtatatatgcacacgtgtatatgtgtgtatatataatatatatacacacataggatgaagtattttgatgaaaagtataggatatatccgtaagtatatgcatatatcctatacttttcatcaaaatactttattggtatattctaattcacatgacaactcaaataataccactcagtggttctcatgcattcatttactgagaacctcctccatgccaggcccctttgcttggggttagggatacagaggtgaatctcctgtggtctacactcttacatggatcacagtttagg

SEQ ID NO: 7192 - DNA, 365 bp, mus musculus
gcaaggcagaataggcctgttgttccgaggaaaaaggtcagaagaaggtcatgggtgggtgaccttggagccatttggtcatatctcttttgcagctgggaggagtgaggaaggttaacagcaaaagctctaagaaaaaaaaaaacaaaaaaacctaaggtctccatttggcattagagtaaaaagagaaaaagaaactagcattttgaagggcaggcagtaccctgggaggattctctcttagactggggacttggaccctgggctcactgtgtgtgagcataaaagcagtgatgggctgaattatataccccgaaacttatatgttgaaatcctaactccaagtacatcagaatgtgactgta

SEQ ID NO: 7193 - DNA, 3665 bp, mus musculus
ctccccaccacactttttcactgtaatattttctgagattgaacaaaattagagaatggtgcactacaggggccagtccgccaagcctgtgtcctctctttgtgttcagtggctgagctctggctgcgggttcctgaagggctccccacatcctccactgtgtcgtggtttggattcagtcctgccccgcacccccagtctccacatgggtggccagggcatggttggttctgggtggtgaagaagacagatagaggcagcctgtacctccatggacagataactgtctgctgagacttttttcttttttatttatttattttttgagacggagtcttgctcgtcacccaggctggagtgcagtggcatgagcttggctcactgcaacccctgcctcccaggctcaagtgattctcctgctctggcctcccaagtagctgggattacaggtgtacagcaccatgcctggctaatttttgtatttttagtagagacgggatttcaccatgttggcctggctggtctcaaactcctgacctcaagtgatccgcccgcctcggcctcccaaagtgctgggattatgggtgtgcaccactgcgccaggcctgagatttttcttttgacttgaatactctcagagtttaactgcagtccatcaggagcgtgtacccagggcattgtttaatagcattgctctgtcagccaatgatacagaaatctgccttcctctccatcctcctgctccctcatccctctcacctagggtcttcatgatctctagatcgtctccacactccactagccatggggcagtctgaactgctcatgttccttttcagctgcctggccctggaacctcaaggatacgtcactatagtaccccggcctgccagctggaaagctccctcactggtggccttagctccatgctccatctgctgggtgcgccccgctgccccaggccgctgcttggccactcctcactggatcctttgccctctaccacagaccaggctagtcatcacttgcctcttctttcctagatggctttctattttgttccacaaagcttccactgcaaatgcttttctcctctggaccctctgagttggccctgccacccttacgacctcaggagtgttttccagaacactgtgatgggtgctcattcagcctagtacttgtacgctgggcctggggagttgggaaggagtcctggctgcaggggtgctcctgcatcctagggtgcccttagccacatctcccctgtacacgccctgcccctgcttgaagcagatcccccgtgtgaatgagccgccctttgtgtcttcacatgtatgaaaacaactagtgtttgatcacctctttcagctcttcccagagtcttccttggataggagagacttgcatctgtgtccctctcccactagccagggagctgctgggacttgtgctgccctggagcctttcccgttgagcgccctcttccctgctcacctagtgctctggcggccctatgttgattgcccaaactagcgtactttgagaaagagagtggaggcgctgctaataatcagtctgtagaattccccaagacactcgatactgcaccggcctgtttgcctgcctgctgcccctacacaccacaggctttgaaaccacagggccctcaggatctagcatggtgtttggcaactaacggagactcgacagatgtgactgaatgaacgcatgagtgaatgaagaggtgcgcccctctgctgcaggccagttccccctgcacatctgctctctccagccccttgaacctgcatttattccttctccctgtggtggctcttgcccctcagcctacagaggactcacacctgcccaccctaaacctgtcctgtccccactggcctctccctcaggtctcccctccacacccagtcctctgggatattgggacagctttctacctactctccccgcctcagtctgccttgtgtccacgctccaccttcctccagagaggccttttgctcctgcctaacagcccagacatcaccttctgtggctgcccgatggctccagctccccacgccctctgccacttggccaccacctgagctcctggcatcaacttagcttccttcttcctctttttaaaaaaatttacatttctggccgggcacagtaacttacgcctgtaatcctagcactttgggaggccgaggtgggcagatcacgaggcagaagtttgagaccagcctgaccaacatggcaaaaccctgtctctactaaaaatacaaaaattagccaggtgtggtggtgcacgcctataatcccagctactcaggaggccgaggcagaagaatcgcttgaacctgggaggcggaggttgtagtgagctgagatgagattgcaccactgcattccagcctgggcgacagagtgagactccgtctcaaaaaaaaaaaaaaaaattacatttatctctccctttagactttgtgctctgcaagacatgtccctgcttgttattaattgatctttaagttattaatctaataactgcttgtcactagattgaatccttccccagatgagaactgagtttgaaggcgagctgtctttgaaatggtccatgtgcccaggaactatgagtgagcgtgagaggttgctggtcccattagcatcttctttcctggctttcagcccaagaagtctatgtgcagggtgacctgctgccctgtcactggagtccaggtccagcactgtcctcctttctgacttcaggtgcattatttgagatgctaaacacaggggcccatcaagcacttctttccagtcagtggtcaacttgggaaccaaagcctacatcccccttccagcaccttcctcttcactgatgtgtatttctacttaggcatcttgctgagttattctgtcctgggtggcttctatttcatctattttggcaacagggaagatgggctacagagtgtcagaagtcactatgttactgaaatcacatagggttaccaggtgatattcttggtgactcaaaggcccgggtggttggtggagtgtcatgaacattagcagaaaatccaacagaaccatgcctgatctggagtgcctttggctaaacagagcctctcgattactgcaggagacccccgtacccctgccacgctcccccttgtgcagcaggttgcagaggtgaagaaatgctgaaccagcagagagggttagagtggtgtcccacaggggtgcacccaggctcagattcttgcccgccgcgtgaggcaggtaacagacctttcctaaaacctacaaactgcgcgacagatctgttcccagatgtggtcaggttctcactcatgtaggcgaagccacctgcaacatcatgatgatgatggaaaccacagcgacagcgcctataacctgcagtcctcttgtgtgccagtgggttctgtacacacatgatcccagttaacgctcccagcaattccacgacgtagagaatgagggaagggtcagagaagcagtgacttggttgaaatcttgctgcccagtgcgtgtagttgtggaaggatgcccccgacagggccagatcccgtctctggcagtgactcaccgcctgatctgcagcagggtcctgagcctcacggggacct

SEQ ID NO: 7194 - DNA, 516 bp, mus musculus
tgctgcgactacagccatgagtatgctcaggcttcagaagaggctcgcctctagtgtccttcgctgtggcaagaagaaggtgtggttggaccccaataagaccaatgaaatcgccaatgccaattcccatcagcagatctggaagctgatcaaagatgggctgatcatccgcaagcctgtgacggtccattcccgggctcgatgccagaaaaacaccttggcccactggaagggcaggcacataggcatagataagtgaaagggtacagccaatgcccgaatgccagagaaggtcacgtggatgaagagaatgaggattctgcacctgctgctcagaagatactgtgaatctaagaagattgatcgccacatgtatcacagcctgtacctgaaggtgcaggggaatgtgttcacaaacaagccgattctcatggaacacagccacaagctgaaggcagacaaggctcacaagaagctcctggctgaccaggctgaggcccgcaggcctaagaccaa

SEQ ID NO: 7195 - DNA, 1629 bp, mus musculus
agaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaggaaaagggaggacttggtagggttttgtttcttctgcttgtttctgtacagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttgacctggtagggtgttccctgctgtgttttccagtgtcctgtgactgtcctgtgcgggccatagggcagggccctgtcccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtct

SEQ ID NO: 7196 - DNA, 5071 bp, mus musculus
tttgaaccagaccatcgttcccctttcgatgggatgtggctcctgtggaaaagcaaggctggggggctgcccatcctgtttaccgccagccctttgaatggtggtgacaggattagcaagcttagcgtcaccaggcgtctgaggtccttgaggtctcctctgaaaatctggacctggacgcttcctttttctattggcaagccggagtgaagaaggcagcctgtgctgacgggacccagaggatgcagccatacctgcccagcctggcttccaggcaccctctccggggtcctgaatgttccccgagaagggagaactttccggggatgcagccagggccttcttcgggcggctgtcctgtgtctcttccttcagagcggggggtgcagggctggtgagacctggaggcagagatgcaccctcctccgttactgtgggaggcagggacataagagttgaggcgtttgcccttttcttcccctttttctcacaaacatgccgcgaaagcgtcagggaatcctggcaggctcgggggctttgcaacacatgtgcttgcattccaactggagtaggagcaatggccatgagcgcctgtgacctgtccctgcccagggcacctggagtaggatcaatggccatgcacgctggtgagctgtcactgcgcaggacacttggagtaggatcgatggccgtatgtgtctgtgacctgtcactgtgcagggcgcctggagtaggagcaatggccatgcgttctcctgagctgtcaccacacagggtgcctggagtctgagaaatggcttcgcgtttccatgacctggtaccatgcagggcccctggcataggtgcaatggctgtgtgaaatggtgagctgtcaccgcgcagagggcctggagtagaagcaatagccttgtgtgcctgagagccgacacggtgcagggcgcctagaataggagcaacggccctgctttctcttgagctgtcacagtgcagggcgcctgaagtaagagtaatgtcctggtgcgctggtgacctgtcagcatgcagggcgcctggagtaggagcaaaggcggtgcacgttcgtgagctgtcacagtgcagggtgcctggagtgggagcaatggccttgcgtttccatgacttgtcatcgcgcagggcgcctggagttggagcaatggtcgtgtgcacctgggagctgtcaccatgcagggctcctggagtagaagcaatggccgtgtgtgctggtgacctgtcaccatgcagggcacctggagaaggagcgatggccttgtgcgctgatgagctgccaccgcccaggtcacctggagtaggagcaatggccttgtgtgtctgagaggtgtcaccgtgcagggcgcctggagtagaagcaatggccgtgtttgctggcgaactgtcacctcgcggggtccctggagtaggggcaatggccgttgagctgtcatcacccagggcgcctggagtaggagcaatggccctgcatgctggtgacctgtcaatgcgcggggcacctggagtaggagcaatggccttgcgtttccgtgacctgtcagacctgttaccgagcagggcacctggagtagaagcaatggctttgcgtttccgtgacctgtcagacctgttaccacgcagggcacctggagtagaagcaatggccttgcgtttccatgacctgtcacctctcagggcccctgcagatggggcaatggccatgcgagctgttgagctgtcaccgcgcatggtgcctggagtaggagcaatggccgtgtgtgcctgagagctgtcaccgtgcagggcgcctggagtagaagcaatgtccaggtgtgctggtgacctgtcaccatgcagggcgcctggagaaggaataatggacgtgcgccctggtgagctgtcacggcccagggtgcctggagttggaacaatggccctgagtgctggtgacctctcaacgtgcagggtgcctggagtagaagcaatggccttgcatttccgtgacctgtcagacctgttaccatgcagggcacctggagtagaagcaatggccttgcgtttccatgacctgtcacctcgcagggcccctggagatggggcagtggccgtgcgcgctgttgagctgtcaccgcgcatcgtgcctggagtaggagcaatggccatgtgtgcgtgagaggcatcaccatgcagggtgcctggagtagaaggaaaggccatgtgcgctggtggcccgtcaccatgcagggcgcctggagagggaataatggacgtgtgggctggtgagctgtcaccgtgcagggcacctggagtaggagcaatggccatataagtccatgacccgtcaccgtgcagggcctctggagtaggagcaacgaccctgcgtttctgtgacctgccaccacgcagggcgccgggagtaatagcaatggccctgcatttccttgatttgccaccaagcagggcgcctggagtaggtgcaatgcccatacccacccatgacctgtccccgcacagtaaacatggagtaggggcaatgctcctgcgtgcgcgggacctttcactgcacaaggcgcctggagcaggggcagtggccttgctcacccctgacctgtcgccgggcagggctcctggagtagaaccagtggccgtgcattttcgtgacccgtcacagtgcagggtgcctggagtgggagcaacggccctgcgcaccggtgacctgtcacggtgcagggcacctgcaggaagggcaatgcctgtgcccacccgtgacccaaccctgaacagtgcggatggagtaggtgcaatggccctgcctgcctgtgacctgtccctgcgcagtgcacctggagtaggggcaacgcccatgcccacctgtgaccccttcccgcacagtgcgcatggagtaggggcaatggccctgcgcacccgggacctttcactgcacaaagtgcctggagtgggggcaatggccctgcttgcccctgacctgtcactgcacagagctcctggagtaggatcaatggctgtgagctctcgtgacctgtcacagcgcagggcgcctggagtaggagcaatggccctgcgcactggtggcctgtcacggcgcagggcatctgcaataggggcaatgcctatgcccacccgtgaccatatctcgcacaatgggcatgtagtagggacaatggccctgcgtgctcgtgaaccgtcaccgcgcaaagcacctggggcgggggcaaggctggtgtgcgcccgtgacttttcaccacgcagggtggctggagtagaggcaatggccctgcgggaccgtggcctgtaacctcgcagggcgcctggagtaggggcaatgtccgtgcgtgccgctgacctgttgccgcccagggcgcccagattaggtgcaatggcggtgcctgtcgttgacctgtaaccgcgccaggcacctgggttaggtgcaatggccctgcgcgcccatgacttgtaacctcgcagggcacctggagtaggggcaatggccttgcacgcagatgacgtgtttccccgcagggtccctggagtagaagcaatggcgctgcgggcccgtgacctgtccctgtgaagggcgcctggagtagggacaaaggccgtgcgcgctgctgacctgtctccacgcagggcacctggagcaggggcaatggccttggacacagatgacctgtttccctgcagggtccctggagtagaagcaatggcgctgcgtgcccgtgacctgtccctgccaagggcacctggagtacggacaatggccgtgcgtgctgctgacctgtctccgcgcagggcacctggagtaggggcaatggccctgcacacccatgacttgtaacctcgcagggcgcctggagtaggggtaatgtcctttggcacccgtgacctgacaccgcacaggacacctggagtaagggcaatggctccgcaagcccgtgacctgttgccgcacagggagcctggagtaggggcaatggctctgtgggcccgtgacctgccaccgcgcctggcgcctaaggtagggtcaatggccctgctcgcctgtgacctgtccccgcacagggagcctggtttgggggcaatggacctgcatgcccatgacctgccaccatgcttggtgcctcgagcaggggcaatggccctgtgcgcccgtgacctgtcactgtacaggcagcctggggtaggggcaatggccctgtgcgcccaagacctgtaacctcgcagggcgcttggtgtaggggcaatggccctgcgtgcccgtgacctgccactgagcatggctcctggagtaggggcaatggccctgggcgcccctgacctgtccccgggcagggcgcctggagtaggggcaatggctgtgggctcctgcgacctgtcatcccgcagggcacgcttactctctgaagggaccgtcggtgagcttgggttttccctcttcccaagactcctccttaggtcgcctttgcatctccagtcatcttcacgagggacagaactggctggcttttcgggcaccttttgagaaagctgagagggtgtggtgctctctagttcatgtggtttccttcctccacccagatttgttctctctttcagaatctccagggccacccgaagggttcctctgtaccccatcttctctctgagtggggcaccgagcttcgtctgtgctgctgcagaggcggcaatgtcttccatctcaaacttagttggggtcttcacgtctgtgcttttcaccttgattttttcatctactgcgaggatttgaacttctagagaaatcgccttttcaggcttcgtttttggtgaagtcccacgtgtgcacaaaacctttgctggccatagtcggcctttccaagagcataggacgtactccgagtccatgatgagctgggaaaaggtagctaagggaggccgaggggtctgcctgccacaccctctgctaccgtaggtctctcctaaaccaagctactcttcagagcatcctttgccttcagactgcaaagggggtgcagtgtgggtgggctgtgttcctcctcctgaatct

SEQ ID NO: 7197 - DNA, 4610 bp, mus musculus
aaccagaccatcgttcccctttcgatgggatgtggctcctgtggaaaagcaaggctggggggctgcccatcctgtttaccgccagccctttgaatggtggtgacaggattagcaagcttagcgtcaccaggcgtctgaggtccttgaggtctcctctgaaaatctggacctggacgcttcctttttctattggcaagccggagtgaagaaggcagcctgtgctgacgggacccagaggatgcagccatacctgcccagcctggcttccaggcaccctctccggggtcctgaatgttccccgagaagggagaactttccggggatgcagccagggccttcttcgggcggctgtcctgtgtctcttccttcagagcggggggtgcagggctggtgagacctggaggcagagatgcaccctcctccgttactgtgggaggcagggacataagagttgaggcgtttgcccttttcttcccctttttctcacaaacatgccgcgaaagcgtcagggaatcctggcaggctcgggggctttgcaacacatgtgcttgcattccaactggagtaggagcaatggccatgagcgcctgtgacctgtccctgcccagggcacctggagtaggatcaatggccatgcacgctggtgagctgtcactgcgcaggacacttggagtaggatcgatggccgtatgtgtctgtgacctgtcactgtgcagggcgcctggagtaggagcaatggccatgcgttctcctgagctgtcaccacacagggtgcctggagtctgagaaatggcttcgcgtttccatgacctggtaccatgcagggcccctggcataggtgcaatggctgtgtgaaatggtgagctgtcaccgcgcagagggcctggagtagaagcaatagccttgtgtgcctgagagccgacacggtgcagggcgcctagaataggagcaacggccctgctttctcttgagctgtcacagtgcagggcgcctgaagtaagagtaatgtcctggtgcgctggtgacctgtcagcatgcagggcgcctggagtaggagcaaaggcggtgcacgttcgtgagctgtcacagtgcagggtgcctggagtgggagcaatggccttgcgtttccatgacttgtcatcgcgcagggcgcctggagttggagcaatggtcgtgtgcacctgggagctgtcaccatgcagggctcctggagtagaagcaatggccgtgtgtgctggtgacctgtcaccatgcagggcacctggagaaggagcgatggccttgtgcgctgatgagctgccaccgcccaggtcacctggagtaggagcaatggccttgtgtgtctgagaggtgtcaccgtgcagggcgcctggagtagaagcaatggccgtgtttgctggcgaactgtcacctcgcggggtccctggagtaggggcaatggccgttgagctgtcatcacccagggcgcctggagtaggagcaatggccctgcatgctggtgacctgtcaatgcgcggggcacctggagtaggagcaatggccttgcgtttccgtgacctgtcagacctgttaccgagcagggcacctggagtagaagcaatggctttgcgtttccgtgacctgtcagacctgttaccacgcagggcacctggagtagaagcaatggccttgcgtttccatgacctgtcacctctcagggcccctgcagatggggcaatggccatgcgagctgttgagctgtcaccgcgcatggtgcctggagtaggagcaatggccgtgtgtgcctgagagctgtcaccgtgcagggcgcctggagtagaagcaatgtccaggtgtgctggtgacctgtcaccatgcagggcgcctggagaaggaataatggacgtgcgccctggtgagctgtcacggcccagggtgcctggagttggaacaatggccctgagtgctggtgacctctcaacgtgcagggtgcctggagtagaagcaatggccttgcatttccgtgacctgtcagacctgttaccatgcagggcacctggagtagaagcaatggccttgcgtttccatgacctgtcacctcgcagggcccctggagatggggcagtggccgtgcgcgctgttgagctgtcaccgcgcatcgtgcctggagtaggagcaatggccatgtgtgcgtgagaggcatcaccatgcagggtgcctggagtagaaggaaaggccatgtgcgctggtggcccgtcaccatgcagggcgcctggagagggaataatggacgtgtgggctggtgagctgtcaccgtgcagggcacctggagtaggagcaatggccatataagtccatgacccgtcaccgtgcagggcctctggagtaggagcaacgaccctgcgtttctgtgacctgccaccacgcagggcgccgggagtaatagcaatggccctgcatttccttgatttgccaccaagcagggcgcctggagtaggtgcaatgcccatacccacccatgacctgtccccgcacagtaaacatggagtaggggcaatgctcctgcgtgcgcgggacctttcactgcacaaggcgcctggagcaggggcagtggccttgctcacccctgacctgtcgccgggcagggctcctggagtagaaccagtggccgtgcattttcgtgacccgtcacagtgcagggtgcctggagtgggagcaacggccctgcgcaccggtgacctgtcacggtgcagggcacctgcaggaagggcaatgcctgtgcccacccgtgacccaaccctgaacagtgcggatggagtaggtgcaatggccctgcctgcctgtgacctgtccctgcgcagtgcacctggagtaggggcaacgcccatgcccacctgtgaccccttcccgcacagtgcgcatggagtaggggcaatggccctgcgcacccgggacctttcactgcacaaagtgcctggagtgggggcaatggccctgcttgcccctgacctgtcactgcacagagctcctggagtaggatcaatggctgtgagctctcgtgacctgtcacagcgcagggcgcctggagtaggagcaatggccctgcgcactggtggcctgtcacggcgcagggcatctgcaataggggcaatgcctatgcccacccgtgaccatatctcgcacaatgggcatgtagtagggacaatggccctgcgtgctcgtgaaccgtcaccgcgcaaagcacctggggcgggggcaaggctggtgtgcgcccgtgacttttcaccacgcagggtggctggagtagaggcaatggccctgcgggaccgtggcctgtaacctcgcagggcgcctggagtaggggcaatgtccgtgcgtgccgctgacctgttgccgcccagggcgcccagattaggtgcaatggcggtgcctgtcgttgacctgtaaccgcgccaggcacctgggttaggtgcaatggccctgcgcgcccatgacttgtaacctcgcagggcacctggagtaggggcaatggccttgcacgcagatgacgtgtttccccgcagggtccctggagtagaagcaatggcgctgcgggcccgtgacctgtccctgtgaagggcgcctggagtagggacaaaggccgtgcgcgctgctgacctgtctccacgcagggcacctggagcaggggcaatggccttggacacagatgacctgtttccctgcagggtccctggagtagaagcaatggcgctgcgtgcccgtgacctgtccctgccaagggcacctggagtacggacaatggccgtgcgtgctgctgacctgtctccgcgcagggcacctggagtaggggcaatggccctgcacacccatgacttgtaacctcgcagggcgcctggagtaggggtaatgtcctttggcacccgtgacctgacaccgcacaggacacctggagtaagggcaatggctccgcaagcccgtgacctgttgccgcacagggagcctggagtaggggcaatggctctgtgggcccgtgacctgccaccgcgcctggcgcctaaggtagggtcaatggccctgctcgcctgtgacctgtccccgcacagggagcctggtttgggggcaatggacctgcatgcccatgacctgccaccatgcttggtgcctcgagcaggggcaatggccctgtgcgcccgtgacctgtcactgtacaggcagcctggggtaggggcaatggccctgtgcgcccaagacctgtaacctcgcagggcgcttggtgtaggggcaatggccctgcgtgcccgtgacctgccactgagcatggctcctggagtaggggcaatggccctgggcgcccctgacctgtccccgggcagggcgcctggagtaggggcaatggctgtgggctcctgcgacctgtcatcccgcagggcacgcttactctctgaagggaccgtcggtgagcttgggttttccctcttcccaagactcctccttaggtcgcctttgcatctccagtcatcttcacgagggacagaactggctggcttttcgggcaccttttgagaaagctgagagggtgtggtgctctctagttcatgtggtttccttcctccacccagatttgttctctc

SEQ ID NO: 7198 - DNA, 4845 bp, mus musculus
aaagcaaggctggggggctgcccatcctgtttaccgccagccctttgaatggtggtgacaggattagcaagcttagcgtcaccaggcgtctgaggtccttgaggtctcctctgaaaatctggacctggacgcttcctttttctattggcaagccggagtgaagaaggcagcctgtgctgacgggacccagaggatgcagccatacctgcccagcctggcttccaggcaccctctccggggtcctgaatgttccccgagaagggagaactttccggggatgcagccagggccttcttcgggcggctgtcctgtgtctcttccttcagagcggggggtgcagggctggtgagacctggaggcagagatgcaccctcctccgttactgtgggaggcagggacataagagttgaggcgtttgcccttttcttcccctttttctcacaaacatgccgcgaaagcgtcagggaatcctggcaggctcgggggctttgcaacacatgtgcttgcattccaactggagtaggagcaatggccatgagcgcctgtgacctgtccctgcccagggcacctggagtaggatcaatggccatgcacgctggtgagctgtcactgcgcaggacacttggagtaggatcgatggccgtatgtgtctgtgacctgtcactgtgcagggcgcctggagtaggagcaatggccatgcgttctcctgagctgtcaccacacagggtgcctggagtctgagaaatggcttcgcgtttccatgacctggtaccatgcagggcccctggcataggtgcaatggctgtgtgaaatggtgagctgtcaccgcgcagagggcctggagtagaagcaatagccttgtgtgcctgagagccgacacggtgcagggcgcctagaataggagcaacggccctgctttctcttgagctgtcacagtgcagggcgcctgaagtaagagtaatgtcctggtgcgctggtgacctgtcagcatgcagggcgcctggagtaggagcaaaggcggtgcacgttcgtgagctgtcacagtgcagggtgcctggagtgggagcaatggccttgcgtttccatgacttgtcatcgcgcagggcgcctggagttggagcaatggtcgtgtgcacctgggagctgtcaccatgcagggctcctggagtagaagcaatggccgtgtgtgctggtgacctgtcaccatgcagggcacctggagaaggagcgatggccttgtgcgctgatgagctgccaccgcccaggtcacctggagtaggagcaatggccttgtgtgtctgagaggtgtcaccgtgcagggcgcctggagtagaagcaatggccgtgtttgctggcgaactgtcacctcgcggggtccctggagtaggggcaatggccgttgagctgtcatcacccagggcgcctggagtaggagcaatggccctgcatgctggtgacctgtcaatgcgcggggcacctggagtaggagcaatggccttgcgtttccgtgacctgtcagacctgttaccgagcagggcacctggagtagaagcaatggctttgcgtttccgtgacctgtcagacctgttaccacgcagggcacctggagtagaagcaatggccttgcgtttccatgacctgtcacctctcagggcccctgcagatggggcaatggccatgcgagctgttgagctgtcaccgcgcatggtgcctggagtaggagcaatggccgtgtgtgcctgagagctgtcaccgtgcagggcgcctggagtagaagcaatgtccaggtgtgctggtgacctgtcaccatgcagggcgcctggagaaggaataatggacgtgcgccctggtgagctgtcacggcccagggtgcctggagttggaacaatggccctgagtgctggtgacctctcaacgtgcagggtgcctggagtagaagcaatggccttgcatttccgtgacctgtcagacctgttaccatgcagggcacctggagtagaagcaatggccttgcgtttccatgacctgtcacctcgcagggcccctggagatggggcagtggccgtgcgcgctgttgagctgtcaccgcgcatcgtgcctggagtaggagcaatggccatgtgtgcgtgagaggcatcaccatgcagggtgcctggagtagaaggaaaggccatgtgcgctggtggcccgtcaccatgcagggcgcctggagagggaataatggacgtgtgggctggtgagctgtcaccgtgcagggcacctggagtaggagcaatggccatataagtccatgacccgtcaccgtgcagggcctctggagtaggagcaacgaccctgcgtttctgtgacctgccaccacgcagggcgccgggagtaatagcaatggccctgcatttccttgatttgccaccaagcagggcgcctggagtaggtgcaatgcccatacccacccatgacctgtccccgcacagtaaacatggagtaggggcaatgctcctgcgtgcgcgggacctttcactgcacaaggcgcctggagcaggggcagtggccttgctcacccctgacctgtcgccgggcagggctcctggagtagaaccagtggccgtgcattttcgtgacccgtcacagtgcagggtgcctggagtgggagcaacggccctgcgcaccggtgacctgtcacggtgcagggcacctgcaggaagggcaatgcctgtgcccacccgtgacccaaccctgaacagtgcggatggagtaggtgcaatggccctgcctgcctgtgacctgtccctgcgcagtgcacctggagtaggggcaacgcccatgcccacctgtgaccccttcccgcacagtgcgcatggagtaggggcaatggccctgcgcacccgggacctttcactgcacaaagtgcctggagtgggggcaatggccctgcttgcccctgacctgtcactgcacagagctcctggagtaggatcaatggctgtgagctctcgtgacctgtcacagcgcagggcgcctggagtaggagcaatggccctgcgcactggtggcctgtcacggcgcagggcatctgcaataggggcaatgcctatgcccacccgtgaccatatctcgcacaatgggcatgtagtagggacaatggccctgcgtgctcgtgaaccgtcaccgcgcaaagcacctggggcgggggcaaggctggtgtgcgcccgtgacttttcaccacgcagggtggctggagtagaggcaatggccctgcgggaccgtggcctgtaacctcgcagggcgcctggagtaggggcaatgtccgtgcgtgccgctgacctgttgccgcccagggcgcccagattaggtgcaatggcggtgcctgtcgttgacctgtaaccgcgccaggcacctgggttaggtgcaatggccctgcgcgcccatgacttgtaacctcgcagggcacctggagtaggggcaatggccttgcacgcagatgacgtgtttccccgcagggtccctggagtagaagcaatggcgctgcgggcccgtgacctgtccctgtgaagggcgcctggagtagggacaaaggccgtgcgcgctgctgacctgtctccacgcagggcacctggagcaggggcaatggccttggacacagatgacctgtttccctgcagggtccctggagtagaagcaatggcgctgcgtgcccgtgacctgtccctgccaagggcacctggagtacggacaatggccgtgcgtgctgctgacctgtctccgcgcagggcacctggagtaggggcaatggccctgcacacccatgacttgtaacctcgcagggcgcctggagtaggggtaatgtcctttggcacccgtgacctgacaccgcacaggacacctggagtaagggcaatggctccgcaagcccgtgacctgttgccgcacagggagcctggagtaggggcaatggctctgtgggcccgtgacctgccaccgcgcctggcgcctaaggtagggtcaatggccctgctcgcctgtgacctgtccccgcacagggagcctggtttgggggcaatggacctgcatgcccatgacctgccaccatgcttggtgcctcgagcaggggcaatggccctgtgcgcccgtgacctgtcactgtacaggcagcctggggtaggggcaatggccctgtgcgcccaagacctgtaacctcgcagggcgcttggtgtaggggcaatggccctgcgtgcccgtgacctgccactgagcatggctcctggagtaggggcaatggccctgggcgcccctgacctgtccccgggcagggcgcctggagtaggggcaatggctgtgggctcctgcgacctgtcatcccgcagggcacgcttactctctgaagggaccgtcggtgagcttgggttttccctcttcccaagactcctccttaggtcgcctttgcatctccagtcatcttcacgagggacagaactggctggcttttcgggcaccttttgagaaagctgagagggtgtggtgctctctagttcatgtggtttccttcctccacccagatttgttctctctttcagaatctccagggccacccgaagggttcctctgtaccccatcttctctctgagtggggcaccgagcttcgtctgtgctgctgcagaggcggcaatgtcttccatctcaaacttagttggggtcttcacgtctgtgcttttcaccttgattttttcatctactgcgaggatttgaacttctagagaaatcgccttttcaggcttcgtttttggtgaagtcccacgtgtgcacaaaacctttgctggccatagtcggcctttccaagagcataggacg

SEQ ID NO: 7199 - DNA, 1322 bp, mus musculus
cctgctagttccaaactttatttaatgaaatgtcccatattatagaaacgtgcaccgaagatgcaactcttttgtcaatccttcacttcccaccttccacatcgaaatactctgctagcctgttgttgttttctatagccattgtacaatatttggtactgtgcaacattgggtatcatagctcacttacatattttagctcatgcattgtggacttcaaattacaggtttcataggccaataattattttcttaataaatgcatgtatgtgtgtctttgttcacgggcactggtagatgtaatatgaaatgtataatgatgatgagatatacatactttagggaaaagttgtacaaaacctttcttagacgagggtatatgaacgtacaggtttaatgccctcttctttagagaactcagagtactgggttgtcaagcacaagtgtcaactgaggaccccgaacaaaagtgagaaggaatcaccaatgaccctggcacttcaatctccccttaactggacctgccagcccatgtcacaaaacaggtgtgactgggcaccctcaagcccaagtcaatgcctacccacatccccaaatgcagagtctctcctctcttcctctctctctttctctctctctctctccacacacacacacacacacacacacacacacacacacacacacacacacgttggaaactcaaggagcctggcattgatgcatagaatccatgctcactgcctctacacattcctgcaaatgtttctgcttccagtacaaatgctgttttcttctccatttagtttcttattttaaacatagacagggaaacatctaaagggatgtctaaaatttctaaataggaaatatagtaagcatcagcaatcccatcacccagaaatgcttattgcaagtatatgagtccacacactccagaatttttgtcctgtttatacatgtatatttctacaagatatttaaaagcttaaagtttgcacagccatttgaatattcttcagtattggcatctggcaacatctttacaggtgtgaaacagtttaagggactgcctcctacagaccaccaaaatatccattgcagctaagttcggatggccaaagccatgcctccttaagagagatcatcagaagggaagtgtgtgaaatcaaaatatgaaatgttctctcaccacatgcgttggcccatcgcccaaataccttctatcaagggtttgcatatagtcttgctggtgactttctccccatattttgtactaagggaaacacaattgttttccctccctctagagagagagagag

SEQ ID NO: 7200 - DNA, 1290 bp, mus musculus
tcccatattatagaaacgtgcaccgaagatgcaactcttttgtcaatccttcacttcccaccttccacatcgaaatactctgctagcctgttgttgttttctatagccattgtacaatatttggtactgtgcaacattgggtatcatagctcacttacatattttagctcatgcattgtggacttcaaattacaggtttcataggccaataattattttcttaataaatgcatgtatgtgtgtctttgttcacgggcactggtagatgtaatatgaaatgtataatgatgatgagatatacatactttagggaaaagttgtacaaaacctttcttagacgagggtatatgaacgtacaggtttaatgccctcttctttagagaactcagagtactgggttgtcaagcacaagtgtcaactgaggaccccgaacaaaagtgagaaggaatcaccaatgaccctggcacttcaatctccccttaactggacctgccagcccatgtcacaaaacaggtgtgactgggcaccctcaagcccaagtcaatgcctacccacatccccaaatgcagagtctctcctctcttcctctctctctttctctctctctctctccacacacacacacacacacacacacacacacacacacacacacacacacgttggaaactcaaggagcctggcattgatgcatagaatccatgctcactgcctctacacattcctgcaaatgtttctgcttccagtacaaatgctgttttcttctccatttagtttcttattttaaacatagacagggaaacatctaaagggatgtctaaaatttctaaataggaaatatagtaagcatcagcaatcccatcacccagaaatgcttattgcaagtatatgagtccacacactccagaatttttgtcctgtttatacatgtatatttctacaagatatttaaaagcttaaagtttgcacagccatttgaatattcttcagtattggcatctggcaacatctttacaggtgtgaaacagtttaagggactgcctcctacagaccaccaaaatatccattgcagctaagttcggatggccaaagccatgcctccttaagagagatcatcagaagggaagtgtgtgaaatcaaaatatgaaatgttctctcaccacatgcgttggcccatcgcccaaataccttctatcaagggtttgcatatagtcttgctggtgactttctccccatattttgtactaagggaaacacaattgttttccctccctctagagagagagagag

SEQ ID NO: 7201 - DNA, 247 bp, mus musculus
atgaagacgtcagttctgtttcaaaagggcatgcattcaagagttggggaggggaacaggataaatcacttgattggcttaatttcctatctgtgtttgtgtttccaggttgacattaggagtgcataggtcctgagcatctacacgcggtgccactgggtcgccagaagaacagcgcacttcaggggcacagagtggggttgaagggtctgcacaccagcgcttgcagtgtgagcagcaagagatc

SEQ ID NO: 7202 - DNA, 673 bp, mus musculus
ggtgcagcgccaaggctggacccaggcttttgttacatttgtccctcctgcttcacccacagctcctgcctcacctgcagctcctgcctcacccacagctcctgcctcacctgctgctcctgcctcacccacagctcctgcctcacctgctgctcctgcctcacctgctgctcttccctcacctgcgcctcctgcctcacctgctgctcctgcctcacctgcgcctcctgcctcacctgctgctcctgcctcacctacacctcctgcctcacctgcgcctcctgcctcacctgctgctcctgcctcacctacacctcctgcctcacctgcgcctcctgcctcacctgctgctcctccctcacctgctgctcctgcctcacctgcgcctcctgcctcacctgctgctcctgcctcacctacacctcctgcctcacctgcgcctcctgcctcacctgctgctcctgcctcacctgttgctcctgcctcacctgtgcctcctgcctcacctgctgctcctacctcacctacacctcctgcctcacctgcgcctcctccctcacctgcagcttttgctactgcttgaccctggggctgtgcaggaaaactgggcatatcctgaaactcaataacaggtacttggggcaggaagatcactttccagggccccccattg

SEQ ID NO: 7203 - DNA, 423 bp, mus musculus
tgccagttgggaggacgggaggtccccctgaggctgcgacttgtccgctcagcccactgtgtgcccaggattctgaacctctggggcactccctcctgtcccgagtcacccagggtctcctgccccctccctgtgtctgctccatcacatcccctctcaagccccatgcctggcagggccaccgccctagggctgggctaggtgaaccaagggcaccggtcccccaaacctgccgatcgtccccaggctgcagggagggacacatgtggggcggcaagggcagaagataaactagggggatccgggcccctgaggacagccctggcgggaggccacaggcctcacagggtggtgagctggaggccacccaggcaggcaggcaggcagcagggaaagagactggcacggtcctggccagggccc

SEQ ID NO: 7204 - DNA, 176 bp, mus musculus
aaatgagtagattctcacgggcaaagacgagaggatggataaacaaggatttgccaaggagaagaggccaatgtcatattttctccctcagtgtgtccggatgggattggaaagtctccctggcccacataggtaagaattctgttgctcatcttctgcacaccccacctctattc

SEQ ID NO: 7205 - DNA, 1188 bp, mus musculus
tggctcttttctcaaagttaaatgtgctgtgcacccccattgaacatgggaagaattaggattgcccagagtcaaaccttcctcattctgtcaaggatggagatgagaggagccagtcttccttcctgcttcccacatgtgtactgcaggctgaaatgttcctgtcaccaaagcttgcctgggtatgcaaaggtaatagtcaactcacttactcaagggaggactggtggagaaacaggcttccatggttgcagaagaaattctgagaagcctttgataatttatctagtccttcattcataaatataagcaaacaaccaaggatcaccagataagaagaaaacactagtacctgccccctaaaatggcaagaatgaggaaataatacaaaatattaaaggaacagaaaagattttaaatggtttccaattagtatcctgagagaaatttaagaaagtaattcttctataaaataagagcagactatcactaaaaaggaatttaaaagttctaaaataattctggaaagattttaaaatgtgaaagttcatatttaaaaaatgtttaacttaccatgattgatttttctgatacttgttgtaattaaaggctttttctgaagcagttttaaatttacataaatactgagcaatagtatagagtgttttaatataaaccttcatcccaataacagaaagcatatttgaaaaaacctagtttacctggagattaaaaacatgcttctgacagagcgcgttggcttacgcctgtaatcccagcattttgggaggccgaggcgggtggatcacgaggtcaggagatcgagaccatcctggctatggtgaaaccccatctccactaaaaaaaaaaatacaaaaaattagctgggcgtggtggcgggcgcctatagtcccagctactcgggaggctgaggcaggagaatggcgtgaacccaggaggcagagcttgcagtgagcggagatcgtgccactgcactccagcctgggcgacagagtgagaatctgtctcaaaaaaaaaaaaaaaaaaaaaaaaaaaaagtcttctatataacacatactctgcagttgttatccatcttatctataggtgaaagaagtctctcaagaactaataaaataaagacacgactgctctcaatttgtgggatgcagttaaagcagtactcgg

SEQ ID NO: 7206 - DNA, 239 bp, mus musculus
gctgccagctgagggccccagctgagcacccaggccatggaagaaagctgccttgcccaagctcatgtcccctcccggcgcagtccacgcctgatgtcggcttgatgtggagaacgtgacccaggctctgtctgaattcaggacatcccaggaggcatctccacgcatcggagctcccgtggcctaggctggagcctcctcggaggcctctgtgccactccctcccagggtgggttatc

SEQ ID NO: 7207 - DNA, 5381 bp, mus musculus
ggagccactggaggccacaaggaaagggagaccttatcttaagcaattaatcaagaaactcatattttgggacaattattcagagttaattctaaaatagctttagagccccaggtcttgagatatttttttccagaattttgtcaaggtcatttagagcactaggataatcttacattagaataaagatttggttaaaggtatatatattagtctctacctagaaatatgggcagcatgaaaacatagcatcggactacataactgtagttgtaattttttactctattttcattttttttggtagtaaactgcacaaaataggataaggctttgtcccagagatgggcagcctttcccgatgcacagtctgaagtgcactggcctctggcacccgtggcattagaggactggattgcagtttttggagttaggtcagtttgtctcaccttatgaaatgtgaacagagggatgctaatcctgtttgcctagtgagtttttgtttgtgtgccatttcacagaataactgatttcctattgggtgtggttgttttaaatctgaccagtcatcttatttacttattactgtggcattttttcccattagtggattaaaaaaactgttattttccaggtcttttgtttgtttgacttacctaatttatcttgtttacctgcatagtgagcattttaagacctttcctcagctttctctacctgccttccttggtatcttcccttcttctagttaagtggattccctttggccgcagacactctctagatgccgcagggaggccaggcctgccctcgcactgcagccccctacctcctcccacccctacagtaactacccacccggctacatcctgagaaggctgtcccagcagcaagggtgtgcccttgctcctctgcccctgaaatgcttgttcatgacatcatcacacagctggtcttcctcctgaatcagctctcagctgaaacatctcttctccatctttagacagtgactgtcctgtctaaagtcgccctttttctctccacacacattatcccattttactgtctccctagcacttactgtgaattttccttttgtatttgttgttgcctatctgccctgctagtaaaatctatgaatagagaaaccttgtcttttgtttgttaacctccgcattgccaggcggacacagatcttaacaaatatttgttgaatgaatggatggatgagattgccttgaccttgttatgcacacctgaccctgactgtcctcctgccttggcctcctctgtggggctgaagccaccctctcgggtcatccataacgtcactgcatcctctacacagctgctagagtcatctttctcgaaactagatcaaactattttaaaactaccggtgacttcctatacccttcaaataaaattcacactctttcccatgatccatgaagctctcttgacctacccaacccacctcctttcctcttgccttcacctgctccttcccatgcctcagacacaaaactcgttacgcagtatggctgtccacatgctgtccctgcacctggagtactttccctggcttgtctctgactggctgttttggttattcccatctcagtttcattaatcagtattcacatagttgcttcattctatttaagaaggtggtgggccaggcaccatggctcatgcctgtaatcccagcacattgggaggccgaggcaggcagattatttgagctcagaagtttgagaccagcctgggcgacgtggccaaacctcgtctgtatgaaaatacaaaaattatccaggcgtagtagcacatgtccttggtcccagctacttggaatgctgaggtgggaggatcacttggacccaggaggtggaggctgcagtgagccatgattgtgccactgcactccatcctgggtgacagagtaagaccctggtctcaaacgaaaaaaaaagaaggaaagtggcactctacatcactaccaccttcccagttgttattttccattcctttatcctgtttatttcaaagcatgtatcacaatgattataacaactttttttgtatatttgatgcttttctaatattggacacaatggaatacttaccctactcgttaaaacttttctttttttaaaaaaataattatttgtttgtttttggaggcggattctcgctacactgcccaggctggtctggaactcctggccttaagagatcctctcacctcagcctcccaaagtgctggcattacaggcatgagccacctcgcctggccacaacttttctttcttatacttgcttatactttctcttcattgttgttgttttaatcttttctgattttcctccaactcattggctgtcccatctccttctccggcccctcttctgctgttattgaaatgtcggcagccctagaatcctgcccttggttctctgctctgctgtgcaatctgcaggtcacctttcctgcatgcacggcccctccagcccccaccgcaggccggatagtgcggttaagagctttccatcagcagctgtgagggccttctctgggttaggcgctgtttagactctgggaatagtctaaaaggtgtagttccttccagcatgaagcttattgcattttggtgagggagacaaaaaatagctaagcaaacattctgtggtgttaggtaagggagtgcagtggcaatgaggccaggtaagaaagctactgggaggcgagttgattgcaatgtgcagtgatcagagacggcttcactgaggggtgacattagagagccaaataatacgagagaagcagccgtgagccgacctggaggaacagcactggggctgctgcgagagcgttggggagaagcttggtgagtttgagaagcatcgaagatgccagcatggcttgatgaaggcagctaagaaggaggatggggccagaccttccaagacctcagaggccatggcaaggagctggggctttattccagtggtgacaggaagcactggaggcttttgagcagggaaatgatctgatttgggattcggagttggagagtcaattccagcctcatccatcacatggctttatgtgaagaagcagcggtcatatttagcattttcttagccaacagtctaactgaaatcacccatgtacagacaggaaatgacgttcacaattctatgttgacgcactataacttcctgacataccttttattaaagaaagtttaaattgtctcaagtggttttattgttaaatatagtactttatgactctgattttttttttttttggagacagggtctcactctgttgccccggctggaacgcagtggtacgaacatagttcactgcgacctcgaactcttaggttcaagcaatcctctggccccagcctcccgagtagctgggtccacaggtgggcaccactgggccctactaattttttttttcttttcttttctttctttcttttttttttttttagagacaagatctttcttgttgcccaggctggtcttgaactcccagcttcaagcagtcctcctgcctcagcctcttaaagtgttgggattacaggcatgaaccagtgcgcccagccttcgtctgattttaagaatgtttattctgtatatgatggatgtgataactttctattattactcatagatggatgaactgttctgctgctctccctggttcctcatccaggccaggaaagagttgattgtaatttcatagcatttttctcataataatctttaaatcctgaattgcttgttttgtggcttttgcatatggatggtctcctagtgtgttgggtgttttgactcaccaaattttgagagactagcagcagattttacaggctgcctcctaaataggaagatgtttggagttgttggaatgagacagggatagatacataacaaccaaaagcttaaatactgatctttttccctatcaaatttatcactgggtactgaactaatgtttatcttaccagttcaaacttgagtcaccctaaatttgtttttctttcgaatcttgcttcctaacagtcattgtgtcattatactgagctttctttattaaatggttttgttaaaatctccaggattatacatgcatagttggggaaaagagggaaaaaagcaagtgtaggaacagcttcctcagagggactgacgcgcagaggtgctgggcgggtggggagcaagagctgtgcccggctgctgccgccgctgctgacagccgctctcgggtcaacagtgtcaggatgatttcccattacttttttatcgactgctcttgatgatcctgtgaagtaagtgggctcagcattattgtgtgagtgtctgtgcgtgcacagatgaagaaccttgtgctcaccatcacagagaaagaggaaggggctggttctgtaaatcagagtccacttgccctttgctgtttccactgtaacgaaatgctgccttaataataaagcacagccggaaataaagagtgggctgcttagcactgtccccaggacagaggccatgtggcaggcaagtcagcctcttcgacaggattgtgtaccaggcctactcatggatgcctgggtgtcttatatataagtggacacaagaagggagagaatggagcacttagggcaacagccaagcaggcccccacctgtcctagcctttccctttgcatcgcattatgtaagtcctcccttctttgacacttggattttagaatgtccactttcatgttgctttaataactagaacaatgtcttcattttacatagaaggaacacagtaagaatttaatagtaacttgaaacaactgtaaaattccgttgatcctgagatatcagttgtaagacacaccattcatttatgtaccactaaggtaaaaacaaacaaacaaaaccaaaacattgccaattagactgtgaagcaattctttcttctataaaacatttttttaactgcatagaccaaatacttcaaatttcttaaatggtttgttgactgaaacatagaagggttgcagtggccagtcattctaccaggagtaacagtcaagttcacccatcggcaggcagtgactgcgcatcaccactgcctgtccaataaagataggaagatactactggttagaaaagatggcccaatttcagagatgcacatttttgttttcacattttaataaattagagtcaatgatacatggtgaaatcgtttctctcatttttctaataatagcactgctggagaaagtacttattattagcctgtaatggtggtttagcagcagaaggcagatgtggttcccgtatcagtgaagctttgttggggaaacagac

SEQ ID NO: 7208 - DNA, 159 bp, mus musculus
ctactacatttaccaagaagagcgttttgtagcaagacatctaatatccctgcaattgtttttgcgcttatactgatataattcacaaagttcatcatcatatcattgattcattgctctgaattcctcaaataacatggtactatcaatataatgaat

SEQ ID NO: 7209 - DNA, 358 bp, mus musculus
tatgtatgtacttatagtacttacgtttttcactagctgtttatataactgctttttcactttgggatatttttcacggtgtaggttgtgattttatctgtttgcttttccctttttgggtacaatgggttatttagcatcattttcaaaaaatcagttgaggttgctcatttaaacagccttttctagttgcagtatttgttcaacttgttctctataatagctcttcctgtaaagcaaagaaaggaaataatttggggtttgggtataggaaagggaatcttgtgatatgaatgggtatggaacaaaccaagtgaaatttaaatatattagatgggtttccccagagactcttgct

SEQ ID NO: 7210 - DNA, 968 bp, mus musculus
gaaattgcttgcccttggcttcctctcttccttcctccctgtggactggaacttgaaagtgatagtacacataaccttcaaaccaggcaaagaccacagcctagagaatgccatagcaaggagagagaaggaacctggcttcctgttcatccctggaatgtcacatgagaaagaaacaagaccttatctcatttgagccactgtattttgaggcctcttcatcacagcagcttagcctgaacactaactgataaaccagagatccccaggactgtagatggcatttgccatggagaaggagctagaagtccagaggtttaaatcctcacctttctccattgctaacgtcctttgtaattttggacaagtcactgaccctctcaacctcagttttctgccctgaaaatgaggacaataagttgtcttggctcacagagcagctgtgagccttacataaaacaatcactgtgaaggctcgttgaaaaatatagaaatgttacaaaggcagagttaacagtcaccgggaacttagcgcactaagatcacagggtggatttctatgaaatctttgttctctgccccagagctttgtgttcctgactttgagccaagggcaaagggctgctcaggagaaactgcccaaaaatgcaaaccagcagacgggtcttctgtctgtccctcagttccactttaggggaaatcattctgaagttagggcgtttaagtccccttccccatctgtctcaaaacactcgccagagaccagagaaccttggagctactcagctaagtgcatgctgggtaaatctctcacaaaatcactgctcccctctatgccactgtgggccacttttcccaagggagtggcgcagtgcaggcacctccatgtaggatttactgtcactctgccttggcttcaaaccccactcccactggctctgtgctctgggaaggtcacgtatgttcac

SEQ ID NO: 7211 - DNA, 3208 bp, mus musculus
tgctcttttgctcacaagacaccctgttcctgattacataccaaaattgtcatcatggtttgccagaaatctataatgatgtcgtatcgtttgaaaagtgtctcaatatgtttttacagctttagagaatttctcctgcctgctcaacttacagttgccattctacaaccatccatttggccatctcttagacgccatgccatttatttattttttgttaagtctcatcaagcagagttgtaataaaaaatattataagatactaaaaaaatgaagtagaatttcacggcatttttgtctctgttttagaggcataaaactcttgcctctgtatatgtgacctttgaattaacctttaaacccttgttctcataagtctttataaattgtgtggcaacagttttcacagatggcctcccagtgaactgtgccatccaatattcaccctcctcttgagtctgggccggctctgtgactcacttttcacaagattgtgggggaagcgatgctgagtgatttctaaggctagatcctaagttttgcagcttccacctgggcctctgaaatacttagcgcactccctccggacactcaggtgccatactgataggagcccaagtcacatggagaggccacatgtagctggtctggatgacaacctcagctgagtcctcagacatcagccagcattcactgctgttgggcatcctgaatgtccagcacagttaaatcttcagatgcctcaggccccagcagtgtgaccccatgagaaatcccaagtgaggatgtctcaggtgagcccagtcaaccccgtagaaccatgaatgtcataataaattgtgtgttaagcttttgagcttagggtggtttgttatacacctgcagacaactggaatgcattgattaaaaatacagcgctaaggcctttagcatggtttagctaaaactttaataaatagtttcatcaaaattaacagaagggatgtatgaaaatgtcaagttatagaagaatggagtgaactgtagcagatcccagggtattcaaggacattttttttttcactaaattgctacttttgtctaagtcttttctttgaggtagggtcgttactttgtgaaacaacataaggacttccatctctcggagtctgtaaagtaaatatagttgcaattgcacttgacttcgatatgaaataagtccttggccacatactttggctaaaaaagggaaagaagtggtggtcacaagtagccaggctaaagaatcaatgaaaatgggacaatagatgagaaaatatatatatatatatatatacacatatatatatatgtatatatatatatgcatatgtatatgctcagcttctattttctgtttgtttatacttcatgaaaattacaggtccacaattcctcatccacaaagctctgaaaaccaaaagtgtttttcataagttgggcacctaaattcttttggtagcaatagaactttcctttggctattaagggtctttatcttatttaatattaacactcattttgttacagaagtctttgtttcatgacaaggtgctggtacagatcccacttatgacacctttaaacagtacaccatacatgtgttgtgtcacccttctaaaaatcaaaccttctgatatctgagacacttctggtttcagacctaaagaagactctatcatagacctgaagtgaactttattgtacagggaggacagtagagtgtagagtaatcaagcagtctttggagttagaccacctgagttcaaatcctggatctgctgcttgccagctctgacacttggattgattgcaaaaccctctgcttcagtttattcttctacaaaatacagagagtaaaagaaatgacctcagaagggttcttatgagaaccaaatgagattatgcatgtaaaatgcttagcccaataactagtagttggtaaacactcaccaaacattaactattattgtattattattaaaatgtcagttgtttgttttggtttttgtttttgcttttagagacatggtctcactctgtggccccaactggagtacactgaagctcactgtcacctcaaactcctgggctcaaacaatcctcccacctcagcctctcaagtagctgggagtagaggtgtgtgccaccatgcctggctatttttttattttttattttattttattttattttatttttatttatttatttattttttagagattgggtattgctttattgctcaggctagtctcaaattcctggcctcaagcaatcctcccactttggcctcccaaagtactaggattacaagaatgagccactggacccagaaaaaatgtcagtattttataaattcaatgaaacaaataatatttaaatgagagttcagccaggaaaaaagaaactactcaaggtatcaccaacaggaagatattcaatatagggaatcagatgcatacaaagtctttggaaggagtgaatgggcaaaagttgagaaggtagcactactaatttcaggttattccatatcacctgtggacccagtgtcaggaagctgctgtactcagagatcagaaattgcaataaatgacaggtaatcaatcactgtccatgtcacagctgctctccttgcagctcagaagctggggatagccagggatggtctttggggtctaacttcactgccaacgtttatatttgttggccaggctcggtggttcgtgcctgtaatcccaacactttgggaggctaaggtgggtggattgcctgagctcagaagttcgcgaccagcctgggcaacatgatgaaaccctgtctctactaaaatacaaaaaattagccaggcgtggcagcatgtgcctatagtcccagctactcaggaggctgaggcaggagaattgcttgaacgcggtaggcagaggttgcagtgagccaagattgcgccactgcactccagcctgtgcaacaaagcaagactctgtctcaaaaaaaaaaaaaaaagtttatatttgtcaaaccccttgtgtcagctgccactgtcacagaaagaatgacatgctccttgcgtctttcaaatccttgagtgcacctcattggcacaacctaaaccttatcagaactgtgctggcaggagactctgggaaatgcagctccaggcctcccagcctctgtgatacacataaca

SEQ ID NO: 7212 - DNA, 1222 bp, mus musculus
ctctcggtcttggttcgttacagctcagctaccgacccatcgaatcatttttccttcctgtaacctggttgccttattcttaaaataagaccaacaatagctttcctgtgagaagaaagtggaatttgtacagttgcacaaatatttttgaaaagtcaaagatttactgtagtaatgaattggacgatggtattacttatgccaaatatatttcctaccttgtaaaaatagtatctgaggtaggaaccgagtagttcctgtgtgctgtttcatcccgtcatctgggatattatttctccaccttccttctgtgaatctttctgtctgtgctcagctttttcctggggcctcacctctgctctccgtttatgcagccctccctgacacccctggtgtagctgcgtggaaaggcacccagaggccaccccatgaaggaaatgcacagagcttgttttgtaaataaatgactgtttcgtggaggtgccacatcaagggagagagacaagatcagaaaccgggagatgggccaggcacagtggctcacgcctgtaatcccagcactttgggaggtggaggcaggcgaatcacctgagggcaggagtttgagaccagcctgggcaacatggcgaaacctcatctctactaaaaataaaaaatcagccagacgtggtggcaagtgcctgtagtcccagctactcgggaggctgagacaggagaactgtttgaacctgggaggtggagattacagtgaactgagatcatgccactgcgctccagcctgggtaacagagggagactccatctcaaaagaaaaaaaaagaaaagaaactgggagatggagctggaaaggcaggtaggatggactgatgaggctagagaagctgagagtttgaacaagacacaaatagctgagccgaggcagttcaagattttgggaggcagtgcctcttttggagagatctctgttttgtttttgttttttttgcataggacaacacattccatagtactgggtactgagttgaacctagcataacaaaagcggtcactcacatccctttggttgaggactttttagtgcaccaccaatattcatctcatgtgccagtgggagttaataatcatgagctagccagaagttttgaatgagatttggaatttccttaagcaaggcaatttcagataattggtggttcctggactgcctaaaggaaggggattt

SEQ ID NO: 7213 - DNA, 1222 bp, mus musculus; identical to SEQ ID NO: 7212

SEQ ID NO: 7214 - DNA, 1141 bp, mus musculus
agggggtacatagctggcaaagaataaagctgcaattcggacccattaactcattcattaaatcaacccaaactcattcgcagctgtatatcagacactggaaagattctggagatagaaacagacgtgacacaatttcttccctccaggaactgcccatcccgatgaacccccaacttgggccactccatctgtgcctatcattgctcttcagtaggagagcctaggttcggtgaaagaggggatggttaataggtacaaaaactagttagaaagaataaaaaagatacagtattttctagcaaaacagggtgactgtagtaaaaaaataattgaattgttcatttaagaataactaagagtataactggattattcaaaacacaaaggataaatgcttgagggaatgaataccctatatatcctgatgtgagtattacacactgcatgcctatatcaaaatatctcatgtaatccataaatatatacacctactatgtacccacaaaaagttaaacattaaaaaaattttaataaaacaatagtagagcttatctgctactgtttacctatggtccaaagtcagatacttctcccagtggcaaccgagttacctcctctcaaaattcccctcccatagagttaacaaatgaataaacaaataaaaaccccagcacccatgatgcagttatcccacctgagttgagctcaagattttctttttcccctttgctgacttttttggtaaagcgaaaaaaaaaaaaaaaaaacacaactttcttttacatttgaatactgtatacagggaatgggcccaggaaacctaaacggagacaagcaactcaaaaataaaagacattcttcctatgatatcatatttcctacttgttcagggccttccttggaggctcctaatgtacaacgtaaatgttaactcattcttccttctggtatccttgggaggcaggaagccgatgttatttcatagataaaaaagctgcagtcccggaggttgaatcccttcccccggggtcacataactacaggcagtgtgaagggctgggaatggaacttggggttaggactccctgcctgtggtcccctggctctcaagtggggcctccttcctaagagataactt

SEQ ID NO: 7215 - DNA, 715 bp, mus musculus
tatttttgttttctgtgaattgcctattcaggcttcttgcctgtttttctattggaatatttcttgtcatattcattatttggttagctgtaatacgccttatttttagaaagagcacaggtgtgtttcctctatgaaccctcacatatttcagaatagctttctatttttatcatgaacgattaacaactttattgatatatcttgggtctcatagcaaagcagaaaaagttcatccagacttgggtttcctcctatgtcaggcagatgtgcactccctgaattccctcacaatccaccaatttgaagttacaatcttcctgcagggcttaaaccaccaggctgattagtaaaattttcagttcagttatcgctcagcctgtgtaactgtagataaagcctggaatatggggagccccgagcagaggaatcctatctctgagcagtttttcctttgtaattgttaccaagcaaaactgttgggctggtgcttccaggcctccatacctcacttagcccacctggtactttggctaagtcgtgagaccctcacgtacaactgactctctgtgggccattaccatggaaacccaggaatctccatgctacttctgtagaatgcagcttattccaagtgggggaaggggtttcacatcttacactctctgcctcatattagcttccacttcctcccctattgttagtgagtattagt

SEQ ID NO: 7216 - DNA, 806 bp, mus musculus
ccaccaacaaggaatgaagtattaatacatgctatgacatgaatgaatgtttaaaacatgtttagtgaaagaaaccagacacaaaagacaacatattttatggctccatttatatgaaatataatccagtagacactcctagaaacagaaagtagattaatggttgggggccgggaggtagtagggagtgactgctaataggtacgaaatttttttttgaagaaatgaaaatattctggaattagataatggagatatttgaaaaactcagtgactatactaacaacctcttaattgtacactttaaatgggtgatttttatgctatgcaaattatatccataaaaggattattaaatcaaagaaagaactgtgaaataatagcagccacagcttttttaaaaagtgcactaatacatgcatttctctgagttctgtggatattatatgtgtacatgtgtgtgtgctgagcataacacataatgtgatgtgttactatctcactgtgtaggcaatataatgttatagaatatttttggctccaaattctcttttgttaataaaacttcatggagaccttagtgatttacttatgaaatgaccgctgtgcccttactaaaggatacatcctttcatctctggaaattgtgattacaaatgatttctttaaattgttctttgtctttttaggatttcctgagaagataacagtgaaacagcgttatcgcctacttggaaatagtctcaacgtgcatgtagtagctaaactaatcaaaatcttatatgaataattttgaaataactctg

SEQ ID NO: 7217 - DNA, 816 bp, mus musculus
tgtaggaattcagagaactagactttaatccaggtatatcttttgtcaaaagaatatcttggtagatatgtgatttggggcagctccatgtatctttctgggtcgtctacttatttatgcattgtaaggctaatgtaacatgatcttttgtagcttgtataaattttctgtttcatatcatctacctctgcctaccttaactatccctgccattcagcctgaatagttcacctatgtcactgaatggacctgggtaccatggtactgaaacttgggtgcatgatttctagcatgtagttatagcagtgtactttctgaacgtaacctgggggtactttatctccattcgtatctggtgagccttttgttctgagtgattttatcaggaacatctgcattccaagtagaagcgcttcagccatagtactttaactttcattggtgttgatttgaaaacagaaaaataaatagttgtaactctgggacagatactgtatttgtatactgcttcaaactaaaggaggtaagtagcatcagactacatgaaattttattcttgatgttcttgtatgcaaagtggcatcttggtcttggtgaactgaaaatgttaatgtcaccagtatactacacttgccgttctttagctgttgtattgctgagatgctagagtactatggaaactagtagtttccatcttttgtgctggctaaaattgtctaccaagtaaggtgcaaaaccagcagtgattttttttttttttgcatcacaaatatttggcctagaaaaatgccattatatactgcttagttacaagtt

SEQ ID NO: 7218 - DNA, 478 bp, mus musculus
taatgctctttgataagaccagtagtctcctcagatgctccaccatcagccacgtgcttctgcgcctggctttgagtaacaggctggccagctgcaagagaggcacagccaggcattgccctgacagctgacaggtggtgtgggcctggagtgagggaaataatctgcactctggaaatttgccatactgcaacctggcccatggaagaacccaaggatgcatgagctccagctcctcacctttcatcttagagagaaatatgggctgtgagagttggccagaggaggtgcatatgtccaggaagcacacctgggagctcaggctggacgtgccaccacttcctctttggctgcaatgcacacatctggctattcccatcagtggttagcaagaggcaaagagatgcttggctcagcatccaagagaactcagtcacccaagagaatgttaacactgatgcattgacctgcctcctat

SEQ ID NO: 7219 - DNA, 682 bp, mus musculus
aaattcagtaatgactggaactcttacttagaacatggctagtttcacaaaaagctggatatattaaaatgtatttacttttgtaaaaactttaaaagtaataagctaggatattcatataattgttttataattatgatactaataattttctcacaactctgtattttattattttaatatatacgacattaaaaataaggacattattcaagaaatatttcaaaagtgttcaaaagtgactttctgcaggatctctcatttgttttttaacttctctttgaaggtgaccgaattataaaagtcaatggagaaagtgttattggcaaaacctattcccaagtaattgctttaattcaaaacaggtaagagtcttaaaacattaaaacccaaagatgggttttatagatcaatagagcacatagatttaatacaatcttctattcttacaaggaattgtggtgacaaggagatgtggaactttcccttagatataatgcatttgagagttgccaaggaccagctatctgaggatagcttagttggtggctttggtttgacagatgtatcagatttatgattaaaatcccatagaggctgtaaggcacacactttagatttactgtgtttaccccttttatttgaagtgacaaatgtataatttgtttttaatatataaata

SEQ ID NO: 7220 - DNA, 243 bp, mus musculus
cacaaagctgccagcgcgggtaatgtggcgaaagtgcagcagatccttttgctcaggaagaatggcttgaacgatagagacaagatgaacaggtaataggcgtcgcaagcccggactgagtgccactggagtaggcgggcaggaagaggggccccttttgtgggagccacccagggcctggatcagcctcccgcgggctccgtagcccctgggacggtgacaccttgcagggctccagcgccc

SEQ ID NO: 7221 - DNA, 1705 bp, mus musculus
gtaaaaaggggtttctaaggaatattttctgcttcctttctgctccattttaagttttctgctaacttgccgccgaccccgcaactgctcacgacctctgtcaaagtcaacctttcccaccgcgtggagtgagttagggtgcacactcgggagttgcataaaagtgtttgagaaagggagatgcaaagttgaataaaagtgtttcccgggaggggccgagcggaaagcagcaggtggccggggcgggtggaacccagcgcgggcgcagagcgtctctggcgcgggcatacggtgcaacgggtccgcgggaatcttggatgcgcggaggtcccgagaccagggtaacggactgggctgcggtcgcggccgggtgaggctgggagcggaaggcggcggcggcggcgcccgggggagggcacgggccctgtaggcctcccacaagggcgccggcgtgcgcggccgcagggcgcgcagtgttgacccgcgtcctagcaacaggcgggcgccgactgcggggggcagggtgctgcaggtgagtgcggctgggggtctccacgctcacccccgcaggggttctgcagccgcccgcgtggatcgggaaacagaggcggctctctggccccgccgctgccgctctcgcctgctcccctttccctcccggggaccaagacccgcccccttcccttctctctcccagccccatctcactccttcctccccgcgagaccctgcctcggccctaggttggggaccgtctgctcctcagtccctgcgcccctctctgcactacctcggccccatcacctcccggatccgctctccacttctcccgccgcttccctgcctctccttcccccagcccgtctttctcctccgccctttgcagctctgcctcccgctcccagcgtggttttcgccgtcccttccctcctcgtccccttaccgaatccattcctggaaacttagggtctcagctctgacgcccccttcttgtaacgagtctggtgggggccgtcatcccacactaggcttagctttggttttacttagggccctgttcatgtcatgtctaaaagttcgattttctgtcggtcttactgagtaacttctgcattctcagaaagcagtgtatgcgcggactccccgtggatgttaccaaccacatttcatagatctcagagctgatggctgcctttccgtagccccctaaagaattcggttgtgcttctgtttaagtgttaacgatgtgattaccgaatgggtttcatttcactaatgatgctggaagcttgaaattgacctttagaaagaaaaacaatctgtggtatctattggataaagagaaaaatgagtgctaagtgattcccagtttatgtaaacatcccagtttatgtaaacacgtaaccaaaacttttttccttttaatctttaaacttactttctttacttcaaaggtgtgtgctgtgtatttacatggattcattttaactatggttcttaagccaaaagagcttggcaatgggcagaaaccggggagcaactggtcttgattttaaaatcttagttttgagttatgccgaccatttttgaacaccatttatttatttatttattttctaataacattgatcttgccttctggattgtcataggccaccctgaggttttcttaaactcaccaaccttcttgaataaaacttgtgca

SEQ ID NO: 7222 - DNA, 1240 bp, mus musculus
ctgtctattaatctatccaatgaaaccacagtgctggacatcaataaaggaatcacagagcgtgaaatacatgctggtagaaagaaagcagatggacaaatatgaaaagcaaacaaaagtaaaaacagaggaggagattctagagataagagagggctggagaagctccaagctcagagtcatccaacacaaaggacagggatgggtcagagggcacccatcagagtgtttatttaaagttctgaattcaggactttggaacccccttcttcaactagagcttttccttctcctctctttcttctctagtccaccgtgcaatttcaaagcaaacatgggcaaattatggcaagtggataaaaccaaatcatctctaaagaaccctaaccctttagagtaaggggatataggtgctgggcctaaagaaaaaagctggaggtaaccctgggcctgaggaacaaaggctaagtaagacagctttgctcaggtgtgaactacaccaaagttctttattccctaacaatcttggggatctctaggttgcctggtctatacaatagggaaggctgcctgacagcactcccactcacttacccagtgtatgcacagaactccctcacttaagaaagagtcccgagaaacccatgctatctgtgctaatcagctttgtccttgagccataggtattgacatggtttggctctgtttggctctcccaaatctcatgttgaattgtaatccctggggattataggggagggacctggtgggaggtgactggatcatggaggcagatttcccccttgctgttcttgtgatagttaatgagttctcatgagatctggtggttttaaaagtgtgtggcactttccccttcacgctgtctctcttctgctgtgtgtgaagaaggtgctggcttcccctttgccgtctgccacgactgtaagtttcctgaggcctcccagtcatgcttcctgtacagaccgcagaactgtgagtcaaacctcttttcttcataaattacccagtctcaggtagctctttatagcagtgtgagaatggactgatacagatataacactagatatttgattatgccaatttcagaaaagggaaggattaatatgaacaaacagaacaacagattctgaagaaaatagatataactcagggaactaaaaataactaaaaaaaaaaaaaacccctttttttagtgttctcggaacaatttaggatgata

SEQ ID NO: 7223 - DNA, 630 bp, mus musculus
tttgatcgaggagagttggagggatagggagttaaacattccaagaactgtgtattgtgcaagagaaaggcagaaagaacaactgagtaaagtcggtggctcacaactgtaatcccagcactttgggaggctgaggtggtggatcaactgaggtcaggagttcgagaccagcctaaccaacatggcgaaaccccatctctactaaaaatacaaaaattagccaggtgtcatggtacacacctgtaatccccattactcaagaggctgaggcatgggaatcgcttcacccctgggaggtggaggttgcagtgagctgagattgtgccactgcactccagcctgggcaacagagcgagactctgtctcaaaaaaaaaaaaaaaaaaaaaaaaaaacaagtaaagaatttgttaattcaggaacaaagttaaaaattgaaaagtagccacagagccacagaagaatagaagtagaataacagaatatataccttcccaagaagcagtcaagtaagtaagaaaaggaagaagaaaacataatcattccagtagaaagcagaaaagaacaaaataagaaaaaaagaaaatgtatatatatagtaaacagaaaacacaaaataatatggtagaaat

SEQ ID NO: 7224 - DNA, 247 bp, mus musculus
actttacatgtataatctttgattttcataactactttatgagaaaggtactattataccccaattttaatgagaataaactgaagccaatagaggttaagtaatatacctggctgaggtcatataattagtaaatggatgaaacaggttttgacccaaaggtcaggtagtctcactccggaacttatgtccttcatcattatacgattgataataatacttcgacaaaaagatacctcatgtttct

SEQ ID NO: 7225 - DNA, 875 bp, mus musculus
acattaataatgggctcagccaattttccaaagcaagacttccactctgtcgttcaggatcattacaggtgtccaactaccattacatgctctgctaaaaccaactttgacacaaaaaacttcaggtttaataaaccaggtttaccagttctaattatctgtttttcaatatgaaattctctttagtagattttttagtttttccatcattatacctagatactagtttctaaatccaacaaaatgtataaatcacataaaactcaaatgaaaaggaatacaatcctaaggctagtaccactacaaatattcccgttttcttcttcccagctgtaaagtccgcctgctaaaagaaccagagagaagagacttttttcacattacatgcgttatttattattcttttttatcactgatgcctatttgaattatagttacaccacctaaaatagactattaaaatatttctggatgagtcaaggaacttctgttttattatattttgtgagttgtgatgaccattgtgtgcagataggtcaactatgaaaaaaaattgatgttccacctcaccagatatacccctacaacatatatatgttcttaatatatacttgaaagttatgttattaccacaaactatctagtgtgatttaaatttgcatatgagattgcattatatggaaaaaatagttaagaaataaggtagcataagtctgtgcctcagttttgttattacttgctatatggtcttggtcaaatcactaaatataactaagcctcaatataatgaggcttatatgattgttaattgttaattttcctttcaatttgaattcctatgttgctgcaatctggacactttattataattctac

SEQ ID NO: 7226 - DNA, 422 bp, mus musculus
ccataattgttatgacccctctctcaaaacacgcacacactcaaagattaaagaaagaatccacttcaagtctgattttggccagagttttacacagttggggtatactcctaccatctgaggttattaaaaacaaaccaatcattactcaatttgtccctcttggagtctctttcctggtagcagcatttaggatcaactgggatcctgagttcccaaactggcctgttaacacgaacacgtttatcagtatttggctcaaggacaaagcactaaaacaacagatggaatcaatattacattttacaaagcgattacatcgcaaaatcaacagttctttgtaatgactgatggtgattgtgtaaatttcttctgctctcagcattttcttcttataagaatgtctaagtaagtgccatagg

SEQ ID NO: 7227 - DNA, 1495 bp, mus musculus
gtggggctggagcccggctggtcctggtatcctgggcttggggggaccctgctcctttccctgggagccctgaggcctcaactggatgacaggaggtggatatgctggtccctgaggcacaggcagtatgaacctctgcatggagctgggtctcagcagaagcccacccaagcctggagtttcccagccagggatgcacctttttcatcccagcagcctctgtccctcagtcctgagccctcaggggccctcagggcatgaaagcaggaatcccaaatccaccttccagaattacacgggctgttcttggtggtcaggtggcctctcggggccagggtcctttttaagactggaacctctccaagctcaccagcactctcagtgcacgcacgcacgcacacacacacacacacacacaccaggattttaaactcagtccaacaaatctcagcatgcaccagaactatttcagcattttaagagcctgtattgattttggaaggagccaggcagcgtgtgaaggccattctgtctgggatcctatgctgagtctggggtctctgtatgagggattatccatgtgtggggagccttcccccttcagagctttccagcttccctctgatcacatgtcctgagcacactatcccaaacctaaccccagctgggctctagcaagagacgaggtcctgtcttgctgggaaagggtcatccttcccacccggaggcccctgctctgccccagtttcctgccacaaagcccagacagtcctgggaacctgggctggtgagtccctccatcaccttcagaaacagccatgaggagctggcagtgggatggcctgggggtaggagcgtggcttctggagctagaccacatgggttcagatcccagcggtgcctctaactggccacaggaccttgggcagtcagctgaccctgcccagtcccagcatcctcatctggtcttagctaacagggacacacctgaggaggtggtcttcatgtcacttccactgggaccagttttcagagcagctgcaggggtcatcagttaaggcagtacagcccacttacagaggaggcgggtggcttggggtgtgaaggacgtgcccaggtgacatgctgctgagtggccccaaccccatccaggcaccaagccagagcctgtccccagggaccccagggcacatcagcagaagctggaggatgtgggtctcctgggcctggaatctcagagcccacattggttaatttcacacgtccgcttgactggcacacagggggcctggatgtttggccagacattatgctgggtgtgtgtcaggggggctctgggtgagatgaacacttgaatccatggactgcaaagcagacagcctcccagtgtgggtagacccatccaacctgtcgcagacctaagctgaacacaaaggccaagtaggagataattcattctgcctggctgccttaagctgggagcttggtcttttcc

SEQ ID NO: 7228 - DNA, 825 bp, mus musculus
ttgatctcgagttggaagaggtgagtcctgtctcaaaatggaggtaaaaccgccgcctggttgcccccagcccgactccggcagtcgccgtcgccactggggggaggagggccatgatccaaaggaaccagagcagctgagaaaactgtttattggtggtctgagctttgaaactacagatgatagtttaagagaacattttgagaaatggggcacactcacagattgtctggtaatgagagacccccaaacaaaacgttccaggggctttggttttgtgacttattcttgtgttacagaggtggatgcagcaatgcgtgctcgaccattcaaggttgatgggcgtgtagtggaaccaaagagagctgtttctagagaggattctgtgaagcctggtgcccatctaacagtgaagaaaatttttgttggcagtattaaagaagatacagaagaatataatttgagagactactttgaaaagtacggcaagattgaaaccatagaagttatggaagacaggcagagtggaaaaaagagaggatttgcttctgtaacttttgatgatcatgatacagttgataaaattgttgttcagaaataccacactattaatgggcataactgtgaagtgaaaaaggcccttgctaaacaagtgatgcagccggctggatcacagaggggtcgtggaggtggatctggcaattgtatgggtcacagaggaaactttggaggtggtggaggtaattttggccgtgatggaaactttggtggaagaggaggctatggtggtggaggtggtggcagcagaggtagttatggaggagg

SEQ ID NO: 7229 - DNA, 523 bp, mus musculus
caaaaccatgtttctttcaatactaggtgctgtgttcagccaactacagctagttagcaacctccctctaagttttctttctgcccaaaactctctacttcaatccccagcagccagatgtcttgcctgtgtgtcctgggtgagaatgttccaaaatgcaacagctcacttgtggttcttatttggtgacgtagctacgtcatttcttatagagagcagttcagttattatttaggagcaggagttctaacgtgaacatattgcttaagggggctgatatcaaaatgtatgcactaccaggcacatacattagccagtcaagcattctccttcacattgtcttttacttcttcattgttccttacacagaagcctagtatgcattactcgaactctcagtgtattgccactaagacttttatttcaaaaaaaaaaaagggggagttgagagctatttttagaagcttgtttcctatgtatttctgtgctatcatttctttctgtgattaaagcccaaaaagaa

SEQ ID NO: 7230 - DNA, 1271 bp, mus musculus
tggaagatttatatttcacctgatcacttttaatttgtcttgtcccaatagacagaaactccagtggtaaactcagtcaaaatttggtgatatttgttaagcttaaactctggaattgttagaattactttgcaagtatttcccccaaatttccccccatattatctttgtttgcatttatactttttaaatttaaacatgaatgcaattttggtgggttgaagagatattaaaattgaatagttaacagatatctgtaattttttttctgatcatctctaaattttttttccttctacacacagaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttt

SEQ ID NO: 7231 - DNA, 708 bp, mus musculus
ctaaattttgcaaatattttttatttaaaaataaggctcacatttatggagagcttccaaagccaaggtgcctgagtgtgttgcccagtgtccagccgggagcatgtggaggagctgggatgctatggtgatagacagacctcaaagcccatcttgtaactactctgatctataatcacatgggggaaaaaagctttgtatttttaaaaaaacaatgtgcatcccgcagccagtaatcagtagcatttcttttaatagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaaggtaagaatcaccacatttgcagacattttgtaaactgtgtgcatctcattgctaggaaattgtaatcaagccatcaataactatgcttggatgattttgtgcccag

SEQ ID NO: 7232 - DNA, 708 bp, mus musculus; identical to SEQ ID NO: 7231

SEQ ID NO: 7233 - DNA, 708 bp, mus musculus; identical to SEQ ID NO: 7231

SEQ ID NO: 7234 - DNA, 1295 bp, mus musculus
aacagcacaggccaagattaaatatatttccccctcaatttaacaagttgctgaccacaaatataaatatgtgcgtatgtgtttgcggccccgtgtgcagatgcacactgtatgtgcgaagccgatctggcgttctaactcttctctcacatgctccacacaggccacaagtgggagaagaacctggccttgagtcgagagctggacgttagcattgctttgacagggaagcccagcaaaaccagccccgcagtgactgctctggccgtgtccaggtaagcgcggccttgtttctctgggtctccagcagagggcactgcagccacctttaggaaagccccagtggctctgagtccaggccacctggccgaggaggccacttcactccaggacatggccccaccaagcacaggaagcagcccgtgtggccatatagagccccaggaaacgtttttcagggttttgttgttgtttgttttgcttttaactcacacatgcccttgctctcttgctcttgaatatccaaacattcattaagaaatccaagaggtataagtatattgttttgtaattttatcctaaagagagccttttcccctgagttccactgcagactgtaacatttggtgtgatgattatccttcattaacagaaagtgccttctgagggctcttagctgctgtagcatagccaagcatcagtcccgacacttcatacccgttatttgactcgcagtaacccatggaggtggttactgtcattaacatccttgtacacactgcgaggtgcagccttaggggccgctgaccttgcagagccggacttccttcctccctcactggcgtggcgtgggctgttccggggtccttggtggaggcactacacagtgttttagatgctgggtggggcggagtggagtggggtgggcatgatggtagggccagagccgcactttttgcagagaacttgccatttgttctgccctggtcctggctatttctctggtgggacaggagactcacctggaggcactggagagaggcacggcctcgtcctgttccctggggcctgagcttccccacagtgctgtgggagccaccaccctcacagctcaatgctttcccctcccccaggtggaaaccttctccattcctcccactgcctcccctgcctcaagggagacaagaccaggggcaagctccgctgggccccagatagagccccagagttgcaatatcccatgtgctggcggggacaagtggtactgtccctctaacgttcttgtcttttctttc

SEQ ID NO: 7235 - DNA, 4160 bp, mus musculus
agcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtgtaagtctaaaagacttccattgtaatttcctcacctgccatttctcatgaactctggtcctctggtaaagctcattttctggaaaatctgctgaagcaagactggaggcttcaggaggcttgcagcttcatctcatcgccatgcaactggcacccagggaaatatgtggaaggacagaactggtcttcctgaggacgaggtgtcctggagtgtcatctgtagtactggggtggaggcagttccaagcacagcctgcagggtgtgttatgagccagttatacagctgctgtaaggagccagatggaaatctcaaagggacacagaaatccagtatcaagcctgattgggtgatggtagattatgtgttgatgcagcaactattttttcagcacttggcactatgctacatgcctgagggtacagtgatgggtcagactcatccctgtcctcaacaaggccatgggctcagggctgaggcagatactaaatgggaaatttcccttaagaaacgtacttaaaatattttattgtgaaatcacaaaataatattataaataccgcatacatggctcagatttaatatatattagcattttgtcatatttaattcagataacccttttagaaaggaaatgaaatgttaatatatgattaaaaccttttcattcctttcctatatcatttccatccatttttttggacttgtgtattattgttttgtggttttttaaatttatatacataaatggcatactgccatttatattcttctgccactatttaccctcaaattatgtttttgagatatgagattttggtccattcactttaattgctattaatattacagtgctagaaatgaactacacatatttattcatttctctacttatggaaaattttattatgctcaatatcacattgttagaaacagtctgataagcattatacaggggggtttccatgaagagcaatgagtagaaccaggctgctgtggtatcacagaggagggagatgctttgccttctggaggtgtcttgggagcatgtggtactctctggaagtttaagtgggtggaattcagagtaggggtaataataagaatggacaggtaagtgggaaccagatcacagggggtgcttaagccacaagaagagggtctgaactctcagctgatgtagatcgggtgcccattgaggggttgtaaccagtggggcagtgtcatttgtctttgaagagagaaaaatcactcttgcagcagcttgcaggatggactggatgggggaccaaactggagaccgggagaaaagttaggagattgctgcagtaacaaaggaaactagcctgatggcatcagggatggagagaagtgacagacactttaagacattaataaagagagtcagcagataacaggatggattatggggtagagaaaacaggtagtggactgggtcgaaacctagttttgttcttgaaaaactaagataaggaaatacaggaagggaagagagatgcacttcagggcactgagatagaaaagggagaatagatgttccagtgcttatacttagtacgtgagcagatatagtgagttctagcaagatctgttcagaattgtcagggcataatctagcctttggactggaatgtaactggatgtggacagtaggaatcacataggccagatgtcagcacccctgggggagggattcctggctcctgctgcctgatacctgaaattctttaacggggtcaaggcttatccatcttgacaataaggcaatgtgtcatattgagaggcagaggcgttggtactatcacttactagctctatgaccctgggaagaaactttaacctaagtcttagtttcctcatgtttagaatgagatattcacatctgcttcatcgggtgggaaaaagtttatgaacattaaaattagatggcatatatggatactaatagagtcacacagagactgaatggtagctgtttcttgtttttgtattgtcaaggtatcaaatacaaatattactagaatattcctaccctaactgctccatttaaaattgcaaactgcccttcactccctatacttctgatcccccttatccagctcaactttattatttttccacagcctttaacacctaacataatgtgtaaattatttattataagtattgtctcttatctctcttccccactaggaagggatcttcccacaaaggcagcctccttgccttttttattcattgatccaggtatctagagcattgcctgtccctggcatgtaagaggctcaatgaatattggttgaatgaatgactggttcttggacccattgagaatccaataaaagtctgaacctgtcatgctggtgtagagagtatagatcatattcaaacaacattttgcctaacactgcagagcctctgaatcccacaattgagaatccaaggtagaaaggcctgcactaatagaaattttgatgtttttctcaggtaatttcccaaatggggatacagacaagtatttatctgacaccattcgacctttgagaaggcacttgaactagaattcccaggcgtctggatgcttttctgcttgtatttgagaaatgaaaatctcaaagactttcagattagtgtatggttgcagaacttggaaagcagtacagttaaatcagttatgactgcttagtccttgtattaggctctgtgggccaaaaggtattgatttttgtgtagagcatcaaccccaaattagctagaggtaaatttaaatgtcaatggacagtttttaaaaacgaaacatgatgcattaacctgtccttatttgattagcctcatcttttaaactctatttatgattgtatgaatcaagtaagaaccaaatatgaattactatcactagtataatcacatcataaaaagctgtttctgttctaaccttggttacagataaatgacagcccttagattcactagatctgttttcagaagggaagactcaaggtaattggattcagaagcattagtagaggcatagttgggtgcccttaatgtcatttgaataatgggactattgcaaatctctccccctttcagattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgagtttccccgcttttgattttagcttctgttgtttctggcttgatgttgctggcttggacagggtgcaaagaacctgtggatgtctgaagtttctctttcttaagtagtaatcaactaagattgtattgtttttttgtgacattgattctcttcagaattaagaataaaaagtttattaatataatgatgtgaggaattacttccttctagaataaggaacgcactttcattgtccttgaaaaatgaaaaatattttctaagcttgtgtccctccttgcttgatttgctttcctatcctcttctccctacccggggcacatcacaagcttaatatttaacatttaattaagtgttaacatttttagcatagaagaggaatacctaaaaagctaactgaggtgtttatttataagcaagagatgagtgagccataagttctccttgccctcccagaattggcgttgtttttctactgggatgtggctcagtttgtagatgaatgtggagtgtagaatggtgatgagagagagaagctgggatatgtgggtggacacgcagggcaggtatggagtcctttgggaattttagcgtggcaagtatttgaacttaaagtgaaagattgtaagaaatgtgtttatgtttctttgttatcctaggtgctaaaggaagcttcccagatgaacctcctggccagggtgtggtggtacaggccatttcagt

SEQ ID NO: 7236 - DNA, 465 bp, mus musculus
atgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtaagtca

SEQ ID NO: 7237 - DNA, 1485 bp, mus musculus
ttgaatttaatgctgttcagtagtcaactcagttgagcaagcacttaccaataatcattaactagatgccacatctgtgatgaggtgctgagtttacacaggcaaatgagccccaagccctgtttttaaggaaattaccatccatcagggtggaccaaaccatgtacagccagctaaacttcagcaacaggggagatctctaaggaggaagctattacataggagatgacatttgaattcagccttaatgtgttagcagaatttggtctagtgtggaagacagaaagcccaaggttttatggcagaggcttaagaacttcaccgacaacttcttatattctccttaggtcagagcctggtccaaaaggtatagagaattggcagttacccacaagtctgccccaaagaggttctttccaaccacctgccacagtgagtcaaacaaactccgctgttggagatcctttacttaaagaggtctccctgcggtctagactagtcacagtgaaatcccatcagaaagggggccatagtaatctattgctggcttttggctaatgactgacatgacttcctttttgtcacttgatatttcactgtcataccaagagagatgttaaccgcagttaactgatgagaaacgtgagctgaagcagcttgtgtcacttgccctaggatgcagctctaggattcagtcaatgtctgactgtgctggttttccactacagcccatgtggcctactatgaggacatggagaccccataaacttatggcccctgagtctcagccctcaagtgtggttagcatgccaaaatggtaaatctttgaatactcttggattgtttagctctttaaatgtttgaggtgctcttatatacattatcatttgatttttactttaaaaacaactcacagaataaacgactgtagttttaaatagagcattgttgtcacacagcacctttggggagcccatacattgcttgaggtggtcaaagactggctgagttgctggggccagtagtagggagtgggtacatctttagcagatcccatgaattgtccctcatgggatctgttgtgggggattaaatggttctcttcctgtctccaactaagctgaggcttactgtaaccagaggagccactggcttggaacccctggttggaacataagttctcttgggcattgccattccagggtattagggtattggggcctgaggcccctgaggatagcatgaagccatctggggacttctccatgagaacttcttgtcactaagtgcgtgtaattgctgatttagtctagcctggcaggcccagtggttctggtaagtggtgttattataccaggctattggctggtagttggctaatttgaggaaaaaaagaggtggttggattctatggtaaattcagttggatgcaagtgataggatttgccacagggatcataaaaatcagggtgctgttcagggtgc

SEQ ID NO: 7238 - DNA, 1414 bp, mus musculus
aaatatactgtaaccaaaaaggtcgagaaatgccaccttaaaaaaaagtcatcatgcaaatcaagaaattggacacgtgcatatccttattctaatgtggctacttctcttatatttaatccacatgattgtttacattcaagcctttgtggattattactctctgtaaggcttctgtgcatcttcctttcaaaaagaattttcaaaaatatacctttatcctttgttagtttgtgttgtaggaattcagatttccaaagtactgagaaatcttctaattttaagctccacacatatttatgtccctggaaagtatgctttttaatctcattcttcgagaaaattatctctgctttccttattacttggcttctgcatgccttgttttatgcatactttttgatatggtttggctgtgtccccacccaactctcatcttgaattgtagctgccataatccctatgtcttatgggagggacccggtgggagataattgaattgtggacggttcccccccataccgttctcatgacactgaaaaaaatctcacaagatctgatgaacttataaagggaaacccttttgacttggttctcattctctcttgtctgcttccatgtaagatgtgccttttgccttctgccatgatggtgaggcctcccaagccacgtgtaactgtgagctcattaaacctctttttctttgtaaattacccagtctcgagcatgtcttcatcagcagtgtaaaaatggaccaatacacttctttaaccactcatcaatcaaaaactaaagaaaataatttcaaggaggaacacaactcagactgtgtctttctgaatagcaatgtctgcctgattctcccttggagatggcagaagacacttaaaagcatttttttttcctgctagcttcacagcatctgcaaatcacacagttgttactttttaccacccaagtcttctccataaattttagaatcaattggcgagaagaaggatcataggtaataagttcttttatatgaatatttgaccagatgccttgggattcataatacttgatatttagtgctttgtgactgcaagttaagccaaaatttaatacaatcaaatagatcattcaatttaggcaaaaaaatttcagattttttttgtgaatttgatcacatgggctgtgtatttcaaaactgctcctctgtaattttatatcagctaatggagactttatataaactgctaccaactataaaggctcaaatttaaaatgacactaaaaagttaatgattttctccaaaatgagtacagaacagaaaaacaaatcctgtgaatagaaatgacacttataaagaaatataggaataaagctaaattaactcactaaagaactactaagggtatttgaaaaagataa

SEQ ID NO: 7239 - DNA, 652 bp, mus musculus
acacattttgaggtccttttgaacttagacattttgctgggaaaagccagcaagacatgaaggcaacttcattttgctctcccacatgcttcctcttagataacgaattagagaacaatctatgaatttaaatgtgtggataaaataagtaattaaatattgttaataagcatacatattttaaatcttgaattttttcttattagcccactaaattttactgaagatacagaaataggataaagacaaaaattaattgtgagaaaaaagcatacaaacttaccaatgctttaaatccaggtgtggagacaaccttttgatagcttctggtgaacttcctgagaaacgatgtttcatctggggtaaagagactggactgaagagatgtgaaggtagtttctcactccaaactctgattattccaaatattaaatattattgcaccatctgaattatcaaagctctccaaatccaaaacattctagtagattcaattgcttcttctgagagtatatgtattggttttataaaaggttaagaggaaaaaaagaatcagagtagatttaagctaatgctgtcatgtagaatagaatgctgaggttcaaaaagggtgaatgacaaaactgagtctaaaatattagcatcaacggta

SEQ ID NO: 7240 - DNA, 1348 bp, mus musculus
cttcagaatgaccacttacccatctggcctcactcttctttcacataatcctatgatcgttatcccagatgcttcttaccaaacatatcattgaatacgtctcagaaattaaaaaaaaaaggagaaaaacaagtgagagtgccactaggatggatttaaatcacattattttagtgaaataatcctggcacagaatagtatacactacatgatttcaaaagtagtttatggtggcaaaataagaaaactgactgtctttgggaaggacgaggtacactgaaaagtggcacactgaaacattttggagtgagagaaatgttttcaatcttgtttggcctggtggctattccagttcatacatttgtcataactgctgactcaaactgtatttttaaaaactttgcaaaaatttattctatgtaaattatacttcaataactaaaaataaacaaatattggagaagaaagtgacatgagaaaaaaatcataacaaatttgttgatctaggatttctggatttacaacaggatctatggatagtcttcaactctttaaacaatgtaaatacatcttggggagaaaaaaatgtgccttttcctaaatatgtgagttatcatcagattatccaaaaggtctgtcaatctccaacaactctaaaagccttggttaaccccctaaatttacaaataagaagctgttttctcaaggacacataatttattaccttgtgttctatcatattttcctaattagtgccatctcctgcagtaccaaactaatctcatgtgcaaacctctgaaaaatggtagccatgagttttcaactttatgtgtcagaaaaataatttacatgttacaaattggttttaaacacaaacaatggttgcctaaattaaaatccatattgtgaaaaataaagtggaatagataaaacctgctttgctggccgggcacagtggctcaagcctgtaatctcagcactttgggtggccgaggcgggtggatcaaggggtcaggagatcgagaccatcctggctaacacggtgaaaccccgtctctactaaaaaaaatacaaaaaattagccgggtgtggtggcaggcgcctgtagtcccatctactcgggaggctgaggcaggagaatggcgtgaacccgggaaggcggagcttgcagtgagccgagattgcgccactgcactccagcttgggcgacagagcaagactccgttaaaaaaaaaaaaaaaaaaaacctgtattgctaacacggtaaagtttaaaagctagagtttatttttagtatacacaactattttttgtatgttaattttatttcctgaaattttactggata

SEQ ID NO: 7241 - DNA, 723 bp, mus musculus
ttgaaggaataagcactaatgcagaaaataggctgctgcctgcataaataattcagaaagcagtgaaaaaaatcttctagaaaatactcagttttcaacattcgctctctgtctctctcacacacacacagaggcacacatacacacacacgcattttctttatttttgaatatcattaaattatgatagacatttctaaggtaacctggcaacttggtgtttttagttacaattacataggatcaaatttcagttggttgctgaacagcactgtcgaatcagtgcaaatgtctaactgatttgaatgggttttggttaatactctgtcctaggacttttgaactgaatttatcagagccaacacaagataacctaaaagtctcaaattaacaaatttcacaccaagtattctaaatgattgtgctattaaaatattactaaaagcaattacatttggtgtttgtaaaaagctaaaatacccagcagatgagtaaagtttctgctctttatgttcgagcattattaatcaacttatttttctgtccaaggtgttcttgacaatccccattaaattataagtcttaatcaattcacaaattatagttctattcatgtcattaaaccaatattttatgctgctttttgttagtatcatggagatatttacaagtccaggcagatgaatgaggatacaggacacaatgaattataatgtgtccttg

SEQ ID NO: 7242 - DNA, 6816 bp, mus musculus
ttttggtctatgaaggttcatgttacttctattatgaattggccttttgtaaccttctagattatctctggcagataatttttctataccattttgtaactaaattcaaaataactatgtaggatgatcttacatttttttggctttggtttccatagttctttaaagcctgggtaccttttgtttgtttgtttttagtatttaattttcaattatctctaggtgttttcgctagtatctttgagcagtttccttaagggaacttgggtttttgacctgagtctttgatatctaagaacaactttatgttgctttcgtataaatatcaatttggcccaagtcagaaatgtattattatgtcctttttctttcaagaatctgtttttttaatttttcattttcaattattatggatgcatgttagttgtacatatttatggggtacatgtgatattttgctacaaacataaaatgtgtaataatcaaatcatggtaattgggtgatatggtttagttctgtgtccccacccaaatctcatatccaattataatccccacatgttgaaggaggggcctggtgggaggtgattgaatcatgggggcaaacttcccccttgctattctcatattggagttctcaggagatctgattgtttaaaagtgtatagcacttacccctttggtatctctctcctgctgccatgtgaagacatgcttgcttccccttcaccctccaccatgattttaagattcctgaggcctcccaagccatgcttcctgtactgcctgtagaactgtgagtcagctacacctcttttctttataaattacccattctcaattctttatagcaatgtgagaacagactactacattggggtttccataacctcaagcatttatcatttttttgtgttagaaacattccaatttcactcttagttatttttaactatacaataaattattgttaatttactatagttgccccattgtgctaccaaacactagatcttactccttctatgtaactgtattttttacccactaaccatcccctttctactcccctttccactaccctttccagcctctgctaaccaccattctattatattctctacttccatgagctcaaattttttggagctcctgtatatgagtgagaacatgaaatatttgtcttttagtgcctggtttattttatttaacataatatcctccagttccatccatgttgtttcaaacaacaggatttcttatccattcatctgctgatggacacaggtttattccatatcttggttattgtaagtagtgctgcagtaaacatgggaatgcagatatcgctttgatatactgattttctttttttttttgttttggatatatacccatcagtgggattactggctcataagatagtttgatttttagtttttgaggaacatccatatagttttccaaaatggccgtgctaatttgcattctcagcaacagcttgcaagggttcccctttctgtacatcctcaccagcaatcattattgcctttttcataaaagccattttaactgcggtgagattatatcttattgtagttttcacttgcatttctctgatgacgaatgatgttgagcattttttcatatgtgttggctatttgtacatccttttctgagaaatatctatgcagttcctttgccatttttaaattggattttttttctgttgagttgtttgagctgctcatatattctggttattaatcccttgtcagatgggtaatttgcaaatattttctcccattccgtggattgtctctttactttattgaccgtttcctttgctgtgcttgatgtaatcccatttgtccatttttgctgtgagatctcaggaaatctttgtccagcccaatgtcctagagtgtttcctcaatattttcttataatcgtttcatcgtttgaggtcttagatataagtatttaatctattttgatttaatttttgtatacagcatgagacaggtgtctagtttcattcttctgcttatggatagccagttttcccagcatcatttattgaagagactgccttttccccagtgtatgttctcagcacctttgtcaaaaataagttggctgtaaatgtgggaatttttttctgggttctctattctcttccattggtcagtgtgtctgtttttatgactgtcccatgcttttttggttactatagctttgtagtatgatttgaagtcagataatgtgatgcctccagctctattctttttgctcaggttagctgttatggttaatactgagtgtcaacttgactggattgaaggatgcaaagtgttgatcctgggtgtgtctgtaagggtgttgccaaaggagattaacacttgagtcagttgaatctgtagattgcattgggtggtatgggcattgtaacaatatcgatcttcccatctatgaacatggagtatctttccattttttgtgtccttaatgtcttatagctttcattgtaggtaactttcacttctttggttaagtttattcctaggcattttgttttatttgtagctatgataaattggattactttcttgatttctttttcatattgttcattgttggcatatagcaatgctacttattttagtatactgatttcatatcctgaaactttactatttatcagttctgatagttttttgtgggatctttagtgtctcctaaatataagatatcatctgcaaccaaggataatttgacttcttccattacaatttgaatgtcctttatttctttctcatgtccaattgctctgactagaatttctagtattatgttgaataaaagtggtaaaagtgggcatgctagtcttcttccagatcttagaaaaaaggctttcactttttcctcattcagtatgatactagctgccagtctgttgtatattgcttttattgtgttgagatatgttccttccatacccaggtttttgggaatttttatcatgaaggatgttgaattttattgaatgctgctttggcatctattgaaatgatcatattgtttttttccttcattctgttcagatgatgtgtcacatttattgatttgcatatgttgaaccatccttacatccctgggatgaatttcacttgatcatgatgaataatctttttagtgtgttgttgaatttgatttgctagcattatattgaggaattttgcatctatgtgtattagatatattggcctatagctttctttctttgttgtgtctttgtctgcttgtggtatcaggataacactggtctcatagaataagtttggaagtattccttccttcttgattttttgaaatagcttgagtaggattgctattaattcttctttaagtgtttggtagagtttagcagtgaagccatcaggtcttgtccatatttatttatttatttattttggacagagtgttgctctgttgccctggctggagtgcagttgtgcgatctcagcttactgcaacccttgcctcccaggttcaagtgagtctcctgcctcagcctcccgagtagctgagattagtagcatgtgccaccacacctggctaatatttgtatttttagtagagacgggggacggggtgcaccatgttggtccggctggtcttgagctcctgacctcaagtgatctgcccgcctcggccccacaaagtgctaggattacgggtgtgagacaccacgcccaactatgtcctggccatttatttgatgggagactttttattactgcttcaatctggttacttgctattggtctattcagattttgtatttcttcatggctctatctttgtaggctgtatatgtctaggaatttgtccatttcttctaggttttccagtttattgacatatagttatacataatggtctctaatgattctttgaatttcagcagtatcagttgtaacatctcttttttatatgtgattttatttattcgggtcttcttttttttcttagtctggctaaagatttgtccattttacttatcttgtcaaaaaaattcattttgttgattttttctatttttatctcaatttcatttatttctgctccgatctttattaattcttctactaattttgggtttagtttgctcttgcttttctagttctttacgatatattataaggttgtttatttgaggtttttctactttttcgatataggcatttattgcaataaactttcctctgagtaccatttgtgcagtgttccataggttttggaatgttgtgtttgtattttcatttatttcaataaatttttaaggtttctttttactttcttcaatgactcaacattcattcaggagcatattagtcttttcttgcattgctataaagaaatacctgagactgaataatttataaagaaaagagatttaattggctcatggttttgcagtctttacatgaagcatggtgctggcatctcctcagcttctggagagacctcaggaagcttataatcatggtggaaggtaagaggagagcaggaatgtcacatggccagaggaggagcaatagggagagagagcatggggtagggaaggagccacacagttttaaatgaccagatcttgtgtgaactgagagcaagagttcacttatcaccaagaggatggctcaagccattcatgagtgatctatccccgtcatctaaacacttgccaccaagccccaactctaacattggggattacaatttaacatgagattgggtcagggaaaagtacccaaactatatctaagagcatattgtttgatttccatgtgttcataaagtttccaaagttcctcttgttattgatttctagttttattccgttgtggtcagaaaagatactggatataattttttaaaaatttttgagacttgttttgtggcctaacatatggtctatccttgggaatgtttcatgagctaaggagaagaatatgtattctgcaactgttggatgaaatgttctgtaaatgtctgttaggtccatttggtctatagtgcagactaagtctgatgtttttttcttggttttctgtctagatgatctttccaatgctgaaggtgggatactgaagtccctggctcttactatatcagggtctctctctctctctctttagctctaataatatttgccttatatatctggatgctcgagtgttgactgctatatcctcttgcttaattgacccctttgtcattatataatgaccttctttgtctctttttacagtttttgtcttgaaatctatcttatctgatataaatataactaattctgctcttttttggcgggttttatttgcatggaatacctttttccatccttaagtctctgttacatgtttttaaaatcgtcttcaaatagtgtcttggtgaaatttatagtcattcgtatcattatttctttatggagagggtttgtgtccattagttttggaagacattttgataagatacaatgggattcttgtacaatttgtttgtcattgatatgtaaacattttactgaaaaaaaatacacagatttggagtcttccattgtttttctcctccttcttctcctccttgcttttccctgctccttcctcttttttgtagtgggaacattttgttctattaaatcacactccgctcctcagttcttcaggaacacatactatattaatccattttcacatggctgataaagatatacccaagactgggtaatttatagagaaaatgaggtttcatggactcgtgttccatgtggctgaggaggcctcacaatcatggtggaaggtgagaggcagacaaggaaaaaaatgagatccaagtgaaagcagaaactctttacaaaaacatcagatcttgatcttgtgagacttagtcactatcccgagaacagtatggagtaaaccacccccatgattcaattatttcccactgggtccctctcacaacacatgggaattaggggagctacaattcaggatgagatttggatggagacacaaccaaaccatatcgcatactattcaagagattgcattttgacagtcagtctctttattgtctttggtcaatcatgagtaaagacaaagaaagattgtctttacttctgtatttagagagaacttcttaggcttgacctgtacctcactaattaattttacaacattttcaagtctactatgtactgttgccagcacggctttcaatttggtgaccttatatttcatttgtacttggtctttatcttgtctcattaactacttataatttcatctgctattagtttataaatgtacattatcttcttttacatggttaagtacatgaatcagatgtttgaagtttttttctgctgttttatatagcatgtttatctaagtggaacacctgttttctgtgcctttaggtaattgcttgtacatgtctatgcttcaaggtttttaataggtcatatgttgaatggtctctgtttacactatccatacacaaaaggattcacaaaggccaaggattgaagtatattccaaatacttggataaccataggctctgtgaaagatcaaggtagggctctatgatagcatcccaggaagtcacccagttccagagcagacaagcaaagctactcaatataatgtgagttgagagaacctttgagggtgaattaaggacaacagtgaggaatgtgaccatggaagttatactaatgttcagtcttaagaggcagcaccccctcacc

SEQ ID NO: 7243 - DNA, 6816 bp, mus musculus; identical to SEQ ID NO: 7242

SEQ ID NO: 7244 - DNA, 6816 bp, mus musculus; identical to SEQ ID NO: 7242

SEQ ID NO: 7245 - DNA, 431 bp, mus musculus
gactgtgggtagccatagattcaatctgcttagggcatagacacagatgatgctttcaaactgttttcaaggattcattgcatgaattggcaatggtgttgaattccagggtaatcttttaatcattccaagttcaggtgttatttttcttcctcatagttaccaacaaaaagaaaaagcaagatgtaagacatgaacacactggtctcacctcttcactctttgtacactcaatgttcatactctggcacttcctagatatgtaaacaggacttttggaatgtgatctaagaatcagcaaagagtcttccatttcccagtatgtaccctgcctagatgcacccaaaggcttcatcatcaaactcattcaagttggttaactcagtgtccatctgggatactttgttaaactgcagaggtcaacggggttg

SEQ ID NO: 7246 - DNA, 1031 bp, mus musculus
taattatggaatatgttagtagaaggaaggcaaagtgttttatcaatgcctgtaagcatcatttacattagcatctgttacagaattggttttaaattttatttctagacgcttaaaacctgtgggttacacacatcagtatttttagatataatttcaaaggactaaacccatttttgaacctttgtttcaacatgcttttgaaagcatacaaagacatgggtgttttatctttctgattttttgtatctttctttctgatttctttagcttcttttagatctgtaagtcttcttgtgcattgttggtttttctatttttttgtttgttttcccttaaatatataaagttagttcttacctatgtttatgtacaaggcctttaacacttgacatgtcagttctgcgacatttggtaataaaatacctttcctgaagtatggaattgtggagacagagctgccagcattacagttggcctgtcagtctttgcaaagcagcaccaaatatcacccagcccctgcagatctctgggcaaaaacatatcagtcctcataagtgaattcaatagaattcttcttgacaactacaaagaaataataatttgtattatctcttcacatttatatcttccttaaaagtgaaaaatgtattgaacccttgagattaagaggaattactagtttttaaaatacacatatataagcaatttgtttcaattaatattaaatagatcccaaaggattacttcagaatttgaattttcagaaattttgaccaagctaagcttctgccagcacaaccagaaggagactagcgagatggagcttatccatccacgagccacctttgagtcaacacaactggcagcagtgtaggggactactatagccagagccaagattcctaagcctttccttcttcctcctttcttcatcccatttctattctccttcttgaagtcatggctggggcactggagagaggggaatgccagcgcatgtctacagtcaagattttcatagcacagct

SEQ ID NO: 7247 - DNA, 729 bp, mus musculus
ctaatagtaactatcaatgaagtcaaatcagtgagaatctgtctggttgtttggcattctgctaatcaaacaaatactctagggctccattgatatgaaatacagatagttgcactgatgcaacaatacaatgactaggtttgcttctccaagtgttaccgtttttcaagaaaaatatttaaactgacttgtagctggtctaacaaactaggcagccctgaagatttttagatgaatggatagatactctgatgaaatactcaacatccaatgaatgccccccgtgtataaaggcctgagctaggggtccttaagatgaatatgacgtgccccacgtcctcgagttgtttccacacaatggcgagaaatcactctacctggctgtcactcaaggccaatgtgacaaatactatgaagttgaataagcaagatactctgcgagcacaagggcgatgacgagaaacttcacagagttgattgagctgggtggaaagtccaggtggatgagatggcctggcaggatgcagggaaaagctcccccagcagagggagcagcacaggcaatacagggctgagaccacagcttcctccaccccttgctttgcttcgctctgctttgctttgccttgctctttttttttttttttttttttttcatataacaattatggagcacccactctgctgcaagcactgggcaagcagggaaagagtgagtggtctagtaca

SEQ ID NO: 7248 - DNA, 146 bp, mus musculus
ttcccttttaaatttccttattgtgtgaatgatttaaaaaatgctttaatacacagtaaaaatattttatcaaaaatgtcatcaattccttattttatcaggcagaactttcctgaacactaagctttttattccatttttagaaa

SEQ ID NO: 7249 - DNA, 973 bp, mus musculus
gagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacaggagaggccagagagtcctgtttatctgtaatacttcatgtacacttatcatccttatcttgaattaaaacactaacatgagctcctaacttggttttttaatagaaacaaaagacttttataaaatattttcccatttaatctccatgctttctttatctgatctaacctggcacctaaccaggcagaaatgtatgattcctgccatagcaaaaaaaccaccttttaatctctagatagctgtactcattgtcaacttattaggctaatatccattataaactaatcaaatttgaatagttaggctacttgctggattttgaaggtcaaccttgtttattaataaaatgctttcttaacattataaaggttacaatgagttctgatgccacatactcaccttttgggtttccaatgtgttagagagttctgtacttttgagtgttaggcctatccgaatacatatgtgaaagaagagttatcacccattg

SEQ ID NO: 7250 - DNA, 973 bp, mus musculus; identical to SEQ ID NO: 7249

SEQ ID NO: 7251 - DNA, 1435 bp, mus musculus
gtggtaacagagatggtgctaacacaaatccttaggttcagggtgcaagggagggacaggtgtgagttaatgcctatgaggagggctcctggaagagggagggcagggtctgaagcctggtcctggggagacaggtgggagggcaaggaggctggaagggggcatggaggtggggtctgtgtgagtctgggacaagttctcgggcagctgtggctgataactctggtttgtttttgttctttggctgcagacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgaggtaggccctggtcagctccagccaggagggcatggccagctctcatcgttcaggctctgaccctgtctggggagtgccaccagagctggtccctggtcagcgacacccatgaaatcattcccatgggttgactttgaaaatggacctgtgttctccctgcagcttggaactctctaggtcacttctgcctctagctggctgtgaagcagattgaacaaggatcaagggtgtggttcctggagtgattctcttgttctgaacagaccagcagggtgtttgggtcctgaggccctgggagttgttatttcccagtagtcttgaatgagcccccttctcaccttccaatctagtgttgttctcctgtgttgctctctcagttcaggagtgacagatgccagggatgttggcattttcttttctttttttttttttgagatggaatcttgctgtatcgcccaggctggagtgcagcggtgtgatctcggctcactgcagcctccacctcccaggttcaagcgattctcctgcctcagcctcccaagtagctgggattacaggtgtgtgccaccacacctgggtcattttaatatttttaatagaggtggggttttaccatgttggccaagctggtctcaaactcctgacctcaggtgatctgcccgcctcagtctcccaaagcgctgggattacaggtatgagccaccatgcctggccgatgttggcattttctctgctgggcatattcagagcatgtggttgtaggtgcttgccatcaaggtggcaggagtccagcaggtgagcctcgtagatgctctagaaatggttcctctggatggacaagcagtgtggcctgactgctgcagtgcctgccctcttctccagagagcagtctctccatccttctacgagaggtcactgctgctcagtgacccatgtgacagagctgtggcatgggcgcctgttgtacgtttgtgaacgagtggagtgggagaattgcggagggcacaggaagcctaggggggcagatcctgcttc

SEQ ID NO: 7252 - DNA, 1435 bp, mus musculus; identical to SEQ ID NO: 7251

SEQ ID NO: 7253 - DNA, 314 bp, mus musculus
aagcgagtgttgagaagcactctattttcatgatcaaaggggatgatgcctatggttagacccttccctttcccctccttccttgcatgagcttggacataatatctacagctgtagtagccatcttgtgactatgagggaaagtcctagaaaacagaagaaagaaacttaatcctgatgtcattgggacactgagccatcaccaacaatcctccttctccaaaacttttattttgttagaaaaatccctattcgtttaagccagtgaaattggggatttttataattacagacagacatattcttcaccttct

SEQ ID NO: 7254 - DNA, 1233 bp, mus musculus
gtgctttatattataaggaaagtatttgtcactcggactctcagaattgaatttgcctgaattaattatgatttgcactccatccccctgggcggtattgtgggggagaggtaatcctttctgatgtcgtatagaaaatcaattctggcctgcggcactggctagttgcttgagtgggggaacttgtcacccactgtatggtctttatttcccatttttcttggccctttgttatgtattactttctctgggctggtttaagaagccgccagggccagggagcagtgcttggagtgatggacaaggatactctcccataaagaaaatcacaagggccccaagttgggtaataaaaggccttgtcagtggcttttcttgtgtagtcagcattgtttatagagtgttttccactgagaaacatagacactttctctttcgcctaggggataagacaagttgaatggcacttggtcagatgtagggatttggtcttgactggtttgagaatgtgctgtcttctcctctgtcttctctgaggcctccctttgttccttggaatatgttcctctttcttaatttcaagatgggaaactccttcatcttataaaactccgtgagcaaatgtaagaggcaaaacaattgataaatatttgtaacaactatgacaagcatagggttgatatccttactatataaacagctgttacaaaaaataaccaccatggaaagggctatggtcaagttttaaatgccttgggaacagtgccctcaagataaagctgagcaaaatagcaggacacagaactgagcagatgtagatgttaatgtagatacactcagagaaagggctgaaatgtcccctttttcttacatccgtcaggagagcctacgagtaatttctgccttggcatgtgaccatggtgccttggctttgccattccagccaactgacccttttgctgaaagtttaataggggatgaattcacatgtgaattcataatccccttatctgtgctaagagcattctgtaatgagcctgcaacagaaagaatcttacatcttgcggttttgctctgaccccacctcttggcctccttcctaacctctctatacctcctggtttgacgctttaggtatctgccccttgtggagtcattgcctgcctgcagtatgttaaatgaagttttaaataaattgattcacatttcctgctagtcgtcacattgaggcat

SEQ ID NO: 7255 - DNA, 1787 bp, mus musculus
agttcccaggtgatactgtgctgcaggtctgggaaccccactctgagatcactgctcatggccagtgttcttaaccttggttgcacattggaataccctggggagtttttaaaaaatcctcacgtttgggttttatcctcagatatgctaatgtaattgacctgggcattggtattttaatgtgtacccaagattgagagtcattgttctaaagagaggagaaatttcttttctttaatattttacttttatttatttatttatttatttagtaattatttttgagacaggatcctctctgttgcccaggctggagtgcagtggtgtgatctcggctcactgcatcctcgacctcctgggctcaagtgatcctcccacgttagcctcctgagtagctgggactacaggcacatgccaccacaccaggctaatttttgtatttttttttgtggaggcggggtttcaccatgttgctcaggctggtctcaaacccctggcttcaagtgatccacctgcctcagcctcccaaagtgctgggattacaggcacgagctgtcacgccgagcctacagagaagagacatttcatcacaggtttctggtggactcagacctgttgtacagactcctggaagctcctgcagaacaagttggcaccttcttagctctccaggcccatgcagggagctcaggcaaccacggctccctccatcctagggattctgattctgtgggtctgagtgaggccaggatatctgagtttaacaaacacccaggtgtgtgtggtgcatagaagaccagtactggggaaccactgggctggcctaatccaggacctggttcctctatccgtgtgaatcctggggcctgtgttcatggggccattcgctctctgggccaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccagtgagtgaggcctgcttggccagggcctccaacacccacagacagctgcctttgcccttcttttctctggacttagtagccaggggttctggttctagtcctgtccctgtgcaagagcaagcagtctgcctacagcaggtggatttgtgcctttgggcctcagttttcctaagtgtaaaacaaggctattaatccttcacatcttattgccagcttcagagacctggcaggcatgaaagtgattcagaacatgcagcagggctcaggcaggcctctgggtctctgtccaggggccctactgcagcttcttcctgtagggtaggcccaaggggtgtttccctttggtctcccagcatccctctgagggtctttgcctgcccacctgctgatatctgtccaggccccagtatttggaggcactaggtctgtaccagaggggcctgtctcccttccctggagatacatgtgccctttttggtgtcaggtttgtaagtggtgatttggatgtttctggaattgggctgttagcaggttttggcttgcctctgagtgctacagacctacctgccattggctcctgtccgctgtatctacgggaagtgttgggacctgaggctggtgatgccctggggtggggcggggtgtgaggggctggctggggctcactgagcatgtaccgggtgtttcagcacactccacagccggctcctgagtgaccagactcggctgaaggatgacgtgga

SEQ ID NO: 7256 - DNA, 941 bp, mus musculus
actgtgatgaccttttaatcgattctatattgaagggtctggaggaaggaggggaagggaaagggcagaatcgggccttgtgccttgcttgggcatcttgcccccttgacctgcagaggggtgacagggctgtgcctgggtcctgtggccgcatggaggctccctgcatctttggagggtctcctgagttactccaccctgcagagtaatgaggtttctctcctcctactcctgcatcttgcaaattctgttgtcatctgctgactgtcagtggctttcctcagcccattttctgctggctctgcagagggaggcttgattccactctgaggggtgaggctggagagtgctggggagcagggagtacagaggctcacactttaggctggggctgatttctcctgaaccatcagcaatcaaatctgcctcaccactgtgagaattaattccttctcaagctccccttcagataggtgagaaatccgtgtgcctcctattaacataattgtgaccccgtttcttgtgaaatgacagccctggtctgattatgctcagggagcatccacagtctgtgtcctgggctgcgtgacgaaagcttcctcacattaactggcaaatgaacagtcccacagtccacatggtctctggaatctgcagacaatggccacgttttatctcagccataggatggggtcaagaagaagttccagtgtagcccaccacagctagttaagtacacgcccagcagcattttaaatgagcgggggaggagctctgcaaaggcgtggctggaaggacagtaggcttggagctggggggcctaggcccagcctgccatttgctaactgtgctgttggggtcaaatcccttcctcgcaaagagagcagagggctggtccgttagacctgatacttgctgattctaggctatcactgagtaca

SEQ ID NO: 7257 - DNA, 512 bp, mus musculus
atagctatttataaaaagttatgaagtacaggtattcatggagatacgctcaatgtaatatcaaatagaagcattgggtatgattattgcgtgtatagagtccatcatgctggtgtgtcatggtggtttactttttttctgcaataatttctatgaagaaagatgcttaccttttttatagaactggaaggagacatggcttgcaccagcagcaacagagatgggccccacagttgccactgccttcgccaggtccttctcctgtgaagggatgtccacaaagccagtgtcattagcagcagaatacttgggattgtacctacaggttttaaccttttaaaggtgaagagggaggcgacttgattactaccatccttctcctggggaatgtgagtcagaaccacaacactcagcagtttgcagcatagaatttccaagtcaacactgttacacatcacccaaggaagtgaaatgttattattaatagttaatttgaaactgaaaattagctc

SEQ ID NO: 7258 - DNA, 596 bp, mus musculus
ttggatacttcatttacttttgcttgtcacctaaagggcattgccaacacaagactgcttcacatgcggttttgaggcacaaacagttagttttcatgggactttgaaccctataaagagatgacttctaaattttcttggtagattttccgcattcacttatcgataatttttgcttctaccttttgcaatgtatcttacttctcattcatccttacattttgggttttcccttttacactattggattagctctttgggatttcaacattaaattaggtatctcctgtttcatttctcaagttggtgggtgttagctttttatcttttattctctggcttccatgcagttattgagaaagtagtcacaattacccagggaccaagagaaaccctgagagagaaaaatcatctttgctaccaaatgtttctcacccttgtgttatatttgctataggttaaaaacacttaagaatatatattttgtatcatgttaatatttttcaagaaaagtcagtgaaggcatttaatctgctctattctgggacatggaactaacttcaagttttgaagaatggggtaaaatgactgagaca

SEQ ID NO: 7259 - DNA, 388 bp, mus musculus
ttgatgtccacaacattttgattatctctaatagggccaaattatttaatttgcaaagaagttttagtaaataacaagtctttgtctgtataactaatataaaaaacttatctcctgttttaaaaatgagccaacagatttagaaaggttcatagttatagaatcattaagtctgtccttccatttcttccaagtatccattactcttactcttcttctatagataagggcttagaagccagaaggtatattaagaaagctgttgaaataatttaagttaaaaataaaaggaacctaaagcatttggcagcaatgagactgtagaagaggggaaagaataagaatgtttccggagtagaatcaatagaattccataagagaatacagg

SEQ ID NO: 7260 - DNA, 411 bp, mus musculus
cttattgatctgtaagtactctataagctttctttttactaatactgggttggtcatgtatgttgcagataccatccaaactgtagcctatttttaaacttagttcatgtaacatattttaacatataaaagtgtttaaatttaatgccaacatatcaatattttccttttctatttttttgttatttctttttcaataaaccttttcctactttgatcaattttcctgtattttactggacagattctaaagatttatttttcttatttagaatgctggcccttgtggaattattctatgtgcagggtgagaaggtaatcttctctcatagttttctaaatcaaattatcaaatatctgaaagcaatttattaaacagagcagagaatggcaaactggggcccatgggtc

SEQ ID NO: 7261 - DNA, 3430 bp, mus musculus
tgactgaactttgaggcacatcatctttaaaagtcgggaaaaggaagatttaacaatgttgccaatgaaggagcagggaaagaagccacaggcagggagagaaatcagaaaatgaggacatcctaatggccaaggcgggaaaatatttcaagaatggagggatcaatcatgacaagtgccactgagaggtcaggtaaaatgagaactgagaattgcctgttggacacttaaggagaatgactttgagctttgtgaaataaaagcctgcctggaatgggtacaaaagagagaagggagggaagtgagccagtgagtacaaacaagtcttgcctttcacttgatcaggaggcaagatagcatattctgctacagatgaagtgaagtgggttgacttggtggtagaaggctaaggaagttctctcagcaagttaactaggtgagaatgaggggtgtgtgtgtatgtagtgccagagatgtggggagagaataaaaggtgtgagaaagtcacccttgataataagatagtaaattaaccaccaaaattggggccgccagtgccaagaactcacttgagggctctaattataaatttatagtaagaccagtcagcagagtcattcgtttttatctgcatcatgatacatgtaaggaggtgacagagatctgctgaaacccaacttgggattttgacaatggaaggacagaagtgtggggatgttcaactggatttatgtaaggtattataatgatgggaaatgaaatctaaatcagctaagaaagaaaatgagagcacgaggaaggttatggacgatggcactgtaatgtattatagtcaatggattggagatcccaagaggtcaagaaacaactaaagtgacagtgaatatactagggtaagaaagcttgaaagttacaaggtagtaaagtgtctgaaattgttatttttggatgtggcgtaataatagataacgatgagttctgaagtatgattaattaaggtaaaatataggacatgaacattggagaatggctggttaacaaactgagaaaccattttcatggttggaccatctacatgcttactgacatcaccaacaattatggcagtagccttatgttaaaatcaatgccagatgccaatatcatcagaggatggtggtggggaggctatcagaagactgtaaatgatggaaaccagaagcattcattgatagtgaagttttgcattttagggtatgaagaagaaaagaaggaaaatgtcttggaagtaacaattcggagcatgaattgtccctatacaaactccaagacttgtggcatgtggagaattaaaggaatagagaacaaaattcatcctttaatagggcttcagagaaaagttcttaggcgccaattgattttctcttcaagaagggaaggacatattcagagatgagattttcatgatggcatgccttgagtgccagagggtttggggagtatagaagatgtaggagcttgagtcccactaagggatcttcaaaatagtgtatgcttatgggaccaatgaatacagttcatctggaacacttgtgttccctgccgggattgataaaatacagggtctaatgggattgagcctattggtctcagttatggtggttcaaggggcagtcggggagggtgtgttctattataatcccattggagtaatggtcttagtccattttgaaaggtaaagcggagttggagaatgcgggtggttagtgatcacctggacatgtggagctcgtaagtaatatgggggctacagcgtgcagagtccagtgggcctacatttgaccttcctgtgagcagtactgaaggctggggaagacaagcctcaataacttgtcagactgagtcaggactgagattctcaacagtaatcagctaagaggtattgctctcctatcctaagagatgccttctttggcaagactgttcaactatgtctcattactaaaggtagacagaatcacttgggagaatccaggatgtggtactgttttgacacggtccaagctggatgatgtaagcaggagagaatgttctaccaaaaaccttgcaacatcagatcttcagctgtgcagccagtcagcacacagaagctaagctaaagagatgtggcatccccacagggaaagagaaagaagcattaggtaagcaactgcctcatttcccagcagtcatgaaggcagttttgctaagccatctcatagcaggttatggatcctgaatttctatgtattcccttagcccagaatcctgctttgcttttatgaacttaccacaaatgatgctcctgttctagagtctaggggagtgattccaaagtctggctgcagagtagaatcacctggaatgtccaaaataaaaatccagattctacccctgaacaattaagtcagaatctgtggggtcctggcttcagtgtttttcaaaagtttcctagatgattcttatatagagccgtggttaagagctatattctagggctcagattctgtccaactcctttggtttgacaagcaggttggctgctgctagaggactaacacttagctcctttctaggactttgcattttttttcaatgattcatagtcctcagactgactatcacatgcatacacgcatacacaaaactgtcctgctgtggtacaaaatgtgtgccttattgagtctcaatccagggacaattgcagcaagtgaagtttccagaggcctgggtatccataacacacacaggcatcccatccttgcagacagttcacacatggatgtgtgatccagtggcaggtctcaagaaaggaaagcttccaaagccaggagcttgactgagacagagccttgaggtcttggactggatctcccttccaggtacacactagaggcaggcagcttccttgtttcttcctctgctctggctgctgtttcattctaagcctctgcagacacattcttcatagctgagaaaactcacagatggaatgactattattggtgcttgtcaatccagaaataaaccacaatttgctcggcatttcaatctttaccactgatgtgttagtttcatttaattagttctgtgctggatgaggtcattagatttgcgtcctaatggaaacctattactcagctctgcatggtgaggagtgtgtaggactgatttgcattatctctggaaagaaggtgaattctctcactacatttgtggtgggcagcaggtcttccagcagaaacccatttgagataacactaattgaagggacacctgtcttttgagaattcttttaaaattttcatagcagattggctgtatgccctgagaaaagggtaaaaagtgtgctacttataaaacgcaattttggagaaaagatgtagtatgatagctaaaactgttacatgaa

SEQ ID NO: 7262 - DNA, 3430 bp, mus musculus; identical to SEQ ID NO: 7261

SEQ ID NO: 7263 - DNA, 1012 bp, mus musculus
taaagacaaagttaggtttcaacagcaagcatttcttagctatctgctactaggcatagtcttatcatttcacctttactgcttttgtctttaaatgacaaccagttcagatcctcaattcttatagcccaatgtatttatacctagatagaaagatagatagttgtagtccttcttcaatgaggattccatacaattagccttgaggcttaatgacacccttgtaaaatcgttctaattagcaaagatgcattatcacagaagcagttcttacccttcggaaatgtctcgggaaatgtctcacgcagtcattattttgatctggctaaagatgcagtgtagcaagagtggctaggttctactcctagacgctgtcatggccttgttattttcaaagggtgtttgtaagctcctactaccgtgctgcattcatctgtgtgtccctcatgcccagctcagagattaggatagagcaagctcttaaatgttgctggacaattggattttcataagtcacttttaatgattttacatacccaagcatcagctccgattacgctgaaagtgtgatgctcctcttacctagatgacatttaaactcccttcatattgaaaaacagaattatctaaacaaaaaatatggttgaaagagtttatggcaaatagaatttggctgtgaattatgttttccaatccctgctgtatagagcaaattgttagaatcagcatttataattgagtttcaactaaatgctttgttttataatttgctgtgaggtaattagaaaaatgtgcatgaaagcatgacacgtataaatcacaggtatattcatctgaagtattttgtgcagtttatatttatagctcattctgtgaagctaaatccactgtattgaaacagacaattaaaggaaggtaaagggactattttcccagcaattgcaatgtgctaggcatgatgccaggcactgcacaagctctatctccattaatcttctctaatgtaaatatt

SEQ ID NO: 7264 - DNA, 1012 bp, mus musculus; identical to SEQ ID NO: 7263

SEQ ID NO: 7265 - DNA, 394 bp, mus musculus
gatatagaaatgattattaagcacatgaaaagatgctcaatattactaatcattacagaaatgcaaatcaaaaccattattagaatgcctattataaaacaaaacaaatgttggtgagattgtagagaaatcgaaggcctgcatagtattggtggaaatgtaaaattgatcagcttctgtggaaaatagtgtggaagttattcacaaaattaagtgtaaaattaccatatgatcttgcaatcccatacctgaatgtaacccaaaagcattgtaagaatggtctggaacagatatttatacactcttattcatagcagcattattcataatggcccaaaggtagaattaaccttagtgtctatcactaaggttgaatgatggattaattgataaa

SEQ ID NO: 7266 - DNA, 995 bp, mus musculus
ttctccagggaggctggggtctgtgggctgtgggagggcatatgcctcctcgaaactaatgggccaggatcccccaggtaagaccaggtgggatggccaagagaatggcatccccctcagatcctcaacagcatggcctctgggcacctccctctcgctggccaggcttgctcacccacctcctcctctctgtgtgcccaatcaccccttctgagcctcagtttcctcatctgcccacccctgaagctcaactaagttcctcatatttctgaagtgtgtggtgtgggaaacattggaaaccagcaggtgcccaccaaagcttcttcccccacaaagagcgcaaaaccctagcagcccctctaggcccagcactttcttttgcaggcaagcccctgctggtcacagcctggcttacaggccatcccactgcagcctgtaccaggaggcccgagtcagcctcgcctgcccatagctgcacgggctgggctggttgcacatctccattatgatgctcagtgcggggcccaagtcctgctgttgtgggtccctgacactcagcacaggccaagcacagagtagatcctcaggaggtgcttgaggcttggtttctggctgggagggggaatttagctctgaatgccccctctcctgccactcatctgatatgatttctctgaagagagaactaaccccacttgcaaaggaatggtggcactttaacattcccaacactcctgtgagagaagaattatctccgggtgacacagaagcaaacagaaacttggagaggacagctggcctcacagccataggtggcagaagccaggttttcacggattctgtccaattccacatctcaacttgtcttcactctcctgtggcctccgattcttctgcaggatggcggtgggaggcttcatggggctgatgtggtgttctcagccaccaccacggtcacggtcaatgtggaggatgttcaggacatggcccctgtc

SEQ ID NO: 7267 - DNA, 995 bp, mus musculus; identical to SEQ ID NO: 7266

SEQ ID NO: 7268 - DNA, 1909 bp, mus musculus
attttcttattagtcatcagttccgtctacaccatcccaaataggagtgccctaaacaaaatctttatagactgacaagtcctttccagcgtcctgctgcatgagggctgtttgctgtgggatgtcaactcttagtatattaactggaccttagtgcgtagtgtgacggaatgcaaattgcattgaacacatttttatagcatggcttgtggtgctggaaaccagaaaagacagatcccagggctttgccccacacactagttacaggattgaggattcctctggtttgttcagccactgctctgctgcctcctgcctcccaggctgggatgagctaaagaacaggccatctaattctgctcactggtttcgagccacggaaggagaccttaacctttaattataacgtttacttatggtttccttaaagctaagccagtgctactctggtttggggtgagtggggaaagcctactagagtccagttgcccagctctcagcagcacaaggcctggtcagagcttccttccttaaggagcaaacacacaagactgcatgaaagaaataggacaggaaaaggaatcctaaagcaagcaactgtgttaaaatccaagcaggtattgacttcttttgtacaaagaagtaaaatttttcccacaacaactacttttctctttttatcaatatttaattttctgtaaccacacttcaccaccacttttctaataacttttaactgcaaagttatgtgaccatttttctctgcctgagaaaatgggatttttttttcttttcttctgaatactgccctccccgcagcccctcccaaccccccgccctgtgacaacctcagaacatcaaaggcaagtgttttatgcaccgtgtacattcactgtctggctctctgccaggctggaggggagagcagagacttgtgctggccaggtcaggctctgtgcacagggatttgggctgcgggggaagctgctctttatcctcttctgccttagagcaggcaagatgggaacactcttcttagcatcttttaatccatgttgtctgtgctctgtcactcccgcttctgagtattcccaatagtcaaaagaattttgcccagtttccctcagtcctttgcattacacattataaattacatttgaagacacatctttgcataaggcatcaggccctgtaagccaccccatccccatccccactcaacactcactggtgagatgataagccattttttaaatgtttattttattttatttttttgagatggagtctcactctatcacccaggcttgagtgcagtggtgcgatcttggctcactgcaacctccacatcccgggttcaagggattctcctgcctcagcctcctgagtagctgggattacaggcgcccgccaccactcctggctaattttttttttttttttttttttgtagagactggggttttaccatgttggccaggctggctttgtactcctgacctcaggtgatccacccactttggcctcccaaaatgctgagattacagcatgagccactgtgcttgccaaaccattttttttcaagtaggttagttttcaaaagctgtgtggtctcattttactgttttttgtttgtttgtttgtttgaagagtcattactttattgaagcacattttacatatataatttattccaagtatacaattaagagattttttataataaaaaaattagctgagcctggggtgacatgcacctgtggtctcagctacttgacagcctgaggtgggaggatcacttgagcccaggaggtcaaggctgcagtgagctgtgattacaccactgcactccagcctgggtgacaaagtgagaccctgtctcaaaaaaaaaaaaaaaagattttttagt

SEQ ID NO: 7269 - DNA, 958 bp, mus musculus
attcctgtcatacatgtttgcctgagcgtggcactgacacctcgtggagtttgacctttctagaaatgaataatttgatttctcaggaaagtagtgaacgtaaggtaagctttagcaatatcaaagcagcacatcgattaaatatctgcctgagaattctctctgggtttctgtattccaaaaggcttacaataaaattaactccaaagttactgaactgagaaatgtacaattactgtcttgttgatgcaataaaatagaaaggactgtttaggcatttaattggcacccaacaacatacgatggtatgttagttagacatcaattatgacagaatgctaattgacatttgataagcattctcactgataaccaatgtttgctctgccaaattaaatgcctcagtgggctgtgtctgacagctgggagggggtttactaaacggctgcaagtgcctggcatcctccagatggctggggctttctctagaacatcctgctactccttgggaaatacttccagggtcaagtgattgacttctcctcgttgcttctgggaaaagaagtcacccttctcagggagcctggcctcgcttaccttcaatgcccaataccttcatcttcccatcacctgtcttctcttctcagtctgtgcagccccacatttcagcccactttctgtagcctttacagtcaagcctatttgaatgctaaacctggctccaccattttctagctgtgggccctgactctgggcttcggtttcccctttctgcaacaggaatcttgcctaagtattaggactaatgggaagaaagtggtgacctcaatttttagcacagagctggagctcagtaactttgattttctgttctctcccctcgttttcccttctggcctcctattcctactcctgggctatggctttgtgccacactgttagactgtgaccctgatgc

SEQ ID NO: 7270 - DNA, 1507 bp, mus musculus
tctgtgtgaagggtaggggacacaaagtacaatgaagccacctctgcccctgaggatcagacagattaatcaatgattgggtctcagggtgacacctgcaacaatagaggaaaatgcagggtattgggagagtagtggggagtggggtggggtcacttaaatccagcaggaggtggaagtcagaagaggaggcaacacttgagctgagttgtgagggatgagtaggaataagatgaataattggagatggagggggcatgccagatattcatttctattcagcaggtcttctgtttttgagctggaatttaatgcgggtctctgtgttaggtacaggggatttggtggtgacaaacctgatgattacccactttcatggagttttcagctagaggtgaggtaggcattacacaaaaaatggctcagtcacactgaagagtcacaaattatgatgtctatgaagaaaaaggtgaggatgtgaagatgtgaaatggtgttgctgggggaccccattcagatgcaaggtataggaaggcccctgaggaagcactactcaaacttggggcaaaaggtgagaatgtgggaaaagggcactggcatgggaggagcatcctggattctggaaagaaggaagtggaggtgccaaggaccagagggacgaagggatatgttggagtagagcagggtaaggctgcaggggaagtaagggtaggagcaggtaaggcaggtaaggctgtaggggaggtgaggctggggagaggtaaggctggcagggaaaggggtaattaggttggggggaaggtatagctagggggaaggtaaggctgggggcgtgattaggttagggggaaggtaaggcttggggagagataaggctggggggcaggtaaagctggggggtaattaggttggggggaagatatagctagggggaaggtaaggcttggaggaggtaaggctgggagggtgattaggttggctatgggaagaagtgagagtgggaggtgggaggtgagactgggggaggggaggtaaggcctcttgtgagggaggcatctcagccaaggtgaggaccagccggtcgatcctggcagtccaggctgttcaaggtggggaccgtgactcaatccagggtaggctttgaagatacccctgaggctactgggctgggtggctggcaagctggggcaactctgagccctgggcatggagaggctgccctggggtctgctaggtgcccgtggtgtccccttcagccttcagtctggtcctagatggggaggagctggttagggtggggcaggaaagtcctgactcatctgcagcttagactgggatcctcacttaggagtcagtgcctgaggctgggagctgtagtggttgtgatggagctgctgcttctgagagtgctgaatggggccatctgtggaatgaacagagcagaacagactctggttctttataacactccacttgggtttcataagagaaggaagctctatctgtg

SEQ ID NO: 7271 - DNA, 1391 bp, mus musculus
caccagagtgtctgccttggataaaaagaatggtggtacctagaatagagataaaaaatacacgaggaaaagcaaacttggaagcaaagatggagagctcaagtttagattgttgagtggcatgtgtctatgggacagccacctatgtaaatctagaaggaatttgttcagtaagacctgaaaccaagggagggctggaagtggtgattcgtgagtcagtggcacaaatgggagtacaaacagtaatgttccagtcagatgaaggaacatcaattaaggagactgagaaagtataatcagaaggataagataagagagaatggagagtctgatgtaacaggaagtacaggaaaagagtttccaaaaagcaaagagttttccataaagtgaaagaaaatttttaaaaatccactaagataatgactgaagagtatcctctcatttttttaaaaaagggaaaccaatagattgtaatagtttgaaggaagactgggaacacaaatgaaatcaaaatatgtaagaaaaggtaagaaaagtggtggccacagtggaactcaaaatgaaaagatttttaaaaattattaaactgcagcctgctgcatatctcaagttaaatgttctgcaggcacagcaagatcagcatcttcaaacttcatctcatttccactcaatattttttatgagacttcagtgtatttataggaggagagaaaggaagcagtagagatgataatggtgaaaacataggaaagataagggataactagtagagaacaatcctagaagagatgagagggactggtatcatgatcacactgaggaggctttgttcagctataagtagagacaattcccgtcctctgaatctggaggtaagaaggtggtttaggcaatggatgaagtcttgctgtagagcaaggtgagtttgaaatatatcagtgaggtcatactgtcatctttcaagagtgaaaagggttaggttggatgaagatttttgaggacagtggtgaaagtttaaaattatttttgaggggatcagaggtaggagaagactaagaaaaaaataaggaaaatattgagtgggctctgcctgagtgtgcaaattccctcagtagcctgagtgggatagagatgtactgcaatgctgatctcaaaaagctgagggttgtactaaatgggtgcagtagcacaagggtactctgtagtttagggtgtgggtgagagagttgttggatggaatatccatgaggctctgacagagtagagaagtaagtaagaccagatgagacctacaaaaataagtaaaagagaaaggataaaaaataaatgtggaggtctctctgatgtaaaacaacagagaatcatgggatcaggagtaaaaaagaaatgga

SEQ ID NO: 7272 - DNA, 633 bp, mus musculus
attcctttttcagagaacatgtagacaaaacaagtctaaagggtgatccaattaaataaatttctgtctctgggggctaggacctctgagttggttctcaaagtctgcatgtttcacattcagtacctaacaagatattcctcactgtaagcttaaagtaagcaatgacatcacaatatgcattactctgagttgttttcaaaacgtgctgaccctctgaaagtttccaaatggcttctttgtgtgctgttacagaccatctggctagctgtagataaacaagtttcaacatatgggccatagcacatacatggctctgctccactagcgcagaaaattaagaaagggatgctctcatgatatgagtagctaactcatgcaagagaagcaggaccatgtagtggagggcctgacctaagtggcacacagaatagcttaattccagtttcttctcttccactcactgggcatgtcgctggatcacagcaagtcttctttgtttcctcatataaacatttttaaaaagtgccagtgaactcttgcctctctctccttccctccctccttctcattaaaacatacccattgttggcctaccatatatatgttcccagcatggtgctaggtaatggg

SEQ ID NO: 7273 - DNA, 839 bp, mus musculus
ggagatgaaaattctcatctctcataccagaaaatcattaaatattgtctaaaaattgttaagtaaaaaatagaaagaaatagtggttatttagaaatacaaatataaatttcagaagaaactgctagcatgctcaaagtggccacaattggaaatggaagaatgaagacagtaccattgctaattgcatcactgcccctgctccaccaccgcacacacaaatatatttataaaaccattacaatttaacattataccccatatattattttgataatacatatttgattgtttttctgtttgcaagcactgtaatttattgacttattatgttctgtttattttttaaataatgtattacttaaatttgtattgtcatatatgctaatttatagaaatgtacttatgcactgtaatgactagtttgtaggagagtggtatgtatctatattatggtaattctttttatatggctggttgtacttctggacatgtaactcatgtttgtaatgttgctgggatttttatatcatgttaatgtggccatgaattgctatgacaaatgttccatatatcttcgtttccatcagttctttcttgtgtcttgtcagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaaggtaagcttgtttctcttacactatatttctgtacttctga

SEQ ID NO: 7274 - DNA, 260 bp, mus musculus
gttggttttattatgaaaagtccactttgaacagtaggttcatttctcattttaaaaattccatgctctaatgctgtggtggggagatgaaaacaatctttattgaagcataagtggaaattctagaattgtactgaggcatcctgacataaattccagtctgggaagtaatctaaaagttagtctcttacaaaggtgtttctatttaagcagaggccatacctaaaggaattttattattctaggagtgtgtttcataa

SEQ ID NO: 7275 - DNA, 1252 bp, mus musculus
gagcagtggtgagttccacagactaggaagggaaggaagggtgggtctagtgtttacatgcttccctgagttgtggaggaagttagtgcacaaggtctttaatgcaggcatgagggtggttagggcctcaacggatggtggccttgggattagaaagcaagagatacgtgtacgagatttaggagggaaattcaatgggaaaaatagagaaagcgggacaagaagataagattttgagcgtgggtgactggaagaatgatgtcactgacagaaatgatagtctacaggggcagctaattttggaggagggttgggcattcactctcaggagtgctgatctggtaatgattacacaacccaaaatcactgcagagtggacatttggaagtgtgagattggcactcacggggtgggcctggacaaatggatgtttttcttaattcactatttatcaaacacccaccatggaccaggctctgtgctagggatgcaaaatcaaagaaggctccaattcatccttgaaaggaggagatcttttttcttttttttttttttttttttttttttttttgagatggagtatcgctcttttgcccaggccggactgcggtggcgctgtctcggctcactgcaagctcctcctcccgggttcacactattctcctgcctcagcctcccgagtagctgggactacaggcgcccgccaccgcacccggctaattttttgtatttttagtagagacggggtttcaccgtattagccaggatggtctcgatctcctgactttgtgatccacccgcctcggtctgaaaggaggagatcttaatcagagtcatctaacagagatcaagagatcagtttctaaaacacagagggaaaaaggagcgttcaaggcagtggctttcaaaggcacggcctgggcacacccacctccatccatcctgcccttcacagggcagagtgggccattgtgggatccatgttgaaattttatgtattttttctgtaaatgttaacgaaccaagttggtttggatttgcattctagatgttgagtggaagagatatgacgcacagctgcacacgcagtctgcaggaacctgactgtgctgtctctgtatttaacagaggatggtcggggcataaagtagtcctagtcaagcagccgcacaatgctgagggctgactgggtgaatatcatgaaagctacgggtgctcttgtggatactgtgaaatgctgttatgttcttaa

SEQ ID NO: 7276 - DNA, 559 bp, mus musculus
ttatttttatagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacaggtatgtaagaaggattgggacaagatagaacttgggccatgggtggaatggtaaatcaatatctaattcctgaactgctcagtatccagtgaactagatttggaagcaaactacccagagattcaaactctgctttctgggttctgtgtctctttgaggaaacatagaaattgaaactctatgcctgggccaaactggtgacttatcctgctcatctgatgtctgacacacaatcaaaggacactctttagaagggtacaactgaaagtctgagtgagtaacccttgtggaagaaacaccagtggcacaacggtccctcttttagggatgccatgttcctattgactctagtcacacatgtcatcc

SEQ ID NO: 7277 - DNA, 1516 bp, mus musculus
caagaacaaaccagcacttcacccagcccagtccacccctccaccaggccccccagaggggttcaggctcaaagagggctgggaaatgctgtgaattaattaccatcagacctccggccactgttcatctctgtaaacaaacattttaatatgcagtaattaattacatctgccacagcgaccctcctctcgctcatccttcttcagcttttcttctgctcacactagaccaacctcctcctcccagttggagcctgaaagccaggcagagccccctctgtccatcgccccagccttctccccccaccatcagatgcaggtgctcgcatctgccatgctgctctgcagctttttgttcttttttctgtgtctctaatgcccgtctgtctttctgacagtcctttgtctccagttctctctgcctggatttctctccccaacaaagttccatgccagggacacattctgggaggaaggggcaaatgaggaagccagtggatctacccaaggtgcctgagcatgtttcaactcctcagtgggccaggaccacgctaatttacagggattatccaaagaccagaacaggccctgttccaggactctcctgccacaaccactgggttgtgagctcctgggagtccttctgacgctgtttcttctcctactccaccccctgcctccacagcagctctgcgtgaaaaacgcagaggggaaacaattgcccagttgagcccacctggctatgccacagttacttttcgccatagccggaaataccactgttggatccaccttctgcgccccaggcctccccagcctccgtacccaggaggcagccagcttagcagggtaggcatgtgggtggcccaccagctcctggaatggagcgtactccgtttctggggaggttccccgcgtcctgcctggagtctagaagggagcggggaagtgaccagcactagattagaggcgggaactccggatgagaaagagacgagggggccaggatcccagggctggcagcgacaggaaggatgggaagaggtccgcaggcccgacgggtgcgggccagcctggccgcgcagggggagctgggagctgggtgggcggggtggggcggacgccaccaggcgtggcgcggggaacagagcagaatgaaatgcagatgcaaaacgtgctcataagagtttcctctctctccccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccccgtttaacactatccccctcacctgcacgctcctggcccgcagcggaggtgggactggggagcagggcctgggactccgctggtgggggtacacgcaggggcactggcgggggcggggg

SEQ ID NO: 7278 - DNA, 1126 bp, mus musculus
aacttatgtacttaattttccttatctttaaaatggtataataatacgaatttttagctcacaagtttggtaggatttaatgaaatattacatctaagatacttagcacagtgcccagttctaaatcacttaatgatgctagttaatgaaaataataacaattttaccaagctcacattctataagatttatacttacaggaacacttaacaattatatatctaatcttcgtcagatagagaaagagacatatttgctatcctggtttctcggggttatcagagaggtaactggcaacctaatttcactacgttttgcttctttgggattctggtgtctgtctttttatttcatctttaacagctgctcgcattagccttttgggaatccagctaaagagtttttcatttttaggaagccacacgttctctatctttaaatcaaaggtgaaatgcagcatgccatggcaataatccaacatttgaaggccacatgcaccttccagtttaaactcattttctatgaagtcaaaactcatccttcgcttttgaaagtatccaaagcgattagctgagacagcagagaacaggcatgagaaggaggcccctggtggccaaaatgaggcttctccctctccgtttttaatggcatgcgaaaggcattaatccacactttcattttctcttagccaaatagaaatgtcttgagataatgtgaatgccttatggcataagtgactttctaaagtatcttattagaactccttatctgtgtaaattaggccgcattggggcttgatagccagaaacatatttcttaaaagctgacaaatgggagaagctcacaaaaagttaaccaaatgccacaggggaaacttccagaggacgcagcagctctagtgtgtttgcaaggctggtgcctttctgccatgtcacatgcaagtgacttccttgggggctgctttattcagaaatgaagtcagatttcccaaatgcttctcaagaaccatgaagaaaaactacatggtcacagatggatgttgggatattactgcagaaaacagacaaaaactttatccttgtagggtgttcaacacgcttttgagaatgataccctagatttcaag

SEQ ID NO: 7279 - DNA, 490 bp, mus musculus
cagagacaaaaagagtctcgttactctgagaaggagacagacttgtgctaagaagcacacacttaggaacatggaattgaagttggtcttgaaatcccaagcaactttttttttcccccaaaggcaagtctagtaatggcctcaggtactaggtggttctctcatcatgtaccatgtaaacacttttattaaatacttacttgcagttttataatatattcatttgtaatagcaagcatgatgttttgtcaatgctcttaagacattctgcaaatctcaaatgactgcaaaaataatgaaactgagtttttaaacatatatgccagaatttatgcatatatggtataaattttgttgttttcatatgtaaaataagagtataatacttactctttagaggctgcattttatgcaaagcctttagttttaggtttatataacaaatctcttagttaaccatagttttaaagattactgtctttataaagta

SEQ ID NO: 7280 - DNA, 412 bp, mus musculus
ccagatgtgggcagggtctgggtcagacttgaacccaggcccttctcatgggcacagtgcagagcatgcagtaggcacctggtaaatgcatcaagactggagacccaaactctctggggagcccttgtgctctcctccaagcttctttcttctcaaagtccctgcatttctagattccttatatatggaagcccgtggtgggtctgggtcctctctggggaagcaggggttgagctgagaggtctcaattctggaacatactgcctcactgcctaggtaagggccccgctccacactcagccttgcctctgtgcctattctcttttcttgtttctctttttgtgttggtggaggtgatgggggagaagaaatgattgcttttgagccagggttgatgcagccctggttgaat

SEQ ID NO: 7281 - DNA, 1587 bp, mus musculus
tctgacagctacaacagaggtggaaactacttataggcctataagagaggaagaaacagattcaagtggggagaactggtaggacttgtggcgggggccagtttttaactagaaattttgaactggctgggcgcggtggctcacgtctgtaatcccaaaactttgggaggccgaggcgggtggatgacctgaagtcaggagttcgagaccagcctgaccaacaaggtgaaaccccgtctctactaaaatacaaaaataagctgggcatggtggtgggcgcctgtaatctcagctacttgggaggctgaggcaggagaatcgcttgaacccaggaggcagaggttgcagtgaactgagatcatgccattgcactccagcctgggcaataagaccgaaactccatctcaaaaaaaaaaaaagaaaagaaaagaaaaaagaaattttgaaccatggccaagagataggagaattcagagatacttagcaaaagtgagtgtccagaggcatgaagtgccttagaattggtgttaggtgagcaatgcggcattccagaccgggactattggcagagcctttgattataggctaggacttgattttacatagggcattttggattttctctgttctatagatggagaattccatccatatgaaatctgttgaaaaattgcctgttcttttccatcttcttgttttggtagttttcaataattgccatctgttccaatattaacttgtaaactctaagcagatagctacatgtaaggacttacagcgttgtttcctaaagtgtgtttcgctgcagaaggaggcgttccaccaaaagatgacttcatggccaagtgtctgtgtgcaaggctgcgtactgcactcctgtcttgtagagattacacattagcatattaatggttctaagaagtaacattccttttttactttttataccaaagagtttctcaatgtatttggtcacagaccctgtacatcttatcatcccacgaaacaagatggggggaaatgttggacttaggtacacttcatagtttttatatatgctttatgtaagtttttcatagtccccataccatccttatcaggtacacattattgtccccattactcaaatgagaacttaaggttaagtgactcttccaagttcacaagccaagaaaagagcaaaaatttgtacctaaattctcctaatctgggaaccattccaccacactgtactacctcttagattcatgtgtatcatttcagtgagcaccagcgtgtcccatccttctctggaccctgtctctagaagtcctttataaatgtacttctaccttggcttttccagtcatagcatgtagcacgaaatccttaattgtccactgtgtaacacctttcatgacatgtgctgttccatgtggcactgactactccagagtccctgggaacattatgctttttttgcacactcgtctccattttccacgctatacgctccttatatgcaaggtactcttagtagttgcagcatctgtccaccgtccttggctccgtagtatcaccgggtgcttctttactaaatgagagtat

SEQ ID NO: 7282 - DNA, 805 bp, mus musculus
tagtatttttaagtagcttttctgaatgtagtctctagaatctgtctccgctgcagtctactcagttgttgcttttttcttttcctcaagtcttatctttattttatgaggctggtttcctaggggttgcccctttgtgtgcatagcttagtggtcagccaatgactgggcagagattgtattcaaaaacctccaacccataaggcttacatcctctgcagtgatctgtgtgtgggttgcagagcacattcaaagttcagccagttcccaagcttgccttggctttggcttctcactggtgtctctcaggtcttcccagcacatatatatactttcccactccataagagatgcatagagagcttatctagcacttctgtggctctttcatttccaggatctccccatcacatttttggttggcctgttacccgccccaactaggactgtaactttaggctagcagaggtgtgggttttcaccattcattacctaccgagtttgctacttttattgacaatgctgctaggcctgggttttgccctctgctccaaatcaagtcagcctcttctggcagccccaccctggtaaaaccatcattctagccaactaagctaaggggtgaggtggggttgttcttacccaaaattctgccagttttctatgaataagcacttctcaacttgttttttgcctttggtcgtcatccagatcactaaaagacgttttttttttttttggtgcattctccagttttatacttgttttgtgaatttgccgacctcttcgctcatagctggaagtc

SEQ ID NO: 7283 - DNA, 642 bp, mus musculus
ttttctatatgccaccaccatattagtcttcctaaaattctgctttcactaatcacctcacttcaatggcatttggttattcttaggttaaaatgagaggattaagctgggtaactctaagatggcttcttttaaattttatccttctgggtcactaaactagctcagaaaccatcatgagttcagtatttcagccatgttaaagtcaaacatgtcagtctgcttctaagacaccctgtgttcagttgataaacctactgttctcatccttgtatctgagagtttgtgcaattattttcttttttagaacatgcttctcttctctctgttgtgttccctatacatccttcaaaggcctaatacaaactccgaaatgcttgaatgaagcattctccggcctctttagccgtttaggatgctcccacctttgccctgctttggcagcggttctctctctgttcatttgacacttaatcatatactatcatattgttatttagcattattcactcattaggcaacatttcttgagcactgtgatttttctgtattttattttcctgatgagattataagctgtttcagagttaggaaatgtgtcacaggtttctttgtttttccattggaagtattcctcttggg

SEQ ID NO: 7284 - DNA, 1098 bp, mus musculus
tatcagtgttatgcttgcttcaggaaaagaaattcactgttttccttatatcttcataatttagatcaatttatatagtttttggattatctggtgtctcaaagtatttttgctttttgttcataatacagtttttaaaaaacttcatcagcaaaacaaaacaaaaactttcttcatttcagctatggttactgggtgagaaatagacaaatttgcagggactataacatttaaagacaagaaggaatcaagaaatggaaatgaaaagcactggaaagacaaaaagaacatcattaaatcaaaacactgcaactgtctctccccaaaagataagagagccattgatttaaacaaatttcttccaccatacagaagccattactttcaactgtgaggcctcagaccttctctcagtgtttccctacacggggaaagactttcactttctgagggtcatttaatctgtatttcatcacccttaggcaccctttttcctttcttctatctaccattgagtggttacttaactctttctgcattggtgtgggcttcagagctgaagttagatgtttatttccctatttacatgtaatttcaagttttgcaaaatcctctgtttccttcttagcttgtatacataacttataggtagttttatttggttttcgtattgagaggtcttttttacattatttttccttttggaaacttaaacatttttaattaaaaaattttgaattaaaaaaatttaattgttattttgtaggaactttggctactgtcattgccttttttaaaacttacatagagaaaatttaccttttagtatacagtgaattggcaaaaatattcagttatgtaaccaccactgcaatcaagatatagaatactttgatgatcccagaatgtaccctcctgcctatttatactcagtgcctgcgttccagccccagcccctgatctgttttcctaattttgctttttccaatatgtcgtacaaatggaataatatgctatgtatcctcttcggtctggctttttagatttaccatagtgcatttgagattatatttgttcatttgtcagtaataatggtag

SEQ ID NO: 7285 - DNA, 997 bp, mus musculus
atgcatgtgtgtttctttcaacctcagttaacacactatcaacagagctgaatatctgttcatgttacctggaggtcacttcttcctgccaagaaactcagagtgggtcatgaggggaagggcaataagagtgctcctgatggcagggagaaaccggagcagatacacagccccactcagcttcagattagtctaaattaagtagtgtggcctatggaggggtctcagcttggagggcaacctgatagtgaagctagaatctcagtctatcgatgtactaaattgatggcaatgaaaagaattcttcccagacacaaaagtacacttgtttccagattaatgtatcctcaatgtaagcttttcagcccctgctctgaaggagttaacgcgtgcttgcttcagggcagaggcacagccacggttgtattattttttgaagtatttgcttgcagaggtgacctgaccacttgctcatgaatacactgaagcactattctttcctaacatctcatgatgccaattcacaaggacactaaagagtttgtttaaagtggtggcgacagagggacaacccagaatgcctgctggagggacattacaagtttccctctggcagaatcgaaagtcatctttagacacctgcccccactgctttccccgccatttcctccttccacttgctatggagcatctcaattacttgctgttaagcatcttggccttatctttgtgtaaccaatgcctgtttttctactcaaaaatgactaacaggaattcagggtattgtgttgaattttaatgggttattttgtttctcatatgctgattttctaaaggcctcacagtggcttcctctctcctccttccttaaaaagaagattgagaatcctcatctctgatgatgttgagagtcagcatctttctaacagctagaaagggtcagtggtataagactgtggaggaaaaaaatcgtaggggaaccatttattttatattt

SEQ ID NO: 7286 - DNA, 933 bp, mus musculus
ttaattgcagctaaaagcatcccactggacgcagcaccctctccctcccagcagcttggcattagggagcccagcatcctgaaaatcccactgagctcccaggaaatagtaatatctgcctcaccagccccacattgccccatcttccccaatggctgtttgccaactttattgcatcaaatctattgaagtttttgttgttgttgttttaacttcgcagggaaggctgttctatggtgctgtgagtcatcctgggaagcagcagccctagtgctaaggcaggatgcagatcagtctgttccagtacccacctcccctctctcctcccccgcaaagggcagtttcctctggaatccatgcacatgcaatttatttctaactgctccagcaggttccaatcctgttgcttgctgcgtctagttattcacttggaatcagagctgctggaaagtcaaaattagcctcattctaccagcatgaaatagaaacacagaggcagtcccttggctttagggaggcaagaatctagaatttttcttatctctctgtgaataccagagctgagggttacatgggtctgtgattacacagtcatttggaaattgtgcaagttggaagcagcactgtcattgacttcctgttaagaggaggcagcaggagaagccttccagagagggacacagggcagccatctggttggaagtcattgtgcttacataagttgtctgttcacttaaggaggcaagggttaagcaggctgcaaggcaaggagtgtgaatgaccctaagccatgcttgacaccatgcattaatgatgttttttatcttctgtagtttataaagctttgacatcctgaggccttgctaatcctggagagactccccttccagggctagctaatttctagagatagtaaacaatttgcctgccaac

SEQ ID NO: 7287 - DNA, 1406 bp, mus musculus
tgctgtcaacaaccacatagaatcaccagggacaccaatatagacctgtgaaggggccgtactgatcaggttaaggaatagtaatggctcatttctacctcacgcgaggctgcacaggcccgggtctgggaagccagggctctggtttttgttctgttagagacagtctgggagggctctggggcgtgggttcgtcccaaggaaaagctggggtttgagatgcccccactggtgaggctgagttgcatctgaggcctcggctggccccagagacccagtttggactttctgggctccatcatttggctcctggtctctcctgccagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaaggtagggctgagtttgggggccacggaggaggaggatctgattgggagagattgtgggagcactgggagggggtaggattccagaagttggtcttgagccacctgcgaggagggggtccatgcaggctggggaggcagacttggccgcctggggttacacctgcatccgagagttcctggggttcccaccagtgctgggcatttgttctcgtgggcttgacgcctgtcctctgccctgctgtgtcagaatgaagaggtgttgaagagatgtgcgcaggagtacctgtcccgggtgaagaaggaggagcagaggtaccaggccctgaaggtgcacgcggaggagaaactggacaggtaacatttagccactgggggtggctcccaggggcctcccagcagcccttttacccaggcaggctgggacctctggcagcgcctgtgacattggcttggaaagggggcatcatccaagtgtgtgtttcaataagactcgagagaaggcacacagttagcatcatttaatcagtggaggatgcgtgttgcaatgtccagggtgccccggcaccttggtctcatggcaatggaattgggtttggtgttctcatgggctcctgtgctccagctccagttggtggcagctggggccagaccaggccactctccctgcctggacctgggaagcaggaggtgtctctagtgatccacaaaagagtgataattctgagctccctgtctccgcagggccaatgctgagattgctcaggttcgaggcaaggcccagcaggagcaagccgcccaccaggccagcctgcggaaggagcagctgcgagtggacgccctggaaaggacgctggagcagaaggtaataggggaggggtgtggcctccaggtgggccgggctgctgctctctgtgctgctg

SEQ ID NO: 7288 - DNA, 1406 bp, mus musculus; identical to SEQ ID NO: 7287

SEQ ID NO: 7289 - DNA, 1769 bp, mus musculus
gatgttaattactgtggtagatgatgataacgatggctccggtgaatcacacctccctgtgtccacaccccttggctttgcggtgccacccatcaacagatggagtctatttctacatcctcttgagtctgggttggccctggagcttgctttggccaacagagtgtggcagaagtaacatggtagcattcagtagtttggagctcaatgtgccttgcagcttctgctctggcctcttggagtcttgggaccgtgtagtgcaggggcctctactaacctgctggagggaacgcggccatgtggaggagaacctcagcccgaccaccagccccaattgccagacatgtgagtaaggccatctggaaccttctagcccagtcgaccctcctgtggaatgcagcctcatgagtgactccagaagaaaccctgcaaaggatttcttcagccaaccctcagaatcataagaagtaattaattgttgttttaaatcactaagtttgggggtggtttattaccctgcaagagctaactgaaatacataccttttgaattaagcaaatccactttagtagtttatacttagaaaataaaaatccagaaaatagcccatgatttaggtacaaaggcattccttatagcattgttgtaatacaaagcatcagcgtgattttaggtgcctaacagcaggaattaaacagaatagggtagatctgtacactagacaatcattacaaagtttttgttgaagcaacctagtggcaagatttccagaatatactgttaactggaaaactaaaacaattttttaaagtatgcaaatatgatctattaaaatatgcatattctaaatatattttaatgaaattgatgggtccaaaagcatatgcaactttgatctgatagtataaactcgctctctaatgtggatgtgataattcgtcttcctcccaacactgaggaaccttgctgctgctttctgtcgctgttgctggtggtaaagggcccttgactgacacatttgagaggctggtcaatccatgcacagagctgatatgagttaaggcaaaggaagcttcaacctttatttcacttagcaggattccctggtttcttggccacccagagacaccttcttgggactcatttctcatccaaccgaaggggcctgatgtgctcctggactcctttaaggagagagaaactttgggtgcagcatcacgaattgtaagcaggaagccaggcttctgagagtcagatggaactgcagctgggagcaggggggttgtcatttgtctgccctgagccaccagaaagggttcagtgagtcttgaacacagtgattaacttctctttaatctacgcatcactgcacagcacagccaattgcttggcttccccaataagagtcatgagtcactcaatgtcttaatgtggactgagcacgttttattccaagcaggtgcgactgttcctgtatgtgcctttgagatacctaggaaatgaataatgcttgttgtccccctccaacaccaactgaacattgaatcaatggtttactattttaataacaagtgaatattgctctaagactcctttttttttttttttttttgcttgttcagtgccagagggataggttcccatttcttttcctggctgttgggtcacggctgagggtccctgggatgtggggcatctccgtaagtaacaggaagtatattaactcgtgggttaattaagaaaatcattgacgaaaccacatgagtgtg

SEQ ID NO: 7290 - DNA, 1001 bp, mus musculus
gggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaacttggtttcttttctgtgtactttgcaaaaattctatttttaattttgttcatatgttgaatgtgcccctaattggcatcttaaagagaatagtaagcatctattaaccaaaaaagaactctaatagtaaaggaaagggaaatattggtggtatgtacccacaaaacccccaagtgccaagttaatggaatctctgctttccctttcagatgctagaaagccactgtaatgagttcttgcagtttagcatccagtctaagctactgcattgtttaaagagcagcatcaaggacactttctccaaactggaactctcttctttgtcaaatcttgtactttaaaattctacaattctgttacattgttgtttaaatcacagactgctcagatccattttactgcagtagtttccaagtgtgtaacttggctttagtatttatcagttgccagaaagaaacaggttgtcatttggaagtttttgtggttattttttcccatttttattcttcagataaaagcagtaccccaaaatagaaaatgaaaattttcatgaaacaaagagaactcccttgttaaaaccagcttattaactctgtattctgtcaaa

SEQ ID NO: 7291 - DNA, 1001 bp, mus musculus; identical to SEQ ID NO: 7290

SEQ ID NO: 7292 - DNA, 1184 bp, mus musculus
agggaagtgattctctgctccctagcttttgccccagtccacttatttgcctttttagttcaatgtgaaggtgtttcaggctataaagaactatcctatggttcatgggcattaccaatccacatttctatgttcttggccatgcatcttcaataagaaagatcctatcgccaaatgctttcaaaagaagcaatctcagtaaatgaattatgctctaataaaaaattgatgggatataatatctgaattaggagatctgaagaagcacatgagaagaagaataaagttctaatggttgctattgttcaggcagtgcccttcccagatcttccatcagccgacacagagctggagggccctttatttaaatgttctgagtcaccgacacggcctccactatgtttgtaggtagatgaaaaatgccttctattaatgagtgttcttggacttaattaaaattgataccactttcctcttaataagaacagaaaatggtcccaaatttgaatctgttctcgtgaagaagatagcatcaagaactgggaatgaaacaaatgcaatttttttctcattacaacattcacattttgacctcaaggactttcttagggccctattcttcgttccctcctcccagccactgcttttactgtgcaaagcaatggtacaatttttccctcttgaaaaagaagtcgttgccccgacgtcttgagttgtctgtggggctccagggcatcctctaagtccctaaataggttgagttgaacaactctgcagtaggtgagaaaatattctgccattcacgggatgtgattttgcataaaatggctactgaagaatcctatatagaagcaagaataggatgcatttctacctgctggtggccacattggcagttgctgcattgggctcacctggaattttgggttatgatgatactgcatccgttggctttaagtaaaagagggaggggtgaggcgaaacccaccaaaatccctaaaaccttttcgacatctgtaatgtcccatttgtgccaaccagaacctaacgcccgtgatctgctcaacaggcaggtgatgacatgctttttgggtacgatatatacaccaggccattagtctgcaagcagcagttgtcagctttgttcccatttagagtaattttctcactaatatagcatattc

SEQ ID NO: 7293 - DNA, 531 bp, mus musculus
acacatgcagagtgtttggatcagggcctcgacgtcagggggccaaattatattattcccatcatcactgtcagcttcctaagtgttttattactgagctatgaccgtgtctagcacaatgcttggcatggggcgagggttcagtaaaggttgccatagagctctcccaaaccctggtctgaacgtgtgtctccaaactccctgtcacttctgctattcatgaatctccttttctggccaagttcagtatcacactcttgtgcattcacacatccagcactcctaccttctcatcaggcattcccctctgccagcacccatctaccacttccttctagttatgtcagcccctccctcatttccccaacctctgtgacctccccatcccacccacccacctggagggcccgagctctgcatcacacctgcatcctagtgagggatcagcctcctgtgctctgtgaagcacaagtccgtgaggttcaccctgtgacaggagctgggtcaggcaggtggcaggtagcaggtgtg

SEQ ID NO: 7294 - DNA, 252 bp, mus musculus
aaagctataaaagtgtatgcccagcgatccgacaaatcattttcaaatttcatatgaatggtttcttgatgaaagaaaataattataacatatctggcattttggcagaattatactgagtaaggcaggggaacctgtgttcatgttaagtatcagccaagccagagatttgtgcggctctgctgttagagatggtaatcaggaaaaccataacaacgtgtttatgcagcactcaaatctggctaaacttct

SEQ ID NO: 7295 - DNA, 1014 bp, mus musculus
tgagtccactgggagcattgccaagcggctgcagtcccttaacgccgagaacaccaaagagaactggcgcttctactgtcagctgctgctgacagctgacgactgcgtgaacccctgcatcggggacgtcatcctcttccaccagacactctaccagaagaaggatgatgggcgtcctttcccccaagttgtcatgtccaagggtggtgttgggggcagcaaggtagacaagggcgtggtctcccttgcagggacaaatggcgagaccaccacccaagggttgtatgggctgtctgagtgctgtgcccagtacaagaaggatggagctgacttcaccaagtggcattgtgttctgaagattggggaacacaccccctcagcccttgccgtcatggaaaataccaacgtcctggcctgtcatgccagcatctgctagcagagtggcattgtgcccattgcggagcctgagatcccccctaatggggaccatgacttgaagcactgccagtgtgtgaccaagaaggtgctgactgctgtctacaaggctctgagtgatcaacacatctatcttggagggcatcttgctgaaccccagcatggtcaccccaggccatccctgcatccagaagttttctcacgaggagattgccatggtgactgtcacaacgctgcaccgcacagtgccccccgctgtccctgggatcacattcctgtctggaggccagaatgaggaggaggcatccatcaacctcaacgccattaacaagtgctccctgtgaccttctcctatggccgagccctgcaggcctctgccctgaaggcctggggcaggaagaaggagaacctgaaggctgcccaggaggagtcaagtgagccgtggccaacagcctggcctgtcaaggaaagtacaccccaagcagtgagactggggctgctgctagagagtccctcttcatctctaaccatacctactaagtggaggtgttccccggctgttcccaacactccaggccc

SEQ ID NO: 7296 - DNA, 521 bp, mus musculus
aatagaaaagaaaacaactctaaagtcaataattgaagcctctaccttggaaaatgaaataacaaagacaatgtaagcctaaaacaggcagaagaaaagatgtaataagaattataactgaaatcaatacaattaaaacaagaaatcaacagagaaaatatatttaaaaaatcaaaagccagctctttgaagacaacattaaaattggtaaacctccggccagcccaaataacacaaaaacaaagaagacaaaaattacaaacatcagaaatgaaaaaggagtcattactactgatcccagtgatgttaaaaaagaaaaaagaaatgttattaacaattctatgctcataatttggataagttacatgacatggaccaatcccttgagagacacaaactgccaaaactcaaacaaggaaaaattgacaattggaataggcctaaaattattgaagacattgaatcaacaattaataactttccaaaaataaaccaccaggcccagatggttccatgggtaa

SEQ ID NO: 7297 - DNA, 2369 bp, mus musculus
cagtgcatctcaatgcatgcttctccaaaggtcagaacagactccttcctatcttgtttccaaaaaaaaaaaaacatttatttttgtatgtttgccttagctcatttccagattaaagaagagagcagtggcctcagctcagtgattaattacatgaactccttacgtggtattcgaccaatataagcccattaagagaaaggctgggttcttgttgtggcctactgaagactctctactctcatctcctgaagagcagtaagagagaccaatgacatggagtggcggaaccatagtgggagagtgagtgagtttgtgttgctgggcttccctgctcctgcgccactacaggtactattgtttgcccttttgctgctggcctatgtgttggtgctgactgagaacacactcatcattatggcaattaggaaccattctaccctccacaaacccatgtacttttttctagctaatatgtcctttctggagatctggtatgtcactgtcactattcccaagatgcttgctggctttgttggatccaaacaggatcatggacagctaatctcctttgagggatgcatgacacagctctactttttccttggcttgggctgcactgagtgtgtccttctcgctgttatggcctatgatcgctatatggccatctgctatcctctccactacccagtcattgtcagtggccggctgtgtgtgcagatggctgctggctcttgggctggaggttttggcatctccatggtcaaagtttttcttatttctggcctctcttactgtggccccaacatcatcaaccactttttctgtgatgtctctccattgctcaacctctcatgcactgatatgtccacagcagagcttacagatttcatcctggccatttttattcttctagggccactctctgtcactggggcctcctatgtggccattactggtgctgtgatgcacattccttcggctgctggacgctataaggccttttccacctgtgcctctcatctcactgttgtgataatcttctatgcagccagtatcttcatctatgctcggccaaaggcactctcagcttttgacaccaacaagttggtctctgtactgtatgctgtcattgtaccattgctcaatcccatcatttactgcctgcgcaatcaagaggtcaagagagccctatgctgtactctgcacctgtaccagcaccaggatcctgaccccaagaaagctagcagaaatgtatagaagggatgtgtgaaatctgataaaatgctattaaacttgggatcaatgtgttctatgaagtccagtggagttcttagggcctaaattgggggccagagtttcaaaggcatcactatggaactaggaatactttctttaactagtccaagaggagagagaggaataggttgcaagctagaaaatggatttctgcaggacagggccataaaatacaggatagagctgggtccactattgtctgtccctttgtaatttgcatagacaaggttccaatcaaggaagcacaggcttcattacggaaaagcaacacaagactttttgataagatctctattaggtagcagaggcccaggagatatcattctagcgtgtgttacaaggcaaggagataagaaactaggaatttttgttttgggaacatatcacctatcaaaacataatggtttctaggtttattttcaaatttactgtggtcagtgtccacattgaactagtggctgagtgcagttgtttcatcaatactctgtctccctgattagactataagcaccatggtgacaggatcagattttcttttacatccttttattaccatgggcaggaacagtatctagtgcatgatggctatgaatatgtataatgaatgaatatagtttggaaccatgtaggcaaggcatgtgtgtcatgcctatatgtggggttggcaggtgcaggaagtaaacccctcatactttactagtatgcagagagatacaaattggctcagccttgccagaaaaaaattttgaaaatatgtattacaaatcctaaaaatattgcaaccattctgattcggaaagatttgtgcagatagacacttttacttataaatacagaaacaaggaaaggaaataagcaaaatatgctcaactttcgcaaacagggcactggtcaaataaattgtagctcatatgttacatggaaaactatgcagaaattgaaataaagtgatctaaatagagttaatgaaagaaaaaatatttctaacttaataaaaatattatgttatataacagtatcaaaaatatcagccatatttgcttgtttaaacaagactagaaggaatatga

SEQ ID NO: 7298 - DNA, 2321 bp, mus musculus
ggagggagcaggcagaacaaagacgcccttgatgggggattcagggaggcccgggctgcttctcagggctcagacggggctgcctgcacgcgccggaccagccgccagccctgagggcttttctgttctcctaggtcagtttcattgacacggagaactcaggaaatgtttttttggggggttttgtgtgcgtgtgtgcgtgtgtgcgtgcgtgcgtgtgtgtgtgtgtgtgtgtgtctttttttcttcctttctttctctctctctctgtctctctcttttcttttctttctttcattttgagacagggtctagctctgtcacccaggtgcccaggctggagtgcagtggtgcgatcttggctcactacagcctccgcctcctggactcaagtgatcccctcacctcagcctccccagtagctgggcctacaggctggccccaccatgcccatctaattattttatttttttgtggagatggaagtctccctatgttgcccaggctggtctcaaactcctaggctcaagcaatcctcccccctcctagccaggcctggtagtgtgagctcgtagtccagctacttgggaggctcaggcaggaggatcccaccacggccctccagcagcctgggcaacagagtcttaggccaggcgcggtggctcacgcctgtaatcccagcactttgggaggctgaggtgagtggatcatctgaggttaggagtttgagaccagcctgaccaacatggcaaaacctcatgtctactgaaaatacaaaattagccaggcgtcgtggtgcatacctataatcccagctactcgggaggctgaggcaggagaatcactggaacccaggaggcggaggttgcagtgagccgagatcacaccactgcactccagcatgggcaacagagcgagactccatctcaaaaaagagaaaaaaaaaagggaccaggcgcggttgttcatacctgtaatcccagcactttgggaggccgaggcgggtggatcacctgacgtcaggagttcgagaccagcctgaccaacatggtgaaaccccatctctactaaaactacaaaacttagctggacgtggtggtgggagcctgtagtcccagctacttgggaagctgagacaggagaatcactagaacccgggaaatggaggttgcagtgagccgggattgcgccactgcactccagcctgggggacagggcgagactccatctcaaaaggaaaaaaaaaaaggcccctgcgcctgggtacgagctgggctcccggttgtggtccaagcctgggtgcgagctgggctcccggttgtggtccaagcctgggtgcgagctgggctcccggttgtcgtccaagcctgggtgcgagctgggctcccggttgtcgtccaagcctgggtgcgagctgggctcccggttgtcgtccaagcctgggtgcgagctgggcttccggttgtggtccaagcctacaggactaggaaaaggagggagggtgagggagcctggagctgggtcctcctgcaggaccagtcctttctgccacaaacagccctggctgggggcccaaaatgccccctggttcccccttgctgtcctccacacctgcagaggtgagacaggtcactactctttgagcctcagtttcctcgtctgtacaatgggtccaaagagccatcaggagtccctgagctcttgaatcgggctgttttgggtgaccagggccctcccagcagcctgggcagctagaccctgcatacagccaggctggtgacttcggccagctcagtgtccaggggaaggcacagagcagtggccgagttcactttagtcccctcttcctgggcagctccaccacctttctcagggactctgccctcttcgggaggagcctggggcctctcagcctggctcctggactttggccccagctggcctggcctggcccccagccagcaggagcctcgtctgcccagaggccaacagagtgaggagtggagggtgggtggggctttcctgcctctccccgatgaggacactggggaccagagagagggtgagagtctggtgggaagtctctccagccaggtgggggccggatcagattggccctgacagtgggtggggggcacctgagcccgggtccatggtttgcttttttctaagttatcacacagtaaaagccatgtgtacgtgggggtgtggttctgttgccaccatagtcgacccatcagccccatcactccaaacctgtgaatccccgaccttggtggctacccccaacctctggcaacacctgcctgccttcatcacca

SEQ ID NO: 7299 - DNA, 1547 bp, mus musculus
tgcaacatctttccatgccaccactacctatccaaccccatcacaccctgagaccacacttcccactcacgttccacctttctccacctccttggtgactccaagtactcacacagtcatcacccctacccacgcacagatggccacatctgcctccaaccactcagcgccaacaggtaccattcctccaccaacaacgctcaaggccacagggtccacccacacagccccaccaataacgccgaccaccagtgggaccagccaagcccacagctcattcagcacaaacaaaacacctacctcgctacattcacacacttcctccacacaccatcctgaagtcaccccaacttctactaccacgattactcccaaccccactagtacacgcaccagaacccctgtggcccacaccaactcagccaccagcagcaggccaccaccacccttcaccacacactccccacctacagggagcagtcccttctcttccacaggtcccatgacggcaacatccttcaagaccaccactacctatccaaccccatcacaccctcagaccacacttcccactcacgttccacctttctccacctctttggtgactccaagtactcacacagtcatcacccctacccatgcacagatggccacttctgcctccatccactcaatgccaacaggcacgattcctccaccgacaacgctcaaggccacagggtccacccacacagcgccaacaatgacgctgaccaccagcgggaccagccaagccctgagctcattaaacacagccaaaacctctacatccctacattcacacacttcctccacacaccatgctgaagccacctcaacttctaccaccaacatcacccccaaccccaccagtacaggaaccccaccaatgacagtgaccaccagtgggaccagccaatcccgaagctcatttagcacggccaaaacctctacatccctacattcacacacttcctccacacaccatcctgaagtcacctcaacttctaccaccagcatcacccccaaccacaccagtacaggcaccagaacccctgtggcccacaccacgtcggccaccagcagcaggctacccacacccttcaccacacactccccacctacagggaccactcccatctcttccacaggtcctgtcactgcaacatccttccagaccaccactacctatccaaccccatcacaccctcacaccacacttcccactcacgttccatctttctccacctccttggtgactccaagtactcacacggtcatcatccctacccacacacagatggccacttctgcctccatccactcaatgccaacaggcaccattcctccaccgaccacgatcaaggccacagggtccacccacacagccccaccaatgacaccgaccaccagtgggaccagccaatccccaagctcatttagcacggccaaaacttctacatccctaccttaccacacttcctcaacacaccatcctgaagtcaccccaacttctaccaccaacatca

SEQ ID NO: 7300 - DNA, 1465 bp, mus musculus
gcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgaggtgggggcgcgcccggtgtgccgcggagggggtgggggacgcggctttcccggcaagagcctgagcagcggctgaccgcccgcccgcctgccttctgacttcccgtcgaccacgccctgcgtccagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggtgaggccacagggctcccgggcatcgtctggcattcgcgggggcgggggtgccgggcaggggcgaggccaccacgtgccgcgtgtgccggtgtctctgctttctggctgctctgctgagtgcaggccacaggcatgaggcttacgcctgccggtacctgcagctccccagtaccatagggactgtcccagggttgttctcgggggacagtgaggcacaggcagggcccgctgcagttcaccaagttgtgaccctgagacaccagggtcctgtcccccagctgggggtggggccagccggctctgctgtccagcagcctgacccccaccgcgtctgcccaggcacttgcaccaacgacaggaaggatgagtgccgcacgcctagggggacggtggtcgcttcctgctccgagatgtccggctctggaacgtgagcataccctgaccagccagcctgccaccggcctcacccgacgcccaccacggtcgggcccaccacagttgggtctaccacggtcgggcccaccacagttgggtctaccacggtcgggcccaccacaccgcctgctccgtgcctgccatcacccatctgccagctgattctgagcaagtgagacttgggtgcaagggagggagggtcagtgtggccgccccacctcccacccttccaagggctggaggggaagaagcgcattttcagggggctcctgagaggaaacgagagctgctggtaccacagaccaaggaggggtgggtgttggggagaagtgggtgccggggaggggtgggcagtggggaggggcgggtgccgggaaggggtggttgtggctggaatgctgccaaggggtcaccagggttggccggctgggccgtctctgaggctctctgctggctcaggtgtatggacgggggcatcggtcaccacccccaggcagcttccaggtttgcagggcaggggctgggggggccaggaagaa

SEQ ID NO: 7301 - DNA, 994 bp, mus musculus
tgctgcccaggtggctccgccttgttccctgcctccgcagccccgcctcactccaggccctgcccctgcactgccccttataagccccgccccctctggctctggcccccccagtattccccacccatgcctctggggccctacccactcctggctccaccccctccccatcgaggctgtgggcgtccagccagaaggcccaggacagcctttcactcactccctccctcctctctccattctgtactccagacaccactaactgtatggaaatgatgacggggcggctttccaaatgtggtaagaatcccccacgctcacctggcacctccacctgccacttcaccgctcaccctcagcccgctgtggccgccacctgccgcccgggttgtcccggcctccctgtgtagatgtaggcacccagcagcccagatgtccccggccccatcctctaccaggagcagcccaggtcgctcccctaccacagcaagcccaggcggggttcctggccagactcacctctgccaggccctaggatcagggcaggcccaagaaggggctcccaaggcctgaagccagtgagggtcccgctggtcccactggtgcaggctgtggcctaggggaggggccggtgcccatccctctgtccactggaggctgtgcctggcagggagcggaggggcccacagctcagggctcaggtgggggttaggcttaggaagtgggattgaggggcctccatcgacacacctgggcagtgagcacagggccccaagaagggtgggctccccatttccgcccctcttctcaggactgcccccatcccagggacccgggacatgactctagctgcttgcccccagccccccagcctgcctcccacatccacccctccatgcttgtccacccatctgttcatctgtctgtctgctgctaaactgtgtccaagctggccaggggtcgggcttcaggcctctctggggaggtgtggtgg

SEQ ID NO: 7302 - DNA, 994 bp, mus musculus; identical to SEQ ID NO: 7301

SEQ ID NO: 7303 - DNA, 994 bp, mus musculus; identical to SEQ ID NO: 7301

SEQ ID NO: 7304 - DNA, 1178 bp, mus musculus
cccggctcttccgggcagggcctgactgcagcctgtctgctgcagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccaggtgcgcgccatgccgggaggggcaccccacacctcgtcctgcatctgcatgagaccctgcagcacccccagcccctacctgccctgtgggggcttccagagaatcccatggctgatctcagcccactgtttctgcagctgtagcctcccagggggccctgtctccaagatgggcctgggaggagccagccatccgtggtgagaggggggtcagtcccaagcacttgccatgcaccctgagccctgcaccctcgagctggatgggatgggctgcagaggcaggaagggggctgcagaggcaggaatggggctacagaggcaggaagggggctgcgcagactggaaaggggctgcagaggctggaagggggctgcgcaggcaggaagagggctgcagaggcaggaagggactgcagaggctggaagggggctgcagagctggaagagggttgcagaggcaggaaggggcagcagagcctggaagggggtacgcaggctggaagggggctgcagagactggaagggggcaacagaggcaggaagggggctgcaggctcaggagccaggcagagggagcaggtgggaacaagagcatgggcagggaggcttcctggagacaggggcaccctggcagcccaggtcagcagtgtcctctctgccccagcgtgggagcagccctggcactttctgattagaagaacccacttccccagagaaaattatcctgcttgggggtgaccagagcgcctgggccaagtggcctgtttccagctgagtggttggaggtcgggatggtaggagggaagggtcagggaaagggagggtggcccacggcccccggagctggggtcagcgttctcctgccccatggcagggctgcggtggaggaggatgcctacagccgcatgaagctggtgctgcggtggtacctgtctggcttctacaagaag

SEQ ID NO: 7305 - DNA, 865 bp, mus musculus
ttctcttctttgtggaagcttgccacactttcccaggaatgttctgtcaatgaccaatttgtagtctctagcaatcttttgagaggaacgttattatggcacttattggtttatagtctggctgtgtctttacttgcctttctcctggcacaagtttgtgagctttcagagacaaaggaacacatttcatttatttctcagtctttcatcctcatcactactttcttacaaagtaaatctgaacgtaaatttgtaacataaataagccttatgggcttcccactatcttagcacagattagggattttcagtgctagctgggtctaacaggtttctgtaaggctatagcagtctctttaatgttacccagaccctataatattttgtaatttcatcagccttggcttctccccatcagcatcctgaggatggcctccctgatgggcttggacttcatactgtaaatgatggggtggagcacagaaggcatcaccaggtacacataggtaacaagagcatgtacaatgtggggcaggtgcctcccaaaatggtggatcatggacacggtgatacctggaataaagaagacaaagacagccggaatgtgggaaacgcaggtgttgagggcccagatgcgctccctgggagcagccagacccatgactgtgtgcaggatgaaggtataggacagaaagatgagcagcgagtctaagccccctgtagaaacaaccacgtagaccccatagcatatattgatcgtgatgtccgcacaggcccgcctcattacatcagggtggaaacagaacgagtgggatgggatgttatcaccagggcagaaatttagactcttaaccggaaatggcac

SEQ ID NO: 7306 - DNA, 543 bp, mus musculus
aggaagaggcacaaggtaacttgagccacaatggccagcccaatcctgatgatgacactatttgtgaggacagctgcatagtgcagggggttggagatggccacaaagtggtcaaaggatatggccaggagcactgaggactccaccacagaggagtgcaggaagaacatctggaccaggcaggcattgaagcccatgagccggtggtcaaaccagagcacagccaaggtgatgggcagtgtggacaaggtgaggcccgctttggggagcgccagcatggacaggaagtagcacatgggctggtgcaggctggggttcctcttcacagccaggaggatcaggcagttcccagggagggccacagtgtacatggaggagaaggggatggcgagccagccatgaaccgcctccagccctgggatgccaatcatgagaagagcaggcggttggaagaaggagatgttgacataggtctgggaagggagcatcctagggaggcagccgaaggctctggagagatgtgagttcttcaatctgagtaga

SEQ ID NO: 7307 - DNA, 542 bp, mus musculus
aagaggcacaaggtaacttgagccacaatggccagcccaatcctgatgatgacactatttgtgaggacagctgcatagtgcagggggttggagatggccacaaagtggtcaaaggatatggccaggagcactgaggactccaccacagaggagtgcaggaagaacatctggaccaggcaggcattgaagcccatgagccggtggtcaaaccagagcacagccaaggtgatgggcagtgtggacaaggtgaggcccgctttggggagcgccagcatggacaggaagtagcacatgggctggtgcaggctggggttcctcttcacagccaggaggatcaggcagttcccagggagggccacagtgtacatggaggagaaggggatggcgagccagccatgaaccgcctccagccctgggatgccaatcatgagaagagcaggcggttggaagaaggagatgttgacataggtctgggaagggagcatcctagggaggcagccgaaggctctggagagatgtgagttcttcaatctgagtagata

SEQ ID NO: 7308 - DNA, 1229 bp, mus musculus
ggagagtttccagttgtggattgcctttccgttctgtgccacgtatgctgtggctgttgttggaaatatcactctcctccatgtaatcagaattgaccacaccctgcatgagcccatgtacctctttctggccatgctggccatcactgacctggtcctctcctcctccactcaacctaagatgttggccatattctggtttcatgctcatgagattcagtaccatgcctgcctcatccaggtgttcttcatccatgccttttcttctgtggagtctggggtgctcatggctatggccctggactgctacgtggctatctgcttcccactccgacactctagcatcctgaccccatcggtcgtgatcaaactggggaccatcgtgatgctgagagggctgctgtgggtgagccccttctgcttcatggtgtctaggatgcccttctgccaacaccaagccattccccagtcatactgtgagcacatggctgtgctgaagttggtgtgtgctgatacaagcataagtcgtgggaatgggctctttgtggccttctctgtggctggctttgatatgattgtcattggtatgtcatacgtgatgattttgagagctgtgcttcagttgccctcaggtgaagcccgcctcaaagcttttagcacacgttcctcccatatctgtgtcatcttggctctttatatcccagcccttttttctttcctcacctaccgctttggccatgatgtgccccgagttgtacacatcctgtttgctaatctctatctactgatacctcccatgctcaaccccatcatttatggagttagaaccaaacagatcggggacagggttatccaaggatgttgtggaaacatcccctgagcaaagggtcagtgtatccccatcacttacattgccccactaatgtggggacattaatgaacatttgacaggctattacttattatcactaagtcagctctgtaaataactggctcagaggtaagcaaccctctagaggcaagagaaacaattttcagggtacctagaaaagagatacctgagagatgtgatggataagaacaactttgttgactacatattcatcatcacatggaaacaataaaagtagttttacctattaaatcagtgaatattttaaaagaatgtcatctcccacagatgattaaggtaaaaaagttgtttttacactgtcagtagaagtaggtac

SEQ ID NO: 7309 - DNA, 1221 bp, mus musculus
tctaccccattttgaatgacataagtacgaaaaacaacagtaacatcatgtcatgttgtaacatattatttattaaaacagttgaaattattctagtttataatcaaacccaatcaccctggtatccaatagtcccatccaaaagccttgtatataataataacacttgttttgattgttatcatctgcagagagtagattgcgttcccagcagagaccatattaaccagtccatggtgctggcttcagggaacagctcttctcatcctgtgtccttcatcctgcttggaatcccaggcctggagagtttccagttgtggattgcctttccgttctgtgccacgtatgctgtggctgttgttggaaatatcactctcctccatgtaatcagaattgaccacaccctgcatgagcccatgtacctctttctggccatgctggccatcactgacctggtcctctcctcctccactcaacctaagatgttggccatattctggtttcatgctcatgagattcagtaccatgcctgcctcatccaggtgttcttcatccatgccttttcttctgtggagtctggggtgctcatggctatggccctggactgctacgtggctatctgcttcccactccgacactctagcatcctgaccccatcggtcgtgatcaaactggggaccatcgtgatgctgagagggctgctgtgggtgagccccttctgcttcatggtgtctaggatgcccttctgccaacaccaagccattccccagtcatactgtgagcacatggctgtgctgaagttggtgtgtgctgatacaagcataagtcgtgggaatgggctctttgtggccttctctgtggctggctttgatatgattgtcattggtatgtcatacgtgatgattttgagagctgtgcttcagttgccctcaggtgaagcccgcctcaaagcttttagcacacgttcctcccatatctgtgtcatcttggctctttatatcccagcccttttttctttcctcacctaccgctttggccatgatgtgccccgagttgtacacatcctgtttgctaatctctatctactgatacctcccatgctcaaccccatcatttatggagttagaaccaaacagatcggggacagggttatccaaggatgttgtggaaacatcccctgagcaaagggtcagtgtatccccatcacttacattgccccac

SEQ ID NO: 7310 - DNA, 900 bp, mus musculus
tttcttctcactggattttctggcatggagcagcaatacccctggctttccatccccttctcctcaatctatgccatggtgcttttgggcaattgcatggttctccatgtgatatggactgagccaagcctgcaccagcctatgttttacttcctgtccatgctggccctcactgacctgtgcatggggctgtccactgtgtacacagtgctggggatcctgtgggggatcattcgagagatcagcttggattcctgcattgcccagtcctatttcatccatggtctgtccttcatggagtcctctgtcctcctcactatggcctttgaccggtacattgcaatttgcaatccactacgttattcctccatcctgactaattccagaattatcaaaattgggctcactataataggtaggagttttttctttattacaccccccatcatctgtctgaaattttttaattactgtcatttccacatcctttctcactctttctgcctgcaccaggatcttctccgcttagcctgttcagacatccgattcaatagttactatgccctgatgctggttatttgcatactgttgttggatgctatactcatccttttctcctacatcctgattcttaagtcagtcctggcagttgcctctcaggaagagaggcataaattatttcagacctgcatctcccacatctgtgctgtccttgtgttctacatccctatcattagcctcacaatggtgcaccgttttggcaagcacctttcccccgtggcccacgttctcattggcaacatctacatccttttcccacctttaatgaatcccatcatctacagtgtcaagacccaacagattcataccagaatgcttagactcttttctctgaaaaga

SEQ ID NO: 7311 - DNA, 1003 bp, mus musculus
tttggaggtcatcacccctaaaaaatatcttctccacctgcaaaacctaccatgtggtataacaacagtgctggccccttcttgctgactggcttcttgggctcagaggcagttcactaccggatctctatgtccttctttgtcatctacttctccgtcctttttggaaatggcactcttcttgtcctcatttggaatgatcacagcctccatgagcccatgtactacttcctggctatgctggcagacacggaccttgggatgacattcactacaatgcccacagtcctgggtgtcctgctgctagaccagagggagattgcccatgctgcctgtttcacccaatccttcattcattcactggccattgtagaatcaggtatcttgcttgttttggcctatgactgtttcattgccatccgcacaccactgaggtacaactgcattcttaccaattcccgagtgatgaacataggactgggggtactgatgagaggttttatgtccattttgcccataattctttcactctactgctacccatattgtggttcccgtgccctcttgcacacattttgcctccatcaagatgtcataaaactcgcctgtgctgatatcacgtttaatcacatatatccaattattcagacttctttgactgtctttttagatgctctaatcatcatcttttcttatatactaatcctcaagacagtgatgggcattgcgtctggacaagaggaagctaaatctctcaacacttgtgtctcccatattagctgtgtcctagtatttcacatcactgtgatgggactgtcattcattcacaggtttgggaaacatgcacctcatgtggtccccattaccatgagctatgtccattttctctttcctccattcgtgaatcctatcatttatagcatcaagaccaagcagattcaaagaagcattattcgcctattttctgggcagagtagggcttgagcccttatttcagaatctc

SEQ ID NO: 7312 - DNA, 989 bp, mus musculus
gagtgaagatcctgaatctgaagacacattcatcagtcatgtcccaggtgactaacaccacacaagaaggcatctacttcatcctcacggacatccctggatttgaggcctcccacatctggatctccatccccgtctgctgtctctacaccatctccatcatgggcaataccaccatcctcactgtcattcgcacagagccatctgtccaccagcgcatgtatctgtttctctccatgctggccctgacggacctgggtctcaccctcaccaccctacccacagtcatgcagcttctctggttcaacgttcgtagaatcagctctgaggcctgttttgctcagtttttcttccttcatggattctcctttatggagtcttctgtcctcctggctatgtccgttgactgctatgtggccatctgctgtcccctccattatgcctccatcctcaccaatgaagtcattggtagaactgggttagccatcatttgctgctgtgttctggcggttcttccctcccttttcttactcaagcgactgcctttctgccactcccaccttctctctcgctcctattgcctccaccaggatatgatccgcctggtctgtgctgacatcaggctcaacagctggtatggatttgctcttgccttgctcattattatcgtggatcctctgctcattgtgatctcctatacacttattctgaaaaatatcttgggcacagccacctgggctgagcgactccgtgccctcaataactgcctgtcccacattctagctgtcctggtcctctacattcccatggttggtgtatctatgactcatcgctttgccaagcatgcctctccactggtccatgttatcatggccaatatctacctgctggcacccccggtgatgaaccccatcatttacagtgtaaagaacaagcagatccaatggggaatgttaaatttcctttccctcaaaaatatgcattcaaga

SEQ ID NO: 7313 - DNA, 989 bp, mus musculus
tcttgaatgcatatttttgagggaaaggaaatttaacattccccattggatctgcttgttctttacactgtaaatgatggggttcatcaccgggggtgccagcaggtagatattggccatgataacatggaccagtggagaggcatgcttggcaaagcgatgagtcatagatacaccaaccatgggaatgtagaggaccaggacagctagaatgtgggacaggcagttattgagggcacggagtcgctcagcccaggtggctgtgcccaagatatttttcagaataagtgtataggagatcacaatgagcagaggatccacgataataatgagcaaggcaagagcaaatccataccagctgttgagcctgatgtcagcacagaccaggcggatcatatcctggtggaggcaataggagcgagagagaaggtgggagtggcagaaaggcagtcgcttgagtaagaaaagggagggaagaaccgccagaacacagcagcaaatgatggctaacccagttctaccaatgacttcattggtgaggatggaggcataatggaggggacagcagatggccacatagcagtcaacggacatagccaggaggacagaagactccataaaggagaatccatgaaggaagaaaaactgagcaaaacaggcctcagagctgattctacgaacgttgaaccagagaagctgcatgactgtgggtagggtggtgagggtgagacccaggtccgtcagggccagcatggagagaaacagatacatgcgctggtggacagatggctctgtgcgaatgacagtgaggatggtggtattgcccatgatggagatggtgtagagacagcagacggggatggagatccagatgtgggaggcctcaaatccagggatgtccgtgaggatgaagtagatgccttcttgtgtggtgttagtcacctgggacatgactgatgaatgtgtcttcagattcaggatcttcactc

SEQ ID NO: 7314 - DNA, 989 bp, mus musculus; identical to SEQ ID NO: 7313

SEQ ID NO: 7315 - DNA, 961 bp, mus musculus
attacccagcaacaactccacttccccagtctttgaattcttcctcatttgtttccccagtttccagagctggcagcactggctgtctctgcccctcagcctcctcttcctcctggccatgggggccaatgccacccttctgatcaccatctatctggaagcctctctgcaccagcccctgtactacctgctcagcctcctctccctgctggacatcgtactctgcctcaccgtcatccccaaggtcctggccatcttctggtttgacctcagatcaatcagcttccctgcctgcttccttcaggtgttcatcatgaacagttttctgactatggagtcctgcacattcatgatcatggcctatgaccgctatgtggccatctgcaagcccctacagtactcatccatcatcactgatcaatttgtcgctagggctgccatctttgttgtggccaggaatggccttcttactatgcctatccccatactttcttctcgactcagatactgtgcaggacacatcatcaagaactgcatctgtactaacgtgtctgtgtctaaactctcttgtgatgacatcaccttgaatcagagctaccagtttgttataggttggaccctgctgggctctgacctcatccttattgttctctcttacttttttatcttgaaaactgtgctaaggattaagggtgagggagatatggccaaagctctaggtacttgtggttcccacttcatcctcatcctcttcttcaccacagtcctgctggttctggtcatcactaacctggccaggaagagaattcctccggatgtccccatcctgctcaacatcctgcaccaccttattcccccagctctgaaccccattgtttatggtgtgagaaccaaggagatcaagcagggaatccagaacctgctgaggaggttgtaaaaaataaaatgaatgcaacctgac

SEQ ID NO: 7316 - DNA, 1225 bp, mus musculus
agaaagtgttcaccttcgtgttaactgagataatagatatgtatgaaaggaggttaattggggtcacccaacattcattgctcccttccttcttccctccctgccttcctcctttccacagtgtggccacattagccaccaacagggcccaggaggagacctgagccatgtcccctactggtggccccacatgtggtgactccagactataggctctaggcagaagcaggaactgtgttgtggtatagctcttccaccaccccttctcaaccatggggtctcagaggggaccgggcataggcaccagctgtctgctctttgggtaggctgaccctcaccaagcctcccacctggcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccaggtgaggctcacaggcctgttgattttgggccaggggtggagggagtgtgtgctgctggagtaggataggacactcactcactactcccatccctcctcctagctcacctggacaggttttgctcatggagaaggctttgaggatggagaattttggaaggtgggtaaggggacctgctttaccacgggatagctggaggaggggcatcattttgatactgattcctcaatccccttcccaaggatgaacccagtgatgaggccccaatggagctgggactgaaggaacctgaggaggggacgttgaccttcccagctcagagcctcaggtgagctgccagatgcagtgagctggcagtgggatggatctgtctggaaggggccttgggacagctccatttatgggagccctgtgccaagtattaccatctgccttcagcccagagccgttgccccaagaggaggagaagcttcccccacggaataccaacccagggatcaaggtttgttcaagactgacacccattctgagtctggggccctcttatttgtcagacagcccctaatgttgtgctctgaggggtctcagcgcagttccccaggtcctgagttaggagttcttccagtctcagcacagagccctgtgtctgagctggaggcacttcagtttttaaatcaaccagcccaacagcc

SEQ ID NO: 7317 - DNA, 1225 bp, mus musculus; identical to SEQ ID NO: 7316

SEQ ID NO: 7318 - DNA, 1225 bp, mus musculus; identical to SEQ ID NO: 7316

SEQ ID NO: 7319 - DNA, 1225 bp, mus musculus; identical to SEQ ID NO: 7316

SEQ ID NO: 7320 - DNA, 1225 bp, mus musculus; identical to SEQ ID NO: 7316

SEQ ID NO: 7321 - DNA, 1225 bp, mus musculus; identical to SEQ ID NO: 7316

SEQ ID NO: 7322 - DNA, 1225 bp, mus musculus; identical to SEQ ID NO: 7316

SEQ ID NO: 7323 - DNA, 1233 bp, mus musculus
tgtcacaataaagtttattatgaaaacaggctggtgtggggacatggggacagataagtacatttaggttgggtggctcaggtgaagtagtgcggcttcttcacattgatgccatactcgctgagggcaggggtcaagtcctccatggttagagtgtacttgcggtcctgagggaagagggaagagcaccaactgagcacaggaatcccggacttcaatcccagatgggtgaccctgagtaagtcttacacctcccctacgattcagtttccccaaaggggtggcaggataagcctccactgttgtggaaggtaattactgattcattaagcctcccctcacaccttgctcttgctccgggagctgccggaggccgtgcccttcattttgcagtgctgtagggcatcattggcaatatctgagatgaatttctgggcagctaaggagatgagccgaattctagagagaaaaaacttagatgagaaggagatggacaacatactgcacaagcacccaaaactaacctgccctgggtttactcacatgcgtgggtctgaggcctcaaagccagcacggttcaggtagtaaccagtcactgcatctgggatctgagaaatcaattaagagaactgtcagcagagcgggaggagggtgagggaaatggataggcctgattatcaggaagctcacagtttgggtgagcagagggcaaacacagaagagcgactaggggagcaaatggaagagaacgctgaaaagcacgatgtggctgaaagttttgacagcaggctaggtggccttgttcgggcggaagcccaccgtaggcgtgtaatcttccagctgcatcaagaagtccaccaaaggcgtgctggacaccacgggcttcacgtctccgttggccgcgctcggcagtacgtaaaccccgttagatatggccccctccgggggcgccgcgccacccgccgacaccggagctggaggagaaccagcaaaatgagacacagaggtgggaggcgcagggccccagctaggtctgtctataccctctgccctcacccgccgctggacccagcccaagacgcttccctcgccctcacccgtcccggccctcacccgccccacgccgctcagctggctccccggcccgcgccgccaagggtcccgtgcccccagcagctgctccagccccaggtccccccgctgtccccgcggggctggccttgttctccgcgg

SEQ ID NO: 7324 - DNA, 1233 bp, mus musculus; identical to SEQ ID NO: 7323

SEQ ID NO: 7325 - DNA, 1233 bp, mus musculus
ccgcggagaacaaggccagccccgcggggacagcggggggacctggggctggagcagctgctgggggcacgggacccttggcggcgcgggccggggagccagctgagcggcgtggggcgggtgagggccgggacgggtgagggcgagggaagcgtcttgggctgggtccagcggcgggtgagggcagagggtatagacagacctagctggggccctgcgcctcccacctctgtgtctcattttgctggttctcctccagctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacggtgggcttccgcccgaacaaggccacctagcctgctgtcaaaactttcagccacatcgtgcttttcagcgttctcttccatttgctcccctagtcgctcttctgtgtttgccctctgctcacccaaactgtgagcttcctgataatcaggcctatccatttccctcaccctcctcccgctctgctgacagttctcttaattgatttctcagatcccagatgcagtgactggttactacctgaaccgtgctggctttgaggcctcagacccacgcatgtgagtaaacccagggcaggttagttttgggtgcttgtgcagtatgttgtccatctccttctcatctaagttttttctctctagaattcggctcatctccttagctgcccagaaattcatctcagatattgccaatgatgccctacagcactgcaaaatgaagggcacggcctccggcagctcccggagcaagagcaaggtgtgaggggaggcttaatgaatcagtaattaccttccacaacagtggaggcttatcctgccacccctttggggaaactgaatcgtaggggaggtgtaagacttactcagggtcacccatctgggattgaagtccgggattcctgtgctcagttggtgctcttccctcttccctcaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgaca

SEQ ID NO: 7326 - DNA, 984 bp, mus musculus
taaaacagattttaaaatatagaaagactgattacacataaatacataaacaatgaaaccctaaggtaaaaaaaaaaaagtctgaactttccttgaatgatacatctgttcatattaaccttcatgtatatattaatgaagatgaagccatcaaatttataacattttaatgtgctgttctcattagggttcatttagtcagcagctacttcgtctcatgaattccctgaaggacgggaatcacaccgctctgacggggttcatcctattgggcttaacagatgatccaatccttcgagtcatcctcttcatgatcatcctatctggtaatctcagcataattattcttatcagaatttcttctcagctccatcatcctatgtatttctttctgagccacttggcttttgctgacatggcctattcatcttctgtcacacccaacatgcttgtaaacttcctggtggagagaaatacagtctcctaccttggatgtgccatccagcttggttcagcggctttctttgcaacagtcgaatgcgtccttctggctgccatggcctatgaccgctttgtggcaatttgcagtccactgctttattcaaccaaaatgtccacacaagtcagtgtccagctactcttagtagtttacatagctggttttctcattgctgtctcctatactacttccttctattttttactcttctgtggaccaaatcaagtcaatcattttttctgtgatttcgctcccttacttgaactctcctgttctgatatcagtgtctccacagttgttctctcattttcttctggatccatcattgtggtcactgtgtgtgtcatagccgtctgctacatctatatcctcatcaccatcctgaagatgcgctccactgaggggcaccacaaggccttctccacctgcacttcccacctcactgtggttaccctgttctatgggaccattaccttcatttatgt

SEQ ID NO: 7327 - DNA, 1501 bp, mus musculus
cctcctgtgaactcctacagcactctgcagctccaaaaatacttggctcacttccccttaggaatgttttacgaaccctccactagactccataagaacaaagacaatgtcattgtcatacccatctccagcccagcaccaagcatgctatctggccccacacaaagcccagaagtatctgttgagttgaactgaaaacaccaacactgttaacataaaaataggttctgtcctaggaaaatcgttctcctggttccaaaaagaaatgagttcagtcttgccaagtctgttttagcagaataaagtcccatagctaatgacagcctttaactattggaaatgtaaagccacattttttttttcgtatggtaatgcaacaaagaggtaagaagcgtttgtttttaagtatctaatcatttcttattttttgcagcaggcgagagaacatgacaaaaggcaatcgtaccacagtgaccgaatttgtcctcatgggattcacagaccgtcctgagctgcagctccccctctttgtggtgttccttgtcatttatctcatcaccctggtgggaaaccttggcatgatcctgctgatcagagcagactcgcggctccacacccccatgtactacttcctcagtcacctggcattcattgatctgtgttactcatcttctattgggcccaagatgctgcaaaatgtattggtgaagaaaaaaaccatctccttttcaggctgttttgctcagctgtacttctccggtgcttttgccactacagaatgattcctcttggccacaatgccctacgaccgctacgtggccatctgcaaccccctgatttacacagctattatgacgcagcgggtctgcagggagttagtgataggggtctatacctatggcttccgaaactctgtgatacagacagctctgacgtttcagctgtctttctgcaactccgacgtcatccaccacttctactgtgctgacccccctctcctggccctctcctgctctgacacccacaacaaagaaaagcagctcatgatcttctctgcagtaaatctcactgggtccctccttaccatcttcatctcctacatttgcatcctcttttccattataaaaatccagtcttccgagggcaagtgcagagcattttccacccgtgcctcccacctcactgtcgtcaccatcttttatggcacactatttttcatgtacctgcagcaaccaaaagcggggaattcatggaagccaaacaaagtagtctctgtgttttatagtcttgtaattcccatgcttaaccctcttatctatcgcctgagaaacacagaagtaaaggatgccctgaaaaaaatgctagagggcaaagagttatagtgagtgagttaatggaacgcagcatactgaaagtttgatatattgacaaggtaatgtctctaattaagtttacatttagcaggccaactgctgtccaatcaggaagcaaacagtaatcc

SEQ ID NO: 7328 - DNA, 632 bp, mus musculus
tcatttgatcccagtgagctgacagctggagccctcctctgggagttaccaagagagggaggcctcaagtcagaggccggcgaggctgcacagacctggctcttcccttctgtgaaggtgacccatcaggacaccagcacctcctgctggccgccctgggggctgcaagccaccccttgggtatttgggagacattccttccagtttcttattttgcaaagaggactggggctcagagacaggaagagaactgctcaagttcacccagtcacactaagggggccagaccatgccctgttctcctctgtccccagggaagagccaggtgagtgtctgatcagggatccgggaagccaacagtcatacttggctcagaggactaatggtatccctctcagagcctgattctctggaagagacacctactggcctactggccaccccagtcaggctgcctgaagtcctgcaatccttccatggccaagtcctgggagtcagtattgcttaaaccccatcccctgcctcttggatcttcctaactcaatatactcaagactctcaacaggaatcttttcatcagacaagacaacccaggctccagcaagcaaatttctgtccatctgggaatgcca

SEQ ID NO: 7329 - DNA, 682 bp, mus musculus
tggggatctggtccctacccagatgggatcaggagcccagaatctgcatctatcttgggactctggaacctgtgccccttcctttatatgaagtctttatcctggcctaaatgtttctctgcaaagatcagaaagcaaagcttgaaggtgtacaagactaggagagtgtctgaaggggagtgaagaatatggtgtcccattcttcaaagcactgctggtgttgagggtcaccagagacaaactcagtgatggaaggcagagtctattcctgcttggcccagggatcacattgggaaggccttggggtccccaacaaaatagatcatgccacttttttgctctatattacccctttgacaaagcttggctgtgagctaaacattggggtccatctactgcacaccaccaatctacagccccctaccaaaggcggggttgggaagaaagcatgcagaaacagtccacaccaaatgtcccatggaatgggactcacagtttccaagaatgtgggagagggatgaacctcaaagattacgttgcacagccccatgctgcatagagagagagcagagctaaatggagtccagagcctaggttagaggccctatgctaaagaaaaaagatgagagcatccaaccccctatgggatttaaaataaaaatatctaaactgcaaaataaag

SEQ ID NO: 7330 - DNA, 5835 bp, mus musculus
ctccaggcatcataccatttcctccataaatgcttcagaatgtatctccaaaaggcctttcagaagtgtattggatgtgtggtatctgactagcaatttttaggtgtgcttacaaaggaatggagaataccatagttagagctttttaggtaggtacagtggaaagagaaaggagctgtggatttgagatggatccatttgtgatgaatcatggatttcagcctggattggcagaaggaaaggccaagaggtggctgatatactctaggaaaaaggcctaagggaacagaggcctggccaagttcagagagcagctgtcaggtagtgaatggtcaaaagatagacaggaagggaaattgtggtcagacagtagagggcaaggttttgagatgggtacgccaggttcagggtttgtgcaaaagtgtgggtgactcaagtggaagtggaattgatgtcagggaatcagttgtgagctaagagttttgagtggatccatccacatagctattgaagttgccagggtggagagagcgccctcagggagagcctggtgtgtgtgagggcaggagatggtgcacaattctgtgaagagtttgaagatgtggggtagttgctttactgcagagctggggcactgtggaatcggttgaaagcttagccagtggtggaagaagacaaggtgagaaaagtgcaagacaaccattctaaacagttttaaatgtattgtgctctgttggacattgctgcccactggttggagtggaggaaattaatgaggtagggggttaatactgaagaggaaaagaattgtgatacataggtggggttgaagcaggagcccttgagaggaaatgcagtgagcccctcttcctgttttatccctgagggatccctttgcatagtaaccccaatgcttttctggttggggtttgttttggtaggtagtctttgtgaagatctgtgttgcattctttacacttcacttacagggtttggatgggttgagtagagaaggggtggccgtccctgagtgaagcagtggtccagagaacccaccccagcattttcttgctgctggcgaccacttccctcttaaacatctagaaagcccttgatgcccaggactaaaggtagagtgaccccttttctgagcacatcatattccaaactttgtctctaaactaccagggaaggcatgcatgtctcctaggtaatagccatcaaacttagaggaaagaagcacattgtaggtgtcagagttttggagagctttgatttcaaaaagtcgtggatttgtagatgagctagaaattaaaacttgaaataattcttcttctcaaagatagtgtctcttgaaataattctttgagaatgatcatcactgaaggagatgagattaaaagggagttgagagaaaagaaggcctacctggccaaatgccagcatctcctggattctgaagcaaacaggagtctgtgcccatggacgttagacgtgggatgatttctcactatcttgccagacacctgtgtttaagggagtgactgaccgacacacttgcttacgtgtttttatgagttttagtgttgagagaaaagttctcctcttaggctatgtttagagttcacttcctgctgagtttactggtgtgtgtgcagcagaaatgccagttctggcctggcatgatggcatgtgcctgtagtcccagctactcagcaggctgaggcgggaggatcgcttggcccaggagttcaagtccagcctaggctgggaaacgtgtccctgtctcttaaaaaaaaaaatgaaaaagaaaactgtcagctctgctttatgcatcttctccttgaggatgatgatacttacttacatataaatcttgccttatagcatagagcatattttcatatacattgtttcttcagatttatatcctgtcctctcagaggagaaaattgatgtgtctggctgcagttgacataaaaacaccctactgtactttccatggcatagtggaaggaatgcgaattttgaaatcagtcctggtttgaattgtggctcctccttttactagctgtatgacttgggccttggttttcctgtttggtaaaatagaattggtaacatttacctcataggattgtgttacagtattaaatgaattaacataattaacacctgggaacaatgcttggcacacagtagataactggtaaagagaggccatagtcatgttaataacatagaaacagaaataacatcagcaccgaagaaaaggagagcatgcagctgttctaatcttgtttttttttgttgtttgtttgtttgttttctttgagacattgtcttggtctgtcgcccaggctggagtgcagtggcgcagtcaagatcactgcagccttgaagcctcgacctcctgggctcaagtgatccttccgcctcagcctcctgagtagctaggactccagaggtgcaccaccatgcccagctaatttttaaactttttgtagagatgggttcttgccatgttgcccagcctgatgtcaaagtcctggtttcaagagacctcccgccttggcctcccaaagtgctgggattacaggcatgagccaccatgcctggccttcctaatcctgttcattaacgtgattgctgtgaatggccttctccttggcagtcaacataccactttctcaaaggacaaagttatttaaatgagtttcatgttttaatgaaatttatatggatatgtaaggcaatattgaatgatataatagtaatttttactttttttaaaccaagaagtatgttttatttatttatttttttcttgtttttaccactacagcgacagtttccttgctatttttataaccagtgcttatgcagtcttggttttctatagctctcacagagactgcagacaaaatgcagatgttttacatgaaattgcaacttagtgaaaaccactctgtgaggagctgagctaatgacatctgtgtagctttcaggtgatctgctagaaaatggagcctaaaatatgcaggggcatggatttatatcataccccttagacagtcttccttaaatatcacttctttcagatggaattttgtgaagagttggacagtaattcaagaccccgagttctgtaatagcttctatattctgtatttccaactaaaggcagacccatagactttggaaaacaggtaaaaggattgacttcctaccagctagaaattggagccaagttagagccatgtaacttgtattcttgcttctattagaacattattttgtttaatccttatactagcctgggagggaagggggctgacctaacagttaattctttcttaagtatcaggtattggcctttccttccatgtacaaatgggaggctggctcagtgctgagggaccaggtgaaggagtgcattcctcccttctcttctctgtcatctcttgggtcacacatgctaggcaggagttgccctttgccttatctgtgcgactgctcatgatctggaaatgactgccatcactcctagataacaccagccctgggcttttgcggaatgaagcccacattacaaatcatgggattatagtgaccagggagaggtcctacttgggagggagtgattcttcctgaaggtgaaaaacagcagggcagggaggcgactaccttcatgaagtgctccttggtctgtatcctccttttcggttagaggcaggaagagtgaggggaatttcagccacagaagagtttgcgtgtgtgtcattttatcctctggtgacttttcctcttcgcagcagtgatcccagaaaacaggaaaaactgctatgatcacaatcagtttttaatgtaaagaaaagctgatgatggtttttcattgacacggcaaattcaggatttggggcctggggatgaagctgacggtctgtgaaagtgcaggcagccagctccttggatgaggtccaagtccaaaagcctaggggtaaaagtaaaaggatggcttaatttcaatggacacccgtggcatcttagatgttgtaccttcctgtggcttcttagcaactactctaccatgtggcggctgtgttagagggggtactacatccagaaagaagacacgtgccagtagaacttccatgctgcatcataggtggccacagagccattacttccctgtttagtttcaagttgtagatgtttcgtatttgcctaaacacaagatcggcttatgattacccgctggcttaccagcccactttttttctcactctgtttcttttctttttttttttttgagaaggagtcttactttgtcacccaggctgaagtgcagtggcacaatctcggctcactgcagcctccacctcccaggttcaagccattctcctgcctcagtctcccaagtagctgggattacaggcgtgcgccaccacgcccagctaatttttgtatttttagtagaaacagggtttcaccatgttggccaggctggtctcgaactcctgacctcaggtgacccacccgcctcggcctccgtaagtgctgggattacaggcatgagccactgcacctacccatctgtttcttcagcttctcattatctcaccaattctagagaaacagagttgctggttgtgtaggctaaactaaggccactgtgatgtcattgcttttgtctcctttgacaccctttttttttttttttgttactgggtcttgttctattgccaaggctggagtacagtggcacagtcaccactcactgcagcctcgacctcttgggctcaagtgatcctcctacctcagactcccaaatagcagggaccacaggcatgcacctccctgtccatgcctggctaatgtttttttttttttttttcggtagagatggggtctccctgtgttgtccaggctattggttaccttctttatcatagttcaatcctgagggtgtttccttggccttctgaatgtgtatgagggatgggatctgaaaagtctcctcctctggggctgatcttatgacagactttatgaagttctacccaagaatctttccttcgctcacacacttcgctcaccaaaggagctggtcctgtggcaggttcagaatctgtgaagtgaaaaacgtattaaaattttgtatggaatttgagaactgtgtagttctgtctgtactctctgctcttcagtcacaaacagctctcccagctgtcctcctcactcttgccttctttgttcttgttgctgaaaatgcccaacctggatgaaaacctctaagccttgctcttcctcctggctcttcgtttcggtagagcttttgttatacttctgtctatgatatctccctctttttctgcttaccttttccgttatttcaagtaaaactcatctgctattaccagattgtccttattttctttttgcgtgaaattaactagctttattgatttttctaataaaagaaatacatgctcattgaggaatatttggacaataacaaaaaatattaggaagaaagtaaaagtcacataatcccctatagcataattattgttaatttgtggtgtatcttgtcctttgggatcttcttcatatgtgttaacatatattgctttttcccccaaagtgccatcatttttcacttatattttgtaacctacttttctgactaatattacttggatatattccacagacagtacatacagagctactctataatgtttaatgctgcatagaattacattgtatggatgaattgttatttagttaacctgacgatggacttttgggttgtttctgttattaatagct

SEQ ID NO: 7331 - DNA, 5835 bp, mus musculus; identical to SEQ ID NO: 7330

SEQ ID NO: 7332 - DNA, 5835 bp, mus musculus; identical to SEQ ID NO: 7330

SEQ ID NO: 7333 - DNA, 986 bp, mus musculus
aaatgctcattgggcacctttagtgtgccagacatcatgtgggacaatgggatgtggcaggaacacttcagacccatccctcccttgtgtcaggtagaccagtgaaggcgatccctttactccactgggaatagcgtcatggaggcctgggatccagcaacgcacaaggagtgctgaccacagttctaaaaaaggaactgtgtcccttgctatcatggagcttcacagcttgcccaaaagctgacttttaatccttaaaagagcatgagcaattactctggctatatttatccttgttcctggagccacacagggatttggcctcgctctcccaaaatcttcagcttctcactcattcccatcagagacagtcatgtgtcctccgcctaaaagcaggggcccagcagaggcagactggcacatagctcggggaggctctcccaacaggccatttaatccaaggccagggaagaagttttagagtctcaggcaaaagacatatccttgcaccaaggggagccaagcaaggaaaaacagcttcttgccaagaatgctgccagctctgcgatcacttgctcggttgacttcactgggtgttttgacttccctaccccttttagacttaggaactctgtgatatgctcagcactcagccctggatgagtgagtgagcaaataagagaccacatctctaggaactgcacccaggcaacaatgacaggtatcatttactgaacatggtgtcaggcactgtcacccactttacatactgaacatggtgcccagcactgtcagccactttacatatacggtagagttcatcctcaccaaatccatgtggtgtggagcttctcaccctcacatcctagatggggaaacagatgcagggcagtcaagatgcctgccgatgtcttgcagggcataaacccagatctctctgactttagaattcccgggtgtcaggtttgagactacaaactgggaac

SEQ ID NO: 7334 - DNA, 381 bp, mus musculus
gcttggtggggagagaggacagaagagacccattgggtataatagatgttattcaaggccatgggattagatgaaatcccctaggaagagagtacagacagaagagagatgttctgaggctttggatggtcaaagcagtgtttagaggggtgagaggtgaagccagcaaggagactgagaaggactgagaaggtaggagaaaccccaggagaatgcatggtcacagaagccttaaaggacaaaatctgactggagtaggtggaagataaaacacggggtgaagacagggagtcagttaggcaaatcttccaggtagttttgttgcaaagtggagttgagacattagccggtaattggagaggatgtgggtttgagggaggg

SEQ ID NO: 7335 - DNA, 912 bp, mus musculus
tcctttctctccctacccacctgcaggcagagcgaacaccgctacaaaggatgggtgtgatcatgggctatattaacaaagatgcagtgtctaggaaggggagggtaaaatgagatgagcagagtgggaagctcaaggagacagggttacatggggaaatctctgaggcaactacaactgtccagccatcagaaaaggaaagtcccccagggatttgggcactattgcagaaacacctggccttgaaggaggatgaactagtagttttttgtggcccaaagggtagaaccaggacactaagtggaacagaggcaggctttggtttcacatatgcaagagtcagttctaataacaataaccagagatgagccacatctgtggggtacccaaatcaagtcggtgggccatgagggatgttatacagggattttgggccaggatgaccttgggcatccctgcaacacctcactgtgggcccagccctgcccctgctacttcccttcaatctgttgaggtggggtggctttggagcagtggtaggcttgtggagtcctctttcagttccccggctctgctcttgggagatctcacagtggaggaagctgctgggcccctggggaaatctcagagctggaaaggctgggttctgcctcctggtgcagccttgaggccttacctccctccctgctgctcacccttctgagaggctgagtctcccacctgaaaggctcagcctccccttttgctccatcctgcacttgcttatagtcatctccaccaaatactgaacttgtcaagtcgctttcttgctcaaaacccttctccctttttgtccatgggcatagcccacactccttgctctggcattcagggctctctgatatgatgccctccccactgctgtaatctctc

SEQ ID NO: 7336 - DNA, 1680 bp, mus musculus
ctgtgtgatgcatcttttcttctttctcttataaagaagagagattgcactcattccaaggtctttaacttggttacatctgcagagagtctgtgggctctaggggagaatctgttctttgacccttccagcttctggtggctgctgccattccttgacttgtggccacatcactccagtccctgcctccatggtcacactgcctcctcctcttttgtctgtgtgtcagatttccctctgcttttctcttgtgatgacatttaggctcactcagataatctaggacaagcttcttatttcaaaatccttaacttaattatatgtgcaaagaccctttttccataaaaggtcacattcacaagttctgggggttaaggcattgactaacatcttttggaggaccattgttcaacccactatacagtccaagattgtaaggtctttgtatattcaccttatgaggtaggttttatcatcctcatttttcagatgaagacactgagactcagagaaattaagtgatttgcccaaggtaattcaaaaaggaagtagcagaaccagtgattgcaacctggctttgtccgactttgaagcccattctcttcctcccatggcacactgaccagaattgtttagaagtctgtcctttggcttaatacacaagtgtccagttgagggggttgcagggagccacacctagctattaccaggcagtatgaccttagtgggagctagtttgagagaactgttagaggatcgagagcaggctgcagtggatatgggcaggaagtttgggggagggagggcagtggggatgggggtgacaatgaagagaaggggcttggagttcaggacaagggcaggaatacccaccaaatgagggaaatagcacttaaaggaaaagtagggccaggtgcagtggctcatgcctataatcccagcactttgggaggctgaggcaggaggatcatttgagcccaggagctcgagagcagccaggacaacatagtgaaaccccgcctctacaaaaaaaaatttttttttaattagccaagtgtggtggtgtgcacttttagtcccagctcccctggaggctgtcggggaggatcgcttgagcctgggaggttgaggctgcattgagctttgatagtgccactgcactccagcctgggcaatagagtgagaccctatctcaacaacaacaacaacaaaaaagcaaaagtgggccatgctttaccatcgtagagttttgcccagcacctctggttctttgatgtgtgaggggctcctatgcttgcctacaactgggaaggtctctgactggggtggatataagctggagggcctgagatgtgtagagaaggactctctgggtttgtattattcattcctcctgagcattgccatgagtgagcactggaaattcagagatgaacatgttttggtcctgcaccggaggcagagtggcagagtagaaaaagatcaagaaccaaatccctgctctgcctctcattcaccgtgtgacctcagatgaggcactttagctttccaagcctctgttttgttatctgaagaatacagatttttttgagctttgaaggagataaaaatgaaaagtgagtggcacacccctggaatataatagggtcaatgaatgttactttcatttaatcaaaaaac

SEQ ID NO: 7337 - DNA, 1237 bp, mus musculus
tcctttttgacactgttaggtaaataaaaattatgaagcagaattttgcagttttgtgcaggaattctttccattctaatgaaaattgcaaaaaaaaatgttttcagtaaaaaaaattcagtggaagaaaacaggataaattgattgctaatgtgaagaagaatttaaacattgtaccttaaaattaatgctttctctgagtaaaactagaaatgtgagattaaaaataaaactatttgaagatactggggtgtcactggggcatttcagaggcacaaagatgagaaaaacgcatataattgtcaagagtggcagggtagtgttgctctcaaagtcccatctgactaacagggcagaggctcttcctcatggccccaatctgcttcccgacagcttcagggtttcctcaggaagctgccctccaccttcatccacctcaagcatgtcctgcagagccctctggagaaccagcttgagggtcttcctgttttgaagctgcctaaaggagcccatgaagaagtaaatgatggggttggcactgctgttaagagcagacaggaaaatggaaattaaacgaacaacacaaggtaagtcatccaaatccttctcgatccagtataataggaatcactgaatgctgaggggcaggctgcagaagaggaagaccagccctgtgagcaggatggtcacatacagcctggtcagcggcatcttctgggatccacatatgatcctgacaagcaggaccagggtgaacccacagagaaccacagattaaaaaaatcagccacacagcagtgaggaaatctaatatttgacaccaattatcagagtcaacatcactaaacaggaagctacagaacatccactccaggatgctctgcaacagggacagggcccagagcaggacacacatgaccgctgacaggtgtgtggggcagtggcagcagtaccagatgggccacaggacggacaggcggtgctcggtgctgatggtgctcagcatgctcaggcctgtaatacaggcggagaacaacaccgtggtgacaaatctagagaaatggatggagagagaactaacaaagtcactgaagaaattaatgaatgttataatctggaagcaggtgcagaggaagtcagccctggccaggttgaggatgtagagagagaaggtgttactgtgcatgcagaagcccaggagccagagcatgactgcatttcctgccagcccgaccag

SEQ ID NO: 7338 - DNA, 191 bp, mus musculus
agcttaaatttcctatcataaagttcaatttatgaagttaatttaaacgtcacattacaacgtctatactgtcttcctttgatttttatctttcgtcaatttggtgtctgtgtaacacacttgttttgttgtgtcataggtttatgtttgctgagtcttccaactcataatttcttcctcaacatctcctc

SEQ ID NO: 7339 - DNA, 289 bp, mus musculus
aaagaagggccccattcactgagaccctgtagtaggagggagtttctggattccaccacagtatatacaccagtgaagcatatgcagttccctgtaagggaccttgacacctgttagaagaggaaatggatgctggatggccaaaaaatggcaaatgtcagtgacagtgagtatatgtgtgttcatattctctctatctacttgtttttacccagactcagaatccattagttctcagtctttatattggtaaacttataggtcttgactgattttagtttgttcgtct

SEQ ID NO: 7340 - DNA, 651 bp, mus musculus
ttttcaaaaaacatgttgactttttgttaaacttaaaaatgttcctatttttattttttctgctctgcaagcaaaatcagggaaagaaagggtgtgtttgtgtgaacacacatgtgtgcttcagttttgaacagaatgagaggtggccagggggtgaccaaacatccaagaagttcatttctcttagtgtagctgtccatcatgtcctaaatgatgaaacctccttaacttcatttctaaacaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggtatgttggcttcctttataaggtgttgagcctttactctgaaagaggttacaaattcagttgtctgtgggacctagttcccagtttttcataatactatacagggagctctgtggggcctgtggctaagggtcatgttctcttcctaaagatattcaggttgtatttgaaatactgtacaaagtaaaaagcacatatttatgggacagatttgacccaaacaatgacag

SEQ ID NO: 7341 - DNA, 210 bp, mus musculus
gtaggacacagtgaaaactactgtaaatggtggccatgataaaaccagtcctccgttggatgggctctacattaaaacaaagcctaaatttaggaatgcaaatatgtatgcaaaggatacaccaatgcatggcttataagaagggttcagctcatggattcctactcttgagtttttgttgcaaagtgtcaggctcttggggatggggta

SEQ ID NO: 7342 - DNA, 245 bp, mus musculus
atgtattcttttctcacagtgtcagttcctcccagcacctagcaacttaatggcaaaggtagacaaacaccgcgcccacagctccattcctgtgaattttccactgactacaccatgtagactttctatctgaaaaatatttaataattcatgaatacaattaaaatactgttctactttagtagaattttatggtgcataatattctttttccttctgatcccctgagttggttctaattagaa

SEQ ID NO: 7343 - DNA, 367 bp, mus musculus
tttgatggtgctgtacactttggtgaacaccatgaaaatctggaatatttaacttaatgacttagaatgagatttagcataaaagtgaatatttgtctgtttgtatacctaattaaaatgtaattgctataaattttgatatgaaatcaaagctgtgagtacaagtgtcaaggaataaaagtggaagttttcaaactatataggtagggtagacttgaaagtttttatgactttattttctacttcttcattgatttcatcatttaccagcaacatttaaaaggtacaaatgtttagaaaaattaaaggaataaaagatagtattgacatttttttttactacggagaacaaattaagaatcactga

SEQ ID NO: 7344 - DNA, 178 bp, mus musculus
cagtcttgctgagcaagcagtttgttttgaaaagtaagctgttctagttggtttgcagtcatatattctaggaacaagtatttcccagagcaaacaacttagggattattttttggtttcagtattactaaatatacatttaggaaaataatgcctggattgagtactatgtaacaca

SEQ ID NO: 7345 - DNA, 132 bp, mus musculus
tgaggaccaggaaccacctctgatgctaataccctataagctccttcagaaacacagacacaaccactgaactggctgatttaccctaaattgatcaaaattaagtttcctgtcacaaaggggaatgaagag

SEQ ID NO: 7346 - DNA, 183 bp, mus musculus
gaaacacttattgaatgaataaatacatgtacaatgtgattgtctgcaaagttgtgccaaaagatacagtatgttgcttgtatttttgtttggggatttcattagtcccttatatccaattaatacatttctacttaagatgttctatcacacctgtatgaagtcttagtaaaagaaaagtta

SEQ ID NO: 7347 - DNA, 278 bp, mus musculus
gaccttagaggtgagtgaagagagggaggaaaggaaagcagaggaaactgcataacaagggcaccaaaagctttatttaaataacgtcacttatttatttacacttctcattctacaaagaatttaaagtagttcacataagtataaaataagtatgaagtgtttggagaaaactagtctggtgtggctagacaattagatgcatgctgggaaatcatggtttgaagaggctagtttgtgatgtattcatgaggatttatacactgtgccagaaggtt

SEQ ID NO: 7348 - DNA, 1381 bp, mus musculus
aaacaaagattcacttactttttatctacttaacattgccaatactgcatttatcagttctatttcaccatggaaagcaactgttacaagagactggtttaactgaaatttagaagaattgtagttcctgtagttttttctttctttctttgttttttttggcaagacaccagaatatcttattttagctttaggaatggctgttaacttactcaaatttaatcatttgacacgctaacttttttttttatagtccctgaaataagaatgaacaaaacagctcttctttccataattgccttgtaattactttgttagctttaggcatttacatttcatcaactacagaagtaattacataatcctccttgtcccttaaattctatacatttcatcaactacagaagtaattacataatcctgcatgtcccttaaattctatttgttttgtttggcttcttttgttacaacttaatctcaaagccattgcacatacagacagtgagtgagagagagagagggagagagagagacagaggaccatccaatgccatttttccacttaatgaatcatttcctctgtcagctttttggtattaattttcaaacagttttctttcccatcagttggtccataaaactagttcacagtggcaagattaggacaattttatctttctgagtttttttttgggggggctaggttagtataatgatatagtccagatagatttatagtataaatcctctagcttagtttagtatggatactcttgttgcattggtcatgatcatcattgtctcaaactagggctagattcttaggtgtgctacctgcataatctcacagggttctgtgcttgcattaatgctctactattgacattttgaaattcttaataatttttgagcacagtctatattttcatttttgtacggggcctcaaaaattatgtagccagttctgtcatagacacacacacacataactaaatgttatgctattttgtttatgtcattaagctaagcattatttaaattggattttttaaaaactcaagctgtgttgctcttaaacctatactgtggattgataaataaatatttcaaacaaacaaatggcttgcaacctacaatctcacccttgcttgataaatcagtattataggtctagtaggaaggatgaaagggagagaggaagggagaaagggaagagagaaggagaggatggaagaaaggaaggaagaaaggaaagctggttgcctttattttgtctaacatactcatagataagtgaaaagagtcaacaatataaatgaacatgttaggcttttacacatagctttaatgctcacatcaagtaagtggcctgagatatttt

SEQ ID NO: 7349 - DNA, 928 bp, mus musculus
gatatgggattaaaaccaagacagtctgatcccagagcatgcacttttaatcactgtgaattcagtctccaaatgataataactaccagtttttcagtgcactgagtattttatatgcattatcttatttaatcctaacaagaaccctatgagaacattagcttaaggagatcaagtaacttttccagggtcacacaataaataagtagcacagccaggattcagtcctaatctttctaattcctaaatcatgctcataatgactagtaaatgataactatttcttcttatataggaggaaactgatgatcctgaaaattaagtggctgacctacgttcacatagtaacaggaatgggactaataaatacaccatctcttgacttctcattcaacaagcttttgattatttctctgacggttttctcatttagttgctttcagttgatgctcattagttatcaaatttagagagactctttctctaagtggcactttctccaaatcatgacttctaatagaagtcatgatttctgccataatcctctctccagcaggcatggcctttagggactctgctgaccttgccagcttgcaaaattacaacttaagggcttcaaaggggccaagtgcacagttacagagtgcatgtatagcctgaaatcatgattttaaatacgttgtcttcctgttgctggtgataaaatttggatgttgtgtcctcagaagttagacatagatatcaaaaatcttcaatttccacttatgattctgtctcactggaaaatttgcttaaatgagaatttccaaaagttatgccacagaatattagttattctgctaaaaagggaattcacagccaaatgcatttgaaaaatataagatagtataaccatttgtgtagactgatgataatatcagaaagctaa

SEQ ID NO: 7350 - DNA, 1219 bp, mus musculus
ttatgagtgaaatgttcagagaacttatggaatttcagctgcagatttaattaaaatgtgaagctaaagttgaaatttcatctctggaatttaaaaacctatgctttttccactaggccagtacagtgctataaaatcatgtctctgagcctacacaaaattgaatttacaaaacatttatcttttagttatttaataaggatctttccaacacatagtgggtgaacaaaaatcacacacttctcaacagatgaaataagaaaaaaactattgaatagtaatattttaatgcatcgcttatttcagcataatttagaatgctccagccacatctgaagatcttaaattaattatttgggtcctgaggggagagagtttctgaaagagcagggtagaattaactttcatcaagcacctgatatatgtgaggtggtatcatttatttaactcttttttataggccggaaccatgagaaatgctaagcattctacacttaatacatcctttaatattgttaataaccctgtgtggcatgacacattaatattaacctcattttacccagtaacaaattgaagttggtcagtagtaaaggtgaaatttgaacccaggtcctgttttttgaacctatgtactttctcaaataattgctggaagacacatacagagccagtagtacctccaaataagttctgcttagagtaactgcatagttgcttcttacaccagcacatgagcagataatttttatcaaagattcattacttgggatttccattcatttatttaatgaagtaattcctcagctagtgttagtatttggccaggctcctgcagtctctcagcctttttgtgtttatggacaggtcaaccagtggaataattttcatttgacaagccccagttgaacttgtttcctggatcattaagcacattggcatgtacattaacaaccattttctgccttgttggtttccatctatttcattcacgaattaataggtacataaagagaactcaattaatgcctctttgcataccaccaccagccttcttggtgggtggcaggtattgaagctgtgatgttgaaagagactgaaaacaagcagaactgagactcaaatcaagattcatttatcttttttggaccagaaaactatgccaatagaaatgaatcacagattcgtaaaatcaaatttgcttttgatgttatcaaga

SEQ ID NO: 7351 - DNA, 577 bp, mus musculus
tttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatata

SEQ ID NO: 7352 - DNA, 1580 bp, mus musculus
gattctggaaagggcaagggagggggaagctctggagccgagcagtggtctgggggccaagagagctgggttctcacctaccacagtggtctgagagatttcagacgtagatgacctcaacccagctactccagggtgaaaggcgagaggtgtctttcccaatgggcacagctagattgatttttggggtgttgctgttgttgttgttgttgttgttgtttttccttggaattgcagtccaggcttgactgtccatgctaatggaacgaggccatgttgtacagtaatgggatttttcaggtttttttaaattttaatttaattttatttcaagtgccaggacacatatgcaggctgtgcaggtttgttacacagataaacatgtgccatggtggtttgctgcacctatcaacccatcatctaagtattaagcaccacagcattagctacttatcctgatgctctccctcccgctgctcccctcgacaggccccagtgtgtgttgttcccctccctgtgtgcatgtgttctcatgcttcagctcccacttataagtgggaacatgtggtgtttggttttctgtttctgtataagtttgctgaggatgatggcttccagctccatccatgttcctgcaaagaacatgacctcgttcctttttatggctgcatagtattccatggtgaatatgtaccacattttctttatccagtctatcactcatgggcatttgggttgattccatgtctctgctattgtgaatagtgctgcagtgaacatacgcatgcatgtgtctttacaatagaatgatttatattcctttggttatatacccattaatgggattgctgagtcaaatggcatttctggttctaggtctttgaggaattgccacagtatcttccacaatggttgaactaatttgtattcccaccacagtgtaaaagtgttcctatatctccacagcctcgccagcatctcttgtttcttggctttttgataattgccattctgactggcatgagatggtatcttattgcagtttttatttgcatttctctaatctctaatgatcagtgatgttgagcttttttttatgtttgttggccgcatagatgtctttttttgagacttgtctgttcatatcctttgcccactttttaatgggattgtttggttttcttttttcttgtaaatgtatttaagttccttatagattctggatattagacctttgtcagatggatagattgcaaaaatattctcccattctgtaggttgtctgtgcgcactgatgatagttgcttttgctgtgcagaatctctttactttaattaggtcccatttgtcagtttttgcttttgttgcaattgcttttgacgttttcgagctagactggtttttaagtttccttaaataatctcacatctggaccatgacaacagccttctaactggcctccttgcctgctgtctctgcccccaccccattcccttctccactgagctacaatgatctttccttctcgactgcagggcagcttaatcctctgttcaaaagccttccaggcctcctattgt

SEQ ID NO: 7353 - DNA, 1753 bp, mus musculus
gtttccattatcaattgcatccacaacaatagtgaaaacacgtctgtttatgtgtatgtgcaatatatattcctttaggttgtcgacaaaaagaagacatagagagaattgaaatgtctaaatgattatatgacagtttatattatgccccattgctgtctcaggagaactgtccaaatatcagttacagggagaaaatgacttcaccagaatgtaaatgcaaaaccagccaatgctttccagaattttgtcaacatattttaaacatcctaattattggacatattacagttagtccataaggatggcaaagaccattttccttgtgcatcctatttcatcatttatattggtagaatgtgtaccttcacttttagaataacgtcccagttttgtccttcctgaacttttcccttcttgtcactggttatttctctgtatccttcaggtggtttttgctaagttcttgaggtattacttaatcgtgcctttctgtcttccacgttctgaagcaattgagaagtatacaaaggaatcagaggtcctaataatagtggtaatactggctacctggtctggtgaatggaaactgtccctgtgatctgaatgagttttctattccatactgagttatacttagccaccttttcatggccacagcagctaaacaactggaagcctttcctcttgagggcagagcttgccttggcagactcaccacatgaaagaggcaggaacagaaggaagaacctataccagcttcaggccatctaacctaagaaagggagccacagagagtataacacttaaaaaaccattgctggccaggcacggtggctcacgcctgtaatcccagcactttgggaggccaaggcaggtggatcatgaggtcaggagtttgagaccagcctgaccaacatggtgaaaccccatttctactaaaaatacaaaaattagctgggcatggtgatgcatgcctgtaatcccagctactcaggagcctgaggcaggaaaatcgcttgaaccggggggacagaggttgcagtgagccaagatcgcaccactgcactcccgccagggtgacagagcaagactccatctcaaaacaacaacagcaccaacagcaaaaaaaaaaaaaaatatatatatatatgtaatatatatatataaatatttatatttatatatttagataaaaaatatttatattttatatatatatatatatatatatatatatatatatatatatatatagctacaaatgcctcccatccctgtatatatgcccccggcaatgtggggttgctactgttcccatcacttgccttggccaatggaaagaagcagaatgatgttaagcaatttctgagccaaggtctaagtcaagcaacctctgcattctttctcaaaattcacctaccaagtgaagaagcccaggctagctaaaccagtggaatggccatgtggataaaaaccaaagtgccccagctgacacttcagccaactgctaggcctgtaaattacatcatccaggatcaggcaacaccaatcaacatgccaagtgaccacaaatatgtgagtgaacccaacaaacaccacagagaatggaaatgaacaatctcagctgaaccctgcccaaatcaccaggccacaccagtcagataagtccctctggtataaggctagacaagcaatgtagctttaatattgttttctacagaatatgaggcatggggtaatatccccactc

SEQ ID NO: 7354 - DNA, 892 bp, mus musculus
agccattccccctcaactcttaaatgctctccaagagaatgctgggcttctgccagctgaatttgttttacaattacctagccagtactcttagttggtcctgtaccagacttagaatataagaccacttagcaactattacattattgccaagatttggagcctctgccagaattttcattttatcagctgtccccactgcatcaatgtgtgtccttcttctagtctcccttaaacttctaacttctgagttctggatttatgtgatctaaaaaaccgagtaaccaaacttattataatatataaggctctagaaagggctgttagtcctttgcaagaatgtcaatgcataaacacttgaagacttttttaaaaaaataaatttcttcttggcccctgcctggagacctaagactgccacaattcctagcctgtggaaaaggctttatttgcaatatcagagatcaatgaagatgtatgaagtgattctttgaaaaagagtataagaaatagaagaataatagaagtgagattaaaaaatacctccacctagcaaatctgcgaagtatgcaaatttagacaaatggccagttccattcagtcatgggcaaattatgccaaatcattcataagttggcaaaaatccatccttcaactataaaccacaaagaattcactttacataacccagttcagtatgcttaatcatgtattcattataatgtataaccaaatacattttaggctgtctatgcacatatgccagcttgaggaaaagagatgaaatcatctaaatgaacatttcttgtttgaatgtaaatgatgtatttcttgcaaatctgatttattgagaggtgtgcatgagaaatcaactaagttaggctacatagga

SEQ ID NO: 7355 - DNA, 180 bp, mus musculus
taaacaattatgtgacttatagacaaatgttattaagaaaaacagagtcacgtattctatctaaatttctagctattaaataataaaattagattttgattcatgaaatcaatatttggaccatttttctagagtactttcacccaaattataattgctataaatttatacaaattataa

SEQ ID NO: 7356 - DNA, 220 bp, mus musculus
ggaccagccaagattaacctactggataatgataaacatatggcccagacaccagcattatcccatgcaacaaccggctaaccactagatattgagggaagtcatcctggactaactagccagctctccatccaactcaccagctgatgcagaaaaaatcctagccaagatcagctaagcctgcctagcccagatgatagagtgatttgtgtgacccatg

SEQ ID NO: 7357 - DNA, 695 bp, mus musculus
gcccttagtagaagtatatgggggaagatgacaccaaatatgaatgttgccttcttgacgcactcctccagattgtcattcttatagcatttgccatgacttgggagccttttctatcccacatcactagtaacttttacagtacttttttttttttttgagacggagtcttgctctgttgcccaggctggagtgcagtggtgtgatctcagctcactgcaagatccacctcctgggttcacgccattctcctgcctcagcctcctgagtagctgggactacaggtgtccaccaccacacctggctaatttttttgtatttttagtagagacggggtttcaccttgttagccagaatggtctcaatctcctgacctcgtgatctgcccgcctcggcctcccaaagtgctgggatttcaggtgtgagccaccgcgcctggcccttttacagtacttttaaccatatatatgtatataaagaaataatagattcagtatactaaaacttctcataataaggtaatattaatgggaacaataaaaaaatcaataatgcattgttgttttagaaaaaatagtataggaaaagtaatttaacaatttccaaactgctatgtattcattttttaagttatatttttagccttcctcaattgtgatttttctatttttctgaattgcccggaatgttactac

SEQ ID NO: 7358 - DNA, 486 bp, mus musculus
tgcaatagctctttcaggagaaactgctttttacataatccttttttatcttgtttgctgatcataagtgaaagatacatgcagacttggacaaatagagataaaaagagggtgtgtcagagtgttcataggacaaataatggtgtgttttgatggctcatttctaatatcaggtgcttgataagtggatgaatcatcctggcttaaagatataagtctgatgtgggcattacctttgtatggtagtttgctcctgatgacaaatgcaggctggtctgtgataatgcttttggctgtatggtgagtgagtgaaccaatgaaccattgagccagataatgaatcagtgttgggcctgattacattttaaatgcatgttaaccatttagcgcaaattggaaatactataaagagtctaaaatgatttacaagtttgatttaaataaactgaaatctttaaaatctaagcaaaaggagatagcttgtag

SEQ ID NO: 7359 - DNA, 1471 bp, mus musculus
tatacacgttcctctgttaaggaggaaatgggcttatttacctcaacttataggacataacaggcctaagacactgagttaattccccaataaggcagccaagagagatctcaaaatttctgaggaaagtgtctaataaacctcatctatggggatccgtaggtgatcatccaaattcttcagctatcatgggcctcaaactgtatcatcagctatacctcgactttcaagatacatatataaaactcatgttaagagaaacgtaaataaaatatttccagtattattttatggaacattgtttaagcctttacaactacaaacaaattctaaataattttaaaatatgcaagatttcaagttactttctcaccagttaatgttcaaattacagttgcgatagaaaatatataaagtaatatttacatattatataaagttaacagtttgaatccacctgaagttaaataagactagaaaatgtaggctagagaaatatttcaccatatttgttgatactctgagtcatgtaagtgtttaaatttgaattataatgcaaaaatttggagataaattatcgtgtacgattgataaaccacagaatattagctctaggccactccagttcctttcaaagagttggcttctaattatctgctgatgtctgtactaaatttaatagccaagagatttggatcttacacatttagtgagatacaatagccgtatgcacttgtcaatgactcatatttatcagttatcacctatattaacggagataaggaacagatcttaaaagttaagctgtaggatcttgattccagacataaaattagaatttgtactttagtagaaatgcacagtaagagaactgcataattgcttggagaactttattaataaccaaatgctcaaatgagcagagcaactttgttattacaatgtactatgccaaaatgagtctgttcatatatttgccaatttcattttgcccaacagttcactgagttcaattactgagttgtttcattttactggaatctttagaacattgccaaaataacaaaaataactaatgaatgaagtcaaacgaagaccatttggggacaatcagattattttcccccttgatttcttcttaccttctggaacaccttggtttaataaaattctgtgtggtgtgtattcttctcccctagagttaatgtctttattcatttgattaataaattcttagtgagaatttactatgtgcttattctagtgaaacatttagaatataattgtgagtaaaccaggcaaagttcttaccttcatgtagctaatattctaaaggagacagataattaaacaataataataatgcggcttaatgtgagtacagttttaaattcatgactggtttcaaatcttttgagttggtgatggattccagaataagatctaaattgctttactttccttattagac

SEQ ID NO: 7360 - DNA, 1245 bp, mus musculus
ccctttgccctcaacttctgtctctcttccccattactcttctttaaacatgtcaggcgtgctcctgcctcggaatctttgtatttgccttcctgctacctagaacagttatttccaatatacccacaaagtgcattctctctcacctccttctggggggaacttctagagaagataatcttccacatggtttacatttttgtatcagtttctgggagtgtccatgtctgaccttgtgccctgattctgaaatcccctttaagtccagattgactccatttattattcaggcacaaactagcatccatttagaaagcttgctgaataagcagactggaggaatgtaaatacatgcagaattattccatatctcagatccagaaaggcctatgggcacggatgggtgcctatgctaaataagagctggcataaatcttaacctagaattggaatttaaaatggaactttatttgagcttcaaaatggactttctggaactctctcaaaggaataaataaataaatatagaaacggattacatgctatggtgcatcttgacatgtagattgggaatatttgcattgatattataagagagaatatttgtagcaggtatctggatatctcataacaattgttaatcgaggagggaaagtaaatgaatcgttggacttagatttccactaattcaagtgtgtagtggaattgtggtggatctcagctgaaaataggtggctgtagatttatgagttagaatcagacttcactattttacggtacataagtgggtacacagttgtagtacatgggtgtgtgtctgtatgtatttgtctacatgaaaccaaagttcaggaatgtgtcattgcaaacatttaacacttgtccgtccctttcgccttccttttctctcttcctgcttcatttatataatcaatgatgcctgctctaaaatcccttcctggctctcaccccatctccactgctgccatatctgctggcacgtgaacttttccccatcttcccacttatcctactttattaaaaaggctgataattttctcattcttattaaatgtaagttttataagatcaatgatcatgtctagcttgttttctattatattctgaaataataatatagtatttggcacataataggtgcttaataatactgacttcgtgaatgggtgaattgatctagggctgactagatatgaagtactgtgctagatcctgaaaggcatt

SEQ ID NO: 7361 - DNA, 1245 bp, mus musculus; identical to SEQ ID NO: 7360

SEQ ID NO: 7362 - DNA, 341 bp, mus musculus
aggagagaagtttagcaggcagaaatgactcctcaagcagaaataccttttgaagccagcaagtagtaatcttgatgcttgaatggctggtatgaggtgaagactgctgggtgagaattcactgctgcatctttgtgggacctttttattcagtgccttcttgtctatgtaaaataaaataaaccaactttttgttattttttatatttccatgaagaagtccattgggtccaacaaaatcatgcagttttaagttcagtctgtttcatatgggcttcccaacatgcattcccattcaaaggtcaattacttgcttgcttactttttgtggcacatttgaa

SEQ ID NO: 7363 - DNA, 1502 bp, mus musculus
tgggtgcaaagaagacaaagaagttggtttgttagtctgtgctgtttattgatgtatctattttgagtccaaattattaagaatgtacacccactgagtagagactgggtctttgatatggacctgtgaattgtgtatttgtgtgtttatgcttgactcatggctgcaattatataattgagactataagctatctgtatctgtccatatgtttatatgtctataattcaaaaaagtctttcacttcaactatgtgaatatacaataaatttcttacctctggatagtactaattaattagtactattactactatttgaaattccttacattaaagaagttctatcatgattggcttagggatgaagaagcctctatacaattggccaatcctaatattaccagaaattaagaaaacaatctcaaagaatttcaaggtgaaaaaaagagatattcttagagaaactaattcaaaaatatttcaagaatattcacataatttaggtaaaatgtcagcaaataagactagtttaataattttggtttaatacaaataattatgttttctctaaattgtcattattatcagtataatgcaagtatacggtattcgtccattttcatactactataaagaactgtccaagactgggtaatttataaaggaaagaggcttaattgactcacagttcagcatgaatggtgaggcctcaggaaacttagaatcatgcccgaaggcaaaggggaagcaaggcgtcttcttcataaggcagcaggaaggagaagtgctgagcaaagagagaagagctccttataaaaaccattagatcttgtgagaactcactcactatcaagagaacagcatgagggaaactgcccccatgatacagttacctccacctagtctctctctcaacacatgggaattatggggattataatttaagatgagatattggccaggaacacaaagcctaaccatatcatatacttttttttttttttttttttttttttgagacggagtctcgctttgtcgcccaggctggagtgcagtggcgcgatctcggctcactgcaagctccgcctcccgggttcatgccattctcctgcctcagcctcccgagtagctgggactacaggtgcctgccaccatgcccagctaatttgtttttgtatttttagtagagatggggtttcaccgtgttagccaagatggtctcgatctcctgaactcgtgatccgcctgcttcagcctcccaaagtgctgggattacaggcatgagccaccgcgcctggcccatgtacatttttattctacttcggtatgttatttttaagcttataggtttactgatcatataagctagtattatttctacttaaggtataatattacaaaaaattactttgggtttaacaaaattgagtaattattctaacaaactgtatttcaacagtaattatattttctggtaagtaagtttgaagagaatttccaa

SEQ ID NO: 7364 - DNA, 1604 bp, mus musculus
ggcccctgtatcttgatcactcaaaaataggtggtttaatagaaccagaaaaagatagtatctgttcaggttgggggtccagctctgggaaaagggtgggtggtcctcaggaattgaagggtggttggaccaagccttgaaagccctttccaataccccaaatacaggacttcatgataggggacttgccaagaaatccagcagacaagtatgtggactccataggcaaagctgctatggcatttctttgggagaagcagccgagtacccaggcctgcggtagttaacagaaagaccactggacatggtgtcagaggtcccactgaccttgggattttgggtaaacaacttccctctcagagccttagtttctctacttataaaatagatctcttatagagacccctccagcactgagaatctctgattcatttctggagtttttgcctcatgtttcataatctgaagatctgccaatgagcaagtatttatagagccctgtcaggtgaggtgggagaaacaagtcactttgaaaccagcctctgccctcctagagctcatcaaggacattcagatacacacaggcacacatatggaagcagccacccaatacccaatggaaaggacttgtctatgggggtccagaggaagggacagcaaggtggcctgggctgttccaggatggcttccaggaggaggtagaatttgagccaggccttgcaagatgagcagagttcactaggttagaagaagggagcaggatgtcccatgcaaggcctggtgaaaagtcagggctcacacatacagctgtgtaggttgtgcactgcacaactccaggggcaccaggggcattcacattgtgatctctgtgactatactccctgtgtacaacctgcaaggccttatgcaaaagccctgaaaaaagtgctggcatagaggaatgatgtctgccaggtctgcaggaacaggcaagagtagcccctgggtggcccatttgtccacctggcctatgggggttagtgttctcccaggcttgggggcaatcagctctgttcatttcctgaatggctcaagtgttcatgagaagagtgcagccagacatcaggttcagatgtttcctccagtgctttctgggatcctgggcaactgacataacctctctatgcctcggtttactccttgaaagtgggcatcataagagctcctgctgtacagggttttggaggacattcaggtggatcatacatgtaaagtaattgtgtaaccctgggcttgatcattgatccatgttatgatgactgaccctgggagagagagagagagagaaaggctgggtggagtggttcctggaagctactgggcactgggaagagaggggtggaagtaagcagcttgtcattgggctggagatgagccattgccaagcagtaatgatttttccataaatcataaatttggatggctcccaggaaaccagcagcgtctcctgggagaactgttttaggaaaaatgctttgtgaagtacacaggagccagggatccaggggactggagttcttttcctcacccatcagggaccttgagccactccctgtatttgggcg

SEQ ID NO: 7365 - DNA, 790 bp, mus musculus
ccctgggagacctcactccttcctttcttcctctttctccctagccctctgccctctgcctaccccagccttcatgtccatcttgagcatgccccacccttctaagggactttgcaaatactgtgccctcactctcttccaagtctttgtacaatcaccttgtctaaagagccaaggaaggggccgggagcggtgactcacacctgtaatcctagtactttgggaggccgagaagggtggatcacgtgaggtcgggagttcaagactagtctggtcaacatggtgaaaccctgtttctattaaaaatataaaaaaaaattagctgggtgtggtggtggccacctgtaatcctgattacttgggaggctgaggcaggagaattgcttgaacccaggagatgaaggttgcaatgagccaatacggtgccactgcgctccagcctgggcgacagagtgagacacttgagccaatacggtgccactgcgctccagcctgggcgacagagtgagacactctgtcaaaaaaaaaaaaaaaaaaaagccaaggaaacactgatgaggaggaagaggatagagaagggaaggcagaaaaggaccctgatggaggctgaccagcctgtgcccagctcacagcctctgaggggagagagctgctcaccagagatttgaagttttaaagtgcagaaccagactctcaccccagttcttctgtagggacttgtgtaacctcagataagtctctggtatggtgatgcaggctttggcttgcccatctgtaaaatggatcaaca

SEQ ID NO: 7366 - DNA, 1088 bp, mus musculus
aacccaactagaaggtctgattccatctctgatgccagttttcaatagccagtctcccttgtgaggttttagtgatggcagatggcatgatctgagtcttcttataaaaatgcaattttgttctagaccaaatgtgaggagtattggccctccaagcaggctcaggactatggagacataactgtggcaatgacatcagaaattgttcttccggaatggaccatcagagatttcacagtgaaaaatgtaagtaagaagtcaggatcagttgagctcatgtaattaccatatgttaatttgggggtgatatgttttaggttgatattaactaatatgttttcctatgcagtgagaaatgttttgctgctttcctttcagaacagaacaatccatatgcatgtatactccaaggcaaccccttgacttttctgggaaatttactttcttgggaataacctaagttatttctgaataaaatgaatcttaagagcatggctctacatcaggaactctttcctttctttccacttccaggtgacttgctcatagattttacagaacaaactgtagccttttggattatttggttagaaatatggcatcaggagcggccacttgctgttaggagtaattgataacagttacattaataggattccagggcatatgcacatggccttccttcccctcaaaatttacaaaagcaaatccaattaaattgtgcaggcattctaggaagtcaagtttatgtgctttttttctttttcaaggatgctttgaaaatagaggcagtgccatgaagcagcattggtatctgttgatgggtgtgtgcattggcataactctctgctgtttatatcacaggcctaaacattaggcatgtgctggcttgaagtctgagactatcctaaggaaataatctgaaatgcaaccaaaggcttattcagaaagacgagtctcagcattatttataatagaggaaaactttggaaaccatgcagacatggttttgtagcttttgtagcttttgcagaatggataacttaactatgactcgtctgcttataatatcattattcagctattag

SEQ ID NO: 7367 - DNA, 1818 bp, mus musculus
agagttgtcctcagttgttttctctctttccttgaaccatttctatacccctcaatgcagaatctgtgaatcatatggtgaatgttttcttcatccaatcaatttgtcccactgcaattatccaaaatgtccttttgactttttcttttttttttaaaattatactttaagttttagggtacatgtgcacaacgtgcaggtcagttacatatgtatacatgtgctatgttggtgtgctgcacccattaacttgtcatttaacattaggtatatctcctaatgctatccctcccccctccccccaccccacaacatgccccggtgtgtgatgttccccttcctgtgtccatgtgttctcattgttcaattcccagctatgagtgagaacatgaggtgtttggtttcttgttcttgcgatagtttgctgagaatgatggtttccggcttcatccatgtccctacaaaggacatgactaaattgaatcaatgttgagctctagttacatttatttgttacctgaaatgtcctttctactacacaatttcctgatggcatttttcatctgggcattcctcaaggtatagattaaggggtttaacataggagttatcatagtgtagaatatagcaactgctttatcaataggtaaagtagctgcaggtctcatgtacacaaatatgcagggcacaaagaataagatgacaactgtgatgtgggagacacaggtggagagggctttgtgccttgcctccaagctgtgagtccttagggagcgcaagatgaccacataggagaccagcaggaggacaaagtttaacaagcagatgaatccactgttggcagcaatgaagagtcccagcatatgggtgtcagtgcaggcgaggttgagcaaagggttcagatcacacataaagtgatctatgacattaggaccacagaaaggtaattggaagatgaagaggatctgtatggttgcatgaagaaagcctcccatccacaccactcccattagcagggcatacacacactggttcatgatagtcatatagtgcaagggcttgcagatggccacatagcggtcataggccatcacagtaagtaggataccctctgcacctccgaagaaatgttctccaaagacttgagtcatgcatccattgaataggatggtgttctttccatagagtgaatctgtgatcagcttaggggtattgacagaagaatagcaggcatctataaaggagagataggccaggaaaaggtacatgggggaccccagtgatgggctggcagtgatggtgaccacaatgagcgcatttcccaccacagtgatgatatagatgacaaaaaaacacaacaaatatgattttctgcatctttggattctctgtaagccctagtaaaacaaactctgtcacgttattcctattctccatgtatttcatgtgatgattaattgcattacctgaaaacattttttattaatacaactttgaatttattacacatctccattttaataataaatgcttgaattttattaaactgtaaattcttataagatttttcttgagatgttaataaagtttctcagttcttgaagattacttggtgaagactctgtgaagagtataaatattaggatctcttgtgaacaaagtcaggatgtcatgtgtgtttactcaaccatctgggaggcctaagagctcaatttgaagtagtagattggatacacagtagcagctaaacctgaaaagggagatggacaatgaatttaaagaccatggtgtaaagctaaggaatttgccatttattct

SEQ ID NO: 7368 - DNA, 924 bp, mus musculus
aaagactctaagtttttcaatagtgctgaagcttatgaaagattgttactttctatatagagtaatcggtatttttcagcacttttcaaatagagtaatagagtcttgcattctcactccaattattcaaaaggtagttggtaaatatcattaacctaatttgacagttgaaatatttgaggcttatagagattaagcaatttgtagaacccatctctctgatatcgggtaccatgttttgccatgagacacctccttagtgaatgagacaagttatgaggactaaaacaaaatttaaatacacttcacacacacaaaagacataaatatgaatattaaatggcaaatcatcagctgattagtccaagcacaaacatggagaagctttactgggatcacttgctatgaataatataaagccctgtaaaaggaaaattggagacctttctttatgagcttaatgtgtggtcaaatgtttctctgtattatattgatcacattgtcaatttatcctgtctcctaggcttatacagccataaaaataaatgaaagtcctgtatatgtccctaacagtagggtagatatattcatatagttctcccaattaattcgcataacagtatgtgaggtgaatattatcattttatggatgataagattaagatgtaaggtgccaagaaatataccccaggtaaaagaagttataggtggaaaaacgaggattctaatctggtctttctgattctcaaactaacacacttaactattgtgataatgttttttaacactttgcagaagtttctggctagggtcccatgctttgcaaggggatcaaggaggaatgcatagggctgagggagaggctaagcaaaaacagcccttcaatgaatgtaataccacatttttcttaatatttaggagttt

SEQ ID NO: 7369 - DNA, 1650 bp, mus musculus
gatattatctacagggtggtggtggcataggacttcatattgtaaaactcaaagagcagctaaatatatcttaaatgttgagtgatacacaacataaaaaatggccctcagtatttattgaaaattataaaatgaaatttaatattaaaatggatcattacctcttacatttaccttccttgaattggaaaaattaatcagaatgatgccaaagctaaccaaggcttgtacttgaagaatgctatagcaaggtatcatgttcataagcatatttgagaatcataataaccctatgaagtggtcattaaaatttggaagaaagtgttgaagtggcttattaagaaaccgccaccagaatgtatccaataagaaatatttaattttgcataaaatattccataacatcacatagcacagcataaattaattccttttttttttgcaggtagaccatttcacacttgccccttcacctcactcacgaaaaccatgcaactgaataataatgtgactgagttcattctgcttggattgacacaggatcctttttggaagaaaatagtgtttgttatttttttgcgtctctacttgggaacactgttgggtaatttgctaatcattattagtgtcaagaccagccaggcacttaagaacccaatgttcttcttccttttctacttatccttatctgatacttgcctctctacttccataacccctagaatgattgtggatgcccttttgaagaagacaactatctccttcagcgagtgcatgatccaagtcttttcatcccatgtctttggctgcctggagatcttcatcctcatcctcacggctgttgaccgctatgtggacatctgtaagcccctgcactacatgaccatcataagccagtgggtctgtggtgttttgatggctgtggcctgggtgggatcctgtgtgcattctttagttcagatttttcttgccctgagtttgccattctgtggccccaatgtgatcaatcactgtttctgtgacttgcagcccttgttgaaacaagcctgttcagaaacctatgtggttaacctactcctggtttccaatagtggggccatttgtgcagtgagttatgtcatgctaatattctcctatgtcatcttcttgcattctctgagaaaccacagtgctgaagtgataaagaaagcactttccacatgtgtctcccacatcattgtggtcatcttgttctttggaccttgcatatttatgtacacatgccttgcaaccgtattccccatggataagatgatagctgtattttatacagttggaacatcttttctcaaccctgtgatttacacgctgaagaatacagaagtgaaaagtgccatgaggaagctttggagcaagaaattgatcacagatgacaaaagataaatgaaggtttcaaatccttctttatagtttggagtgacctagaagaaatcaatgagaatattatatttttattgttgatttaatgtaatcctgccttggtacatgaggattagttcctttgggaaaagagacagtgtaaacaaataacaatggttaatgttgagtcagttttatgtggcagaaaagacagcatgcaatacaaactagtatgtaaagctcattgccttc

SEQ ID NO: 7370 - DNA, 816 bp, mus musculus
ataacatcacatagcacagcataaattaattccttttttttttgcaggtagaccatttcacacttgccccttcacctcactcacgaaaaccatgcaactgaataataatgtgactgagttcattctgcttggattgacacaggatcctttttggaagaaaatagtgtttgttatttttttgcgtctctacttgggaacactgttgggtaatttgctaatcattattagtgtcaagaccagccaggcacttaagaacccaatgttcttcttccttttctacttatccttatctgatacttgcctctctacttccataacccctagaatgattgtggatgcccttttgaagaagacaactatctccttcagcgagtgcatgatccaagtcttttcatcccatgtctttggctgcctggagatcttcatcctcatcctcacggctgttgaccgctatgtggacatctgtaagcccctgcactacatgaccatcataagccagtgggtctgtggtgttttgatggctgtggcctgggtgggatcctgtgtgcattctttagttcagatttttcttgccctgagtttgccattctgtggccccaatgtgatcaatcactgtttctgtgacttgcagcccttgttgaaacaagcctgttcagaaacctatgtggttaacctactcctggtttccaatagtggggccatttgtgcagtgagttatgtcatgctaatattctcctatgtcatcttcttgcattctctgagaaaccacagtgctgaagtgataaagaaagcactttccacatgtgtctcccacat

SEQ ID NO: 7371 - DNA, 1206 bp, mus musculus
tcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctac

SEQ ID NO: 7372 - DNA, 752 bp, mus musculus
tattccttagactatatgtcatggaattaataatggagtcacaatagtacgaaaaagagaaagcattttgtcagttcctgctgaatgacgggtttggggtcttaagtatgtaatgaagccttatccaaatgacaatgccacaattatgagatgagataaacagatggagaaaactttgacacaactcgtagttgtagctgatggccatttatagattgtgcagacaattttgccgccagggataaatatcaacagacatggagccaggacatgaaacacagtacctatacagagattcatctcattcaaaaacatgttcccacaggacagtgtaagtgttggggtaatgtcacagaacaggtgcttgatttgtttggaaccataaaatggcaaagagaaaacctggaatgtctgcactatccagacaggagttccagtgatccaggagccagccaccatctgggtacagacctcatggtttatgaagagaagatagtgcagagggttacaaatggccacatagcggtcttaggccatcacagccagaaagaagcactctgtggctcccagtataagaaagtggcacatttgtgtagcccaggcaactaaagaggttattccactctgggtcccaagattaatgagcattcttgggagagtaactgacagataacaaatttctaagaaggaaaaattgccaaaaaaaaataggtgtttggagactaaggtccagctttgttattagaacaatg

SEQ ID NO: 7373 - DNA, 826 bp, mus musculus
ttgatgatcctgatgtgcaatggcatcataatactactaataaaaattcaccccgctctccagactcccatgtatttttttcttagcaatttttcccttttggaaatctgttatgtaacaatcattatcccaagaatgctcatggacatttggactcagaaaggaaatatttctttgtttgcttgtgctacacaaatgtgtttttttcttatgcttggaggcacggagtgtctccttctgacagtgatggcctatgaccgctacgtggctatttgtaagcctttgcagtatcctctagtgatgaaccacaaagtctgcattcagctgataatagcttcctggaccatcacaattcctgtagtaattggggaaacatgccaaattttccttttgcccttttgcggaactaacacaattaatcatttcttttgtgacatcccgccaatactcaagcttgcttgtggaaacatatttgtgaatgagataacagtccatgtagtagcggtggtgtttatcacggtgccatttctgttgattgttgtctcttatggcaaaattatctccaacattttgaaattgtcatcagccagaggaaaggctaaagccttctccacctgctcatctcacctaatagttgtaatcttattctttggagcaggtactatcacttatttacagcccaaaccacatcagtttcaaaggatggggaaactgatttctcttttctacaccattctgattccaactttgaatcctattatatataccctgaggaacaaagatatcatggtggcattgagaaaattactagctaagttattaacat

SEQ ID NO: 7374 - DNA, 1139 bp, mus musculus
tatatttcatttctgaatcaaatgtagaaataatgtttctattatctattgtgaataacaatctattctgtctacaaatattataatttgtttaaatagcactacatggaacagctaataacccaactgtttcttcctagaagagataactggactaaatgggccaacacaatctaacagtgctaactgaattcattctgatggaactcacaaggcggcctgagctgcagattcccctttttggagtcttcctcgtcatctacctaatcacagtggtgggcaacctaactatgatcattttgaccaaactggactcccacttacatacacctatgtacttttctatcagacatttggcttttgttgatcttggtaattctactgtcatttgtcccaaggtgctggcaaattttgttgtggatcgaaatactatttcctattatgcatgtgctgcacagctggcattcttccttatgttcattatcagtgaatttttcatcctgtcagccatggcctatgaccgctatgtggccatttgtaaccctctgctctattatgttattatgtctcagcgactgtgtcatgtactggtgggcattcaatatctctacagcacatttcaggctctgatgttcactattaagatttttacattgaccttctgtggctctaatgtcatcagtcatttttactgtgatgatgttcctttgctacctatgctttgctcaaatgcacaggaaatagaattgttgagcatactattttctgtatttaatttgatctcctcctttctgatagtcttagtgtcctacatgttgattttgttagctatatgtcaaatgcattctgcagagggcaggaaaaaggctttctccacatgtggttcccatttgacagtggtggttgtgttctatgggtctctactcttcatgtacatgcagcccaattccactcacttctttgatactgataaaatggcttctgtgttttacactttagtaatccccatgcttaaccctttgatttacagcttaagaaacgaagaggtgaaaaatgccttctataagctctttgagaattgatgtcaactttgtgtttaataatcaatttgtaatattgttataataaatatataatat

SEQ ID NO: 7375 - DNA, 1006 bp, mus musculus
ttgctttatatttcatttctgaatcaaatgtagaaataatgtttctattatctattgtgaataacaatctattctgtctacaaatattataatttgtttaaatagcactacatggaacagctaataacccaactgtttcttcctagaagagataactggactaaatgggccaacacaatctaacagtgctaactgaattcattctgatggaactcacaaggcggcctgagctgcagattcccctttttggagtcttcctcgtcatctacctaatcacagtggtgggcaacctaactatgatcattttgaccaaactggactcccacttacatacacctatgtacttttctatcagacatttggcttttgttgatcttggtaattctactgtcatttgtcccaaggtgctggcaaattttgttgtggatcgaaatactatttcctattatgcatgtgctgcacagctggcattcttccttatgttcattatcagtgaatttttcatcctgtcagccatggcctatgaccgctatgtggccatttgtaaccctctgctctattatgttattatgtctcagcgactgtgtcatgtactggtgggcattcaatatctctacagcacatttcaggctctgatgttcactattaagatttttacattgaccttctgtggctctaatgtcatcagtcatttttactgtgatgatgttcctttgctacctatgctttgctcaaatgcacaggaaatagaattgttgagcatactattttctgtatttaatttgatctcctcctttctgatagtcttagtgtcctacatgttgattttgttagctatatgtcaaatgcattctgcagagggcaggaaaaaggctttctccacatgtggttcccatttgacagtggtggttgtgttctatgggtctctactcttcatgtacatgcagcccaattccactcacttctttgatactgataaaatggcttctgtgttttacactttagt

SEQ ID NO: 7376 - DNA, 218 bp, mus musculus
acctccaaattgtgataaataaaatgtctctagacattagaaaatgtttttgggtgagtaaaatcaaaagcaactgaaaactgctgatctgccttatctctttcttaaattatttaaacatgtttttatttgtgagaggtatgttttcaaatgtcgcaaattgtgaaatttaggtatatcttctgttagctttgcatactaaaaaatttctcaggtga

SEQ ID NO: 7377 - DNA, 49 bp, mus musculus
aatctaacaacggtgaatgaattcattcttacgggaatcacagatatcg

SEQ ID NO: 7378 - DNA, 917 bp, mus musculus
aacattttacttaaagaagctttgacttccttgtttctcaaactatagatgaaaggattcaacatggggatgactactgtgtaagacagacaccactttgtcttgatccattgagtagctggagctgggacgcagagatacatgaacaggattgtcccaaagaagatagtgaccaccgccaagtgggaagcacaggtggagaaggccttgtgcctcccttctgcagagtggatcttcaagatggcagcaaggatgtagagacaggaaacaagaatcagtaggagacagctcaattcattaaaactggcaaaggcaaaaatgacaacctcattgatgtgtgtatcagaacaagagtttcaggaggggtggaatatcacaaaaaaaatagttaatgatattggagtggcagaatgacagctggaaggtgaagccagtgtgaatggcagcatttacaaagcccaaaagatatgtggctaacaccaggagggcactgaggtggggtgacatcaggactgtataaagcagaggcttgcagatggccacataacagtcataggccatgacagccaacagaaaaccctcaatgccagcaaaggagccaaaaaagaagaattgagtggcacattcattaaatgaaatgactgggttctccacccagaaatttatcagcatattaggggcaatgacagaagaataacagaagtcaacaaggcacaagttactgaggaaaaagtacattggagtatggagatgtgagtcaatcttgattaatagaatcatgccaagatttccaacaacggtgaacatatagatgagaagaaacaacacaaaaagaagacactgtaattctgggtgatccgtgaatcccaggataataaatccagacagtggtgtaaagtttctcatatcttagtctc

SEQ ID NO: 7379 - DNA, 1297 bp, mus musculus
attttaattattcaataaagagttaactgtaggaatgaccatagttaatacacactaaatcacttgcttcagtcattagtagacagcacatctagtactacaagtcttttgatttggcatcaaatccaacataccttttattatgcttttcactttttgctcttctgttagaagttgtttcactaaaaatatattatagctccatcatgtattcatctgactaaattccactgtgcatcttctttcttattgcagctcaaatgatgagacttatgaaagaggttcgaggcagaaatcaaacagaagtaacagaatttctcctcttaggactttccgacaatccagatctacaaggagtcctctttgcattgtttctgttgatctatatggcaaacatggtgggcaatttggggatgattgtattgattaagattgatctctgtctccacacccccatgtatttctttctcagtagcctctcttttgtagatgcctcttactcttcttccgtcactcccaagatgctggtgaacctcatggctgagaataaggccatttcttttcatggatgtgctgcccagttctacttctttggctccttcctggggactgagtgcttcctgttggccatgatggcatatgaccgctatgcagccatttggaaccccctgctctacccagttctcgtgtctgggagaatttgctttttgctaatagctacctccttcttagcaggttgtggaaatgcagccatacatacagggatgacttttaggttgtccttttgtggttctaataggatcaaccatttctactgtgacaccccgccactgctcaaactctcttgctctgatacccacttcaatggcattgtgatcatggcattctcaagttttattgtcatcagctgtgttatgattgtcctcatttcctacctgtgtatcttcattgccgtcttgaagatgccttcgttagagggcaggcacaaagccttctccacctgtgcctcttacctcatggctgtcaccatattctttggaacaatcctcttcatgtacttgcgccctacatctagctactcaatggagcaagacaaggttgtctctgtcttttatacagtaataatccctgtgctaaatcccctcatctatagtttaaaaaataaggatgtaaaaaaggccctaaagaagatcttatggaaacacatcttgtagagccatgttacccatcatttgttacgtagaagaaaatacattttcatgttaactgtattctctgattgtttaagctgtttctc

SEQ ID NO: 7380 - DNA, 1297 bp, mus musculus
gagaaacagcttaaacaatcagagaatacagttaacatgaaaatgtattttcttctacgtaacaaatgatgggtaacatggctctacaagatgtgtttccataagatcttctttagggccttttttacatccttattttttaaactatagatgaggggatttagcacagggattattactgtataaaagacagagacaaccttgtcttgctccattgagtagctagatgtagggcgcaagtacatgaagaggattgttccaaagaatatggtgacagccatgaggtaagaggcacaggtggagaaggctttgtgcctgccctctaacgaaggcatcttcaagacggcaatgaagatacacaggtaggaaatgaggacaatcataacacagctgatgacaataaaacttgagaatgccatgatcacaatgccattgaagtgggtatcagagcaagagagtttgagcagtggcggggtgtcacagtagaaatggttgatcctattagaaccacaaaaggacaacctaaaagtcatccctgtatgtatggctgcatttccacaacctgctaagaaggaggtagctattagcaaaaagcaaattctcccagacacgagaactgggtagagcagggggttccaaatggctgcatagcggtcatatgccatcatggccaacaggaagcactcagtccccaggaaggagccaaagaagtagaactgggcagcacatccatgaaaagaaatggccttattctcagccatgaggttcaccagcatcttgggagtgacggaagaagagtaagaggcatctacaaaagagaggctactgagaaagaaatacatgggggtgtggagacagagatcaatcttaatcaatacaatcatccccaaattgcccaccatgtttgccatatagatcaacagaaacaatgcaaagaggactccttgtagatctggattgtcggaaagtcctaagaggagaaattctgttacttctgtttgatttctgcctcgaacctctttcataagtctcatcatttgagctgcaataagaaagaagatgcacagtggaatttagtcagatgaatacatgatggagctataatatatttttagtgaaacaacttctaacagaagagcaaaaagtgaaaagcataataaaaggtatgttggatttgatgccaaatcaaaagacttgtagtactagatgtgctgtctactaatgactgaagcaagtgatttagtgtgtattaactatggtcattcctacagttaactctttattgaataattaaaat

SEQ ID NO: 7381 - DNA, 1244 bp, mus musculus
tttatcacaagtaattatgacagtcacatcttaagaataagttattttaattattcaataaagagttaactgtaggaatgaccatagttaatacacactaaatcacttgcttcagtcattagtagacagcacatctagtactacaagtcttttgatttggcatcaaatccaacataccttttattatgcttttcactttttgctcttctgttagaagttgtttcactaaaaatatattatagctccatcatgtattcatctgactaaattccactgtgcatcttctttcttattgcagctcaaatgatgagacttatgaaagaggttcgaggcagaaatcaaacagaagtaacagaatttctcctcttaggactttccgacaatccagatctacaaggagtcctctttgcattgtttctgttgatctatatggcaaacatggtgggcaatttggggatgattgtattgattaagattgatctctgtctccacacccccatgtatttctttctcagtagcctctcttttgtagatgcctcttactcttcttccgtcactcccaagatgctggtgaacctcatggctgagaataaggccatttcttttcatggatgtgctgcccagttctacttctttggctccttcctggggactgagtgcttcctgttggccatgatggcatatgaccgctatgcagccatttggaaccccctgctctacccagttctcgtgtctgggagaatttgctttttgctaatagctacctccttcttagcaggttgtggaaatgcagccatacatacagggatgacttttaggttgtccttttgtggttctaataggatcaaccatttctactgtgacaccccgccactgctcaaactctcttgctctgatacccacttcaatggcattgtgatcatggcattctcaagttttattgtcatcagctgtgttatgattgtcctcatttcctacctgtgtatcttcattgccgtcttgaagatgccttcgttagagggcaggcacaaagccttctccacctgtgcctcttacctcatggctgtcaccatattctttggaacaatcctcttcatgtacttgcgccctacatctagctactcaatggagcaagacaaggttgtctctgtcttttatacagtaataatccctgtgctaaatcccctcatctatagtttaaaaaataaggatgtaaaaaaggccctaaagaagatcttatggaa

SEQ ID NO: 7382 - DNA, 1244 bp, mus musculus
ttccataagatcttctttagggccttttttacatccttattttttaaactatagatgaggggatttagcacagggattattactgtataaaagacagagacaaccttgtcttgctccattgagtagctagatgtagggcgcaagtacatgaagaggattgttccaaagaatatggtgacagccatgaggtaagaggcacaggtggagaaggctttgtgcctgccctctaacgaaggcatcttcaagacggcaatgaagatacacaggtaggaaatgaggacaatcataacacagctgatgacaataaaacttgagaatgccatgatcacaatgccattgaagtgggtatcagagcaagagagtttgagcagtggcggggtgtcacagtagaaatggttgatcctattagaaccacaaaaggacaacctaaaagtcatccctgtatgtatggctgcatttccacaacctgctaagaaggaggtagctattagcaaaaagcaaattctcccagacacgagaactgggtagagcagggggttccaaatggctgcatagcggtcatatgccatcatggccaacaggaagcactcagtccccaggaaggagccaaagaagtagaactgggcagcacatccatgaaaagaaatggccttattctcagccatgaggttcaccagcatcttgggagtgacggaagaagagtaagaggcatctacaaaagagaggctactgagaaagaaatacatgggggtgtggagacagagatcaatcttaatcaatacaatcatccccaaattgcccaccatgtttgccatatagatcaacagaaacaatgcaaagaggactccttgtagatctggattgtcggaaagtcctaagaggagaaattctgttacttctgtttgatttctgcctcgaacctctttcataagtctcatcatttgagctgcaataagaaagaagatgcacagtggaatttagtcagatgaatacatgatggagctataatatatttttagtgaaacaacttctaacagaagagcaaaaagtgaaaagcataataaaaggtatgttggatttgatgccaaatcaaaagacttgtagtactagatgtgctgtctactaatgactgaagcaagtgatttagtgtgtattaactatggtcattcctacagttaactctttattgaataattaaaataacttattcttaagatgtgactgtcataattacttgtgataaa

SEQ ID NO: 7383 - DNA, 1703 bp, mus musculus
ttttaacttatttacctacaaaatgacttaggttaatgagaagttagtctgtcaagaattgtctttacagtgtaagacagatgtatgctagatatattttgctctacccatttcaatagaacatttgtagttctatatgaagagaatcctgaagagagtgggtagattttcaagtcatcataagaaatactgtagtatacataaattacatttaaaactggtgtttcaattattgttattattgtgtttattatagaatatgtgtaaaatatagtaaatactgtgtacttcgtaatttcatcattgtatatcattcttctgtacacattttccccaaaacattgtatctattctcttttccctttatacttttcttagtattttcttaggcctatatataatattatgagatatgaatttataatgctttcataatgtttcaatgcatagaaactagaggaaaaatactttattctttttaaactatatttaaaagagggatgcccagtattttaaagacaaacaagtgatacttaaaaatagaaatgtacacatttagcaaaagagaaaattgacaaaaggaagaggatcaaagtataagaaaaatagcaattataagtacatcttttcttcacttgaacagtcattcctaaaggaaaaacataattaaacaacttaagaaatttagaattgaatacataattgcaaagcctgattgttgcaaaatgaagactttctaaaacaaacaattagattgttggttctagacttcacgaaacactgcaaatgtgatcttatgtaacataattctacatattcatgacagtaatgcaaactgagctcattttctttccccataggtgagattccttacagccatgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttttcactggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctaca

SEQ ID NO: 7384 - DNA, 1703 bp, mus musculus; identical to SEQ ID NO: 7383

SEQ ID NO: 7385 - DNA, 1703 bp, mus musculus; identical to SEQ ID NO: 7383

SEQ ID NO: 7386 - DNA, 1123 bp, mus musculus
ttatgtaacataattctacatattcatgacagtaatgcaaactgagctcattttctttccccataggtgagattccttacagccatgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttttcactggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataaatcaagattatctccaccagaggagaaacaaagacgaccttagatggagtgttgtgtatttcaaacagagttaccattgtgctttatcgtgatcagtccccttcttgacacgtgagagtta

SEQ ID NO: 7387 - DNA, 1123 bp, mus musculus; identical to SEQ ID NO: 7386

SEQ ID NO: 7388 - DNA, 1123 bp, mus musculus; identical to SEQ ID NO: 7386

SEQ ID NO: 7389 - DNA, 134 bp, mus musculus
aacaagaagctgcaacaagactggcacataactctgtagacgtggcttgggattaaagcaggggcttggagattgcctcatagcagtcataacccatggcagccaggaggtagcgctcactacaggccagccca

SEQ ID NO: 7390 - DNA, 1037 bp, mus musculus
gggtttcaaacccaaacctagcaccaaagccttttctgtggaagttcctggggcctctctactatcttttttagtggttagaaggcatttcctcacaatggcactgttacctgaaaactggaggactctgacactgaaaatttggcaacaatatctttcttctctcttctcagtagctgcacacctcaacagaataaaaccatttgtctctagatcagtaattggtggagggaatgccaaaggagacatgacaaaaaggacaaggatgttgtggcatatgccaggacttaattgtagccataatttcatgttgagcctaggctggcagaaggtgcacctgtgaagttggtagaacatctgattgcagtctctttgcagaagggctgcagagaatgctagagagagatatttaaaaggtaagaaggagcctgttctgaagaactcaactaagaaaaaagtcttatccattagcatgaagtcacatttctaagtttagcatagtagttattactcaaatccatccccaccccaaccttctaggtgacaagaagagacaagactggatatcaagtttgaaaaaacattttatcatttttttcctccttttgacactcatagcttctctctcaattcctgccttagaaccagtaagagcatcttattacccctgtttatgtccatcaccccatgaagcccaagactcccagctcatctccattcacgaattcactagctctggtgtctgtatggctccatcccattttatgaactcttcttccacttttctccctctcctgaaatcatttcactgtaactctggagcttaaggtctctcagtacatttccctgtgtcctcaagctcttccagtaacatttccttcaccttcttgaactagctgaaaaccctggctcttcctcgaggacgctatagccctctaaagtggttctatgttctctttcactcctccttccactggacctggacgtggggtagagaccttccttactactttaataatgctgtaagaccatccttc

SEQ ID NO: 7391 - DNA, 1241 bp, mus musculus
ttagaacagtcccagcacagagtacacattcaatgtgaagtatattaaatatttttaccatttcaaatcaattagaaaggatcaatttcctaatatggcattaggacaatgagggaatcattttggaagttaaccctaatgcatagacattatggatccttacagaaaatgtataaagattaaatgtttcgccgggcatggtggctcatgcctgtaatcccagcactttgggaggccgaggcgggcggatcacaaggtcaagagatcgagaccatccaggccaacatggtgaaaccccgtctctactaaaaatacaaaaattagctgggtgtggtggcacgcgcctgtaatcccagctactcaggagtctgaggcaggagaatcacttgaacctgggaggtggaggttgcagtgagccgagatctggccactgcactccagcctggtgacagagcagactccgtctcaaaaaaaaaaaaaaaaaaaaagtttcaaaatttatttctaatggacttaggtttcaaatatttttaaaagtaaaagaaaactagaagagagtgtagattaactgtttttcagatttcagggtagataaacatttataaccaaatgaggaaagggcagagtacaaaaaaatgttgatattgcaacagaataaaaatgttaaagttttgtaggcaaaaacacaataagcaaattgaatagcaagtgacaattcagataaaaaacctatcagaaaaacaaataatggaaattcaaaaaagaaacatgcaaaagcaaacaaatatatacaaattgttttgtatatattcaaataaatatacaattaaagaaaatggaatcctcttttctgtttatcaactaatagcaatggaaaaatgataattccttgtgttattaaagttgcaaggagagatgtattcccaaatatgctggtgaaagtataaattgctgtaaaaatttgtgaaatacaatttggtaatatagtgaaagacttgaagaaatgcatgcactttgattcagcaatattgctttacaaatttattcttataaactaaacatgctcataaaatcattgacaagaatgtttgtcatcgttttcattataatagtaaaaaatcatatcaacctaaatatcaatttagaatgcttaaattaattgtagtctattaattttgtggaacaatgtgtaattgtctaaaaatgacattgtggaaaaataagcagattgggaaggttca

SEQ ID NO: 7392 - DNA, 690 bp, mus musculus
aatgtttcttagatatagaagcttaccttacagctggatgagcagaaacagtcaatacagaatagttgttctgcaatcagaaaatcagccatggaacattgcattaatatgtttggagaagcttgctttcagatagtggtcaacaggtttcaaggtctcttaggcatggagaaataaagggaagagcattaacacggaaaaagtcctgaatctactattaattctttctgtgaacttaaaggaattacttatcttcccctttcttgagaaaataaacatgttaagattacctctctcacataattcacagaattgcatctgtaaagaacaagtaagggaggcctgtaaaacatcttgctaaggggccatcatgcaaaaatcagtcaatgtaatttttaactcgggatgttttccctgagcagggttgaagcttcatagcaaagcctcaggtcagaaggcatgcatgaactaaaaacaattatcctttagatgaataaattatgatctgcagagctttgtacacagtgtggtctctctaaaactacatcatgttgggagtcatgttgggattttagatgctaatatatggagacatgaggagaattataagggcatggagatctctggagatgtcccctgtgagaggatctacagctcctcattctactttcctggtgaagaagcaattaa

SEQ ID NO: 7393 - DNA, 1138 bp, mus musculus
aattaattagtctgatgatcttgtatgaatcttccttttctgtaccttagttcggtaatctatgaaattaggagttcgggatgaattatctccaaaatcattttattaagaatgctctatgaattattgtaatttaaagttgcattttgcggtcatgggcatgttttagatccgggactcctggaaacaagtaattacaatactggaataaagcaaaaaaatggcatgctgattgatctcagtagtcctccctccatttatcattctgattctgccttttcatttctacagggcagctacataattcccaatggagaacaacacagaggtgactgaattcatccttgtggggttaactgatgacccagaactgcagatcccactcttcatagtcttccttttcatctacctcatcactctggttgggaacctggggatgattgaattgattctactggactcctgtctccacacccccatgtacttcttcctcagtaacctctccctggtggactttggttattcctcagctgtcactcccaaggtgatggtggggtttctcacaggagacaaattcatattatataatgcttgtgccacacaattcttcttctttgtagcctttatcactgcagaaagtttcctcctggcatcaatggcctatgaccgctatgcagcattgtgtaaacccctgcattacaccaccaccatgacaacaaatgtatgtgcttgcctggccataggctcctacatctgtggtttcctgaatgcatccattcatactgggaacactttcaggctctccttctgtagatccaatgtagttgaacactttttctgtgatgctcctcctctcttgactctctcatgttcagacaactacatcagtgagatggttattttttttgtggtgggattcaatgacctcttttctatcctggtaatcttgatctcctacttatttatatttatcaccatcatgaagatgcgctcacctgaaggacgccagaaggccttttctacttgtgcttcccaccttactgcagtttccatcttttatgggacaggaatctttatgtacttacgacctaactccagccatttcatgggcacagacaaaatggcatctgtgttctat

SEQ ID NO: 7394 - DNA, 1021 bp, mus musculus
tatctccaaaatcattttattaagaatgctctatgaattattgtaatttaaagttgcattttgcggtcatgggcatgttttagatccgggactcctggaaacaagtaattacaatactggaataaagcaaaaaaatggcatgctgattgatctcagtagtcctccctccatttatcattctgattctgccttttcatttctacagggcagctacataattcccaatggagaacaacacagaggtgactgaattcatccttgtggggttaactgatgacccagaactgcagatcccactcttcatagtcttccttttcatctacctcatcactctggttgggaacctggggatgattgaattgattctactggactcctgtctccacacccccatgtacttcttcctcagtaacctctccctggtggactttggttattcctcagctgtcactcccaaggtgatggtggggtttctcacaggagacaaattcatattatataatgcttgtgccacacaattcttcttctttgtagcctttatcactgcagaaagtttcctcctggcatcaatggcctatgaccgctatgcagcattgtgtaaacccctgcattacaccaccaccatgacaacaaatgtatgtgcttgcctggccataggctcctacatctgtggtttcctgaatgcatccattcatactgggaacactttcaggctctccttctgtagatccaatgtagttgaacactttttctgtgatgctcctcctctcttgactctctcatgttcagacaactacatcagtgagatggttattttttttgtggtgggattcaatgacctcttttctatcctggtaatcttgatctcctacttatttatatttatcaccatcatgaagatgcgctcacctgaaggacgccagaaggccttttctacttgtgcttcccaccttactgcagtttccatcttttatgggacaggaatctttatgtacttacgacctaactccagccatttcat

SEQ ID NO: 7395 - DNA, 1161 bp, mus musculus
ttttcctcttaatgtcgaattaaaatacttgctcgtagttgacttaccattcctacaaagaggcagaaactttgagcaatctaggtgttttttttttctttcttcctctcctgaatacactccccaaaacactcctttccagttataattagcatcgtgatctaagtggatgctacatggaagaggaatcgccatttactcagaaaaaatgtcccttacaggaaccggcagcagctaggcgaagtcgccggcccacctccatccaaaatcatgctcgcgtgcttcggaagcatccgggtcactcctttcccgctttttcttgcagatcggcctaggccggtgtcagttctgtttctcctcttggctgcctgtacacccacagccttctggctgcaacattatagaatcagctgtgtcccccctggtgggggattggggatctgtgtttagccacttatatctactttagctgttaaagaagtccaaatgaaaatcaggtgattatggaaccatggggacttgggggtggagcaaaggtgggaacatttgtatcagttgagtcagcttcatggctccctgcggagccagggctgagccttgtcacacgcactcgccaattagagattgatcagccagcagtcaaatgcattctccagtccttgcaagaaggatcagccctttctgtaccagcctcgatcgccttgtactttggtctccttttctcccctgcctggatcctgcctcgtgcgggccatcctgttgctgagactcggggtaccgttctgctgacccagctccctttagtcacgtttgcttggctctagtaccaaatagttgggattaccaaagagtccccttcctcacatgtcagcacggatgccgtgactgccacccgtgtccccgtcaagtgcccgtgcccaagctagccgctgtgtgcactgcactgagtgagttatgaggtgcctttcccggaaccctcctcttgcctggacccaagagaggcaacagctggggctggggctcttggtttccagagggtctggactggtttgggtgctttaaaatagatatttagttcagtggtgcttatgggggagatgggactagaaacttaagtgtgagatttgggtggatgggaaagttaaatattggtctcttcaa

SEQ ID NO: 7396 - DNA, 222 bp, mus musculus
tcatctgtgggttgaccagtgcgcctacagtgcctactcttttctgacaactgtacagtttattgtttctgctattgttgaagattttgaaatccaccatgaaaaaagaactggaggcagcacaaaaaaaaaaaccttctctgtgtgaaatgctccacatgcccaacatatgtaaaaggatctccctcctgtcctttacgaggtaagcttcatgcagtgttt

SEQ ID NO: 7397 - DNA, 222 bp, mus musculus
aaacactgcatgaagcttacctcgtaaaggacaggagggagatccttttacatatgttgggcatgtggagcatttcacacagagaaggtttttttttttgtgctgcctccagttcttttttcatggtggatttcaaaatcttcaacaatagcagaaacaataaactgtacagttgtcagaaaagagtaggcactgtaggcgcactggtcaacccacagatga

SEQ ID NO: 7398 - DNA, 222 bp, mus musculus; identical to SEQ ID NO: 7397

SEQ ID NO: 7399 - DNA, 3377 bp, mus musculus
cagtcgggtcccggcagcggctgcagcgctctcgtcttctgcggctctcggtgccctctccttttcgtttccggaaacatggtgagcggcaggccacggcgcctgagggaggcggctgcgggtcggtcgcctgcgcgcgggaagcgactggggagcgacgtccgcaccccctcccccagcgccccgggcgggatgagggtctcgcacgaaggggcgggcggtgccggaatgcgcgtgcgcgcccgtgggcgccggggagggccggtctggacgtcgctcgcgctccgcctgggctcccctcccccacccgctggtgcgcccgcgcggacaccggccgcggggggaggggttcggggcgcgcgctggggcgcccctcgcggaacggccggcgtcgcgcctttcttcttaggggcgcgctctcgactggagcatgcggcgtccaaacccggcccgggggcggcgaggaaaaagcgcgcgagaggtctcggcgcgcgcgccccacccaaggctgttcctgtctgcgcgtcaccctccctcggcagccgggtccgtctcgggagcaggtggcagggatgcctgcgcccgggaggggcgggtgctggcgcggcgaggggtgatgctgggaagacggggtcccggttggggcgtgggtgcctgcgattaaggccttgcaccgcaaggcttggagggggcatcgcagagaccgcggcccgttcgggagcgcatctaacgagctgcgttctcacccgtgcatcgggcgagggctggaacggcgctgtctgtcggcgcgtgcgcgcacgctcaggcccggccgccggtgccgaagccctgggccagcgaggccttcccggatgggcctgagtgagggtggagccgagtttagggaagtgacccaggcgggcaccgcccggaaaccaccccgccccctgtatacggcccgagggctgagaaaaccgaaggttatgtagcttgcccaggctcctgcctgcaggagatgggtctgatacacccgttgttttagggcgattccacagggttagggacctggagatgctgctgcctctcggatacgcgtttctgcattggtgagggggccgggcccagccgatctcctgtccccgcccactccggatgcggccgagtcacgtggccggcttcttctgcagttccggggagtttgggggaccagatttaccttggattgcccctccctctcctggctcgggcaccccgaagcacgacgcagagtaggaagagtttaaagacctcgaggcctctgggcacttgagtttggcatgttaatttttatcagcgacttctggggcctagcaccattcccggaagaagggagttgtcgggcagggtccttaatgggggttgcaattcttgtcttggttgggaaagagcctagctgggaacaggggtcgtttgtgtagtaactgtattaagcagttctggtgggtttgttgtaactgttcggtgtccttggggtcccatctagcattgtggggtcttggctctttctgaagaggagtcttggctcaggtgtttgggtcctccatatccgaagttctaaatcaccagttttatccaaaggctgagagcaagtactgtgagtagcaaatgagtcagtagccggtggatcttttaattctgggttcacattttggtcaaggttctgcttttcacgagttttgcatttctatcctgtaaaatgagggaaggggttgttgaactaggtgatcagaggccatggctgccattctgaggttgtgtcccatctggttctttgacagtgacttgggtgggaaaactagtgacttgccttgggaagggcactagtgaccactcgggacgtggactgagatcttctgaaaaaacaaggggcagttccctagaatccttttcttgacgtatacgtggcatgtctcctaggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctggtgagctcattctggcacttcttcctgtcacctgccccctttctcatgatgggaacttctgtggctcctggtcaacccagatgtgtgggtttggagggggagggggttgtaacaaaagactcctcactgccagcccaagggtttctcaaagtcacctgtggctttgctgttgctgggagttgcctgacgcgtgtttctgtccagggcccccgagtctgcgccccttaagagcaaaatgatttatgccagctccaaggacgccatcaagaagaagctgacaggtaagggccagcattggtgctgagtgcccttctgctctggccttggctgcagggcagggtgaatggcacgcagagggggtctgcccccttgtcttcgctgcctgcttgttccttccatctgctttgattggctccttcccagccacagaaactacccccaccccagtgcttcctgctcacagatgctcccctttcttctttatagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaa

SEQ ID NO: 7400 - DNA, 1120 bp, mus musculus
ccccattctttggaattcgtggttgaatcggtgacacaggtgtaaatggttcatcacaatgcagcagagtgacccttgtaacagagtgaagaacaaggtgcgggaaggctgaggggccaaaaaaaaaactgcctggagagctgggaagacccccacgaggggtggtggccactctgcctcggtttctgcttgtctctctctgcgtatgttcgcctgcccaattctctcgcttgctatgcttaaaaaagagaaggaacttcaggcccctccttctctggtgccaactccaaaggctttgtccaggattacccaaacctcccagagatttagggggtggatcataaagccatccgtcttctccacatgaggttttcagtctcacaccccctcccagtcacctgtcctcatgtttcattcctttcttgaccacaaggctcaggcccagagttaaaaggaccaagccctagagttaaaatagtgcagtcaaagcatcaagatcaatgtcaaacaactctaggcttacatgtctttctctgggaaggggacagtgtttaagcaagtccatgaccagaactgacctccttcagggtaggggaggcacatggatatgtgggccaagtgagatccccttggtgggcaggaatggggaggaaccgggcacacttaattgttttcagtccaatcacaggcttacgacaagttcagacttctgcagttggggtgggagttttgggaaaggacaggtacaggtggaagacgatggttctttgaaccagggctgacccttgtgtccccttcagggcgcccatgtgagttgttaccgcctccactgtccgcctgtccactgcccccagcctgtgacggagccacagcaatgctgtcccaagtgtgtgggtaagtagccatgctcctccccatcgtccatggacctttctcctactcccagtgtagccctctagctgagggagacccctgcaaggagaggggcagtctctacccatcagaggtgtagacacacaaaggtgctcaagggaggaaatatcccagatccccaggcagtgctggggtagcagagacttcatgtccttaagtaggtgtgcatggcaggggagggaggaca

SEQ ID NO: 7401 - DNA, 1152 bp, mus musculus
aaatggggcagaggatgaacagaaagagagcaggaaagggtctccctttgctctgagatcccaaaagatggaaactagaacagtttatccaaccagttgtccccattgattgagcacttaatgagtacaaacaactctcctggggagaaggaggacaggcaggggatggagtgaattaggcggcctggtgcagtgggagaaagtgagctttggagttaggcctacctaggctcaacgcgtgctcccagtgacactgggctggccgtagtccctctcagggactttgtctcctctttgaatgccccggaagctgctgtcttcctcctgggcccgaggattggacaggacagtgctgctagtgccaggcctatgggcagagttcagtctgagcaatctcacctgccttcctctcagacccctgtccctgacagctccttcttccctccccagccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcggtgagtattgaggctggttggggttggggagggagttggctggggtgtggtcagggccagagtgccgacgtctccatgggagaatatggccctgcatgcactgaggagggtactgggctgggaggcaggagctagggcttccgctactatgtgacctagagaagagtccagcttctctccgatcatggtttcgcatctgcagggatgcggggccaatatgtggattgatggatgtccagcatttgaaggagttctgtgggttatatggtgtgaggcatgcctatgtatcttaaaggcacaaacccatcagcagcccaggcttgggagtgaaggtaataaacttacaggttctaaggaccatctagcctcacacttaacattcatcagaagaggaggctgacacccagagatggaggaaatgtcaccaaggtcacacagcaagttcttttacagatttccaagtgtgtacactgactgtgggcaaagggacagaggagagagccctgaattgttctcagatcct

SEQ ID NO: 7402 - DNA, 1656 bp, mus musculus
atgtttacttgatcccctgactctcatagaccctcctagcagaatgcagtgggttcaaccagtcttgatcccatctgcagcttagcacctggtggcctcgggtgggtcccttcacatgcccctgggcctcagtcttttcatctgtaataggggacaaccagagatgcagcacataaagcatttggcacagttccttccacatggcgggcccacagcccagcgtcaccaccttcagcatcatggtggatgcccaggggaagggtgttgactaaccagaagcctctgccctgtccctgcagtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctctatgagttattgctggggctgcatctgcatctgctgctgacacctggggaagactgggtccccagctggctgccctctgagccctctagccccttgcacctttggcccacatgaccctgccatggtgtgtaagttacctgtcactgtgtaacaaactacttcagagctcagtggct

SEQ ID NO: 7403 - DNA, 1317 bp, mus musculus
tccagccactcctggagttgcccgagacagaggaatccagcctcccaccctcaggacagcagtagaagcctggctctatccccagagtgcaggaatggcaaatgacccattttccctggaaaccacagggaaagaaacctgcctttccctgagctctgtgcccagagaggcagctagtgtggtgagcgacctagccagccccgccctgccagctggatggccttgggcaacctctgagcttgttcctcatctgtgagttggggccagcaatggcacctctctcgaggctgttgtgagggtgaaatgggcgagtgtccaccaagtgctcgagcttcccggagcctgcacacagtcaccctccctccctgagtttgcccatggttactgccccatcaccatagacacacggtctcctctctcagttatccgtgggtgggggtacaggagaacctgtggagagctgaagtgagttgcctgaggcatcctaggccagtgccgatggcagcaggcgcagggcggaggggtgggcaggaacctggcctggctctgtggtccgagagagcggccatgggggagtgtgtcctcctccgtcaccatcgccacctcagagcggcccagcagagaccattagccttcacatgattgctggggagctggaggcccgggggaagggggactcccccaaggctgggggtccctgcccggtctcagccaccccatgaacaggacctgccgtggccactctgtggtgcatcgacaccctggtctccggtggagagcagcagggctctgctctcccaagaaggcagggggtgcccaccactttcctgccctcctgcagtcatggcatctgaaacggggagtttgagagtcttggaatcagaagctgagagctgaggaatctcagatactcaggaccagggacccactagttttgaggactcacaaaggcccgtggcttaccttacccagcttgggttatacaggaaacctccctgtagcccccattccacagccctggcggcgtggctcagaaacgctccgcactggccctctggggtcccaggcagaaatgtgaaaagctccctgcctgtgccccacatctgcacacaccacctccacacacgcacacacttgcaggcagatcctgagcagcttccctccctgggctgccgaccccctccttctccactctgtcgcacagctgggcagagagtcctgtctgccactacccggggaagatttaagagcagccacttgggtctaggtgggagtctccagggacaatccaggagccagggatgctgtggtgcaccc

SEQ ID NO: 7404 - DNA, 512 bp, mus musculus
acctcttaacattctgaagaactgatgctccaaagaacttactttggaaaacatcatcatagacccaagagaagacatgtttatggggcctgaagagtagttcatatctttagtgagaagggggctagacgaagcaaatttccacctctcatcatggagaaagaatcactttgagctctctgagcacctaaggagacaacagaggtaattctaacagatccaacaattttctgtgaagttaaattggctcaacctagagcacaaatagaaaagggcccggaatcagccattcaattcactgaaatagcaaagggagatttttatttaaatggaaatgagtcactacagatttttttatatggaaacatgctatttatgccatcaatgtatagaggtccctgtgattaacattttggttctagacactaatttccagcacaacatggtgcagcatcaaatcattgtcaagcagataatgccaggcttccgtttaaggcattcacttcagctgc

SEQ ID NO: 7405 - DNA, 512 bp, mus musculus; identical to SEQ ID NO: 7404

SEQ ID NO: 7406 - DNA, 380 bp, mus musculus
agatgcacgtgaagaaggaactggaagataggttattagaaaatatgaggaatgaagcattaagagataaaatggtaaaacaaaacacagtaaagattataagatgcctagggtatataatattttagaattctaccatacatgtgattggagttctagagtatgacctcagatgtgaaagacaagaagaaaaagggcaaggaggaggagaggaagagaaaagaaaagaaaggagggaagaagaggggagaggaaaagagaagagaaaaagagaatagaggaaagagaatagaagggaacaaagcagaatcagtatttgaagagataatgggtgagaatgtttttagaaggatgaaagatatcaagctatagattcaaag

SEQ ID NO: 7407 - DNA, 1016 bp, mus musculus
ctgaagaaatagaaataagacatagaacttcacaaagagtttaagggaggagacagacttgtaacaaagaattagcaaaagtctacaagattattatttatttcaatgttatagacaagaaaagtggagtttgagaggtcacacaacaggagagtaaacattcagatttgtcttacttcagaatcttttttttttaacctgttctttagaagtgcaggagttttatgataaaatgtttgagaaaaaaagacagagagagagaacatgtagggtgtgtgtgtgtgtgtgtgtgtgtgtgtgtggtgtgtgtctgatgagcagcagtgggagggaattacagaattacagcattttaaaccagcttttcataatcccactatagtgagctttccaataacctctattagaaagtaaataccggaagcaagcatttgctccaccaacactgacctctaaccagaaccatttgcaaaggtacaaataaaatcatataagtcagtgctcattaccttgagcatgattgtgtgtatgtgtgtgtgagggggtgtgtgtgtgagggggtgtgcgtgtgtatgtacgtgcctgagcatgcatgtgtatgagaagtttttattgatcctatataggctacaaacaggcaaagaactcatctgttaaaagcttttaaaagcttgttctatctcatctcacctagctgttcatcctaagaactacaattttgacaggagaatataagcagccattagcagcacagcctatccttttataatttggggtatgtaccattctgggatggtcagagacattctgcagtttcaactgatgttgtagaatgaactctgttcatgagtagagagatgtcatttttataaacccagaatggtgggaagagtgtggtgggctaaccagagaattggatatgtaatgggatggatatttagtaagggtaggacttgtccctacagagacagtccaaattatatttctttatccaaagtagggagctattcataatc

SEQ ID NO: 7408 - DNA, 195 bp, mus musculus
agtttctctgtgagattttgtttgataaaagtgtttccctgttggtaatgcaatcacaaccaaacaaaaacaaaaatgaacacaaaacccttacaaagtctgagaagtgctgtcctaatgataggaatataggctatggatttggattcagtccctgactccagcaatcattgcttaagcaaattaggctttctg

SEQ ID NO: 7409 - DNA, 824 bp, mus musculus
tccgttaatacctttaagtgattgattggatgaggcccattcacattatggaggaaaatctgctttactcaaggtctgctgatttaaatgttaatctcatgtaaaaataccatcatggaaacatctagcatattgttactccaaatatctgggtagtgtggcctcaccaagttgaaaaataaaaatcaccccaggaggcaagactgtgatgcacaaatatttaaagcaaatattaagtaattgactaaaattgtggttacaatgtaatgctaaaggttaggaacacagacagaaaggaaatagtacttagaattgattagaaatacatatacagagaaatatactccaaattggaccttgggacacaggtgggattgtaacataaaagctaagtatattccatgtgtaatagagtgttagcaatgtgaaaccgatggattactaatctgggctaggtactacctgggacttcaaaaagggtatcatctgattgattaaaccagagaatcagtggtatgtttcagaaaggatctatgagttataaaatatatgattaaggcgaaacattaaccatggactgaacgatcagattcactatcttattagcttcctgcaaaatagattgggtgcttattatttcatttaatagaggagagctccttgtgtgatagatctgcatctactagtagtatgaacagttaacagtaaccttctttatagcaagagactccattaactcatctataaactaggaatacttgcttcatggctattataaagctaaattttaaatcatgttattttgttcataatattgatggagg

SEQ ID NO: 7410 - DNA, 412 bp, mus musculus
catatgtaagtaaatgtagatacacatatacacatagtatatgtacatatgtatatgtatatacacatatacacatagtgtatgtacatatctatatgtatatacacatatacacatagtatatgtacatgtctatatgtatatatacatatttatcttttagtatgttttctcatatatgactatctgatgttgttacatgtgtatatatctagtcatatatatattaatccaatataatatattttatactcctagagacaaagaaatacattttttcaatcaataatgtaatttttggtagtttggtatattctaaacaaaaattgttgatttttaaaaattatatgtgtagaactcctcgcagtttatacactatgcccatgtacattttttcatatggtgcttacag

SEQ ID NO: 7411 - DNA, 412 bp, mus musculus; identical to SEQ ID NO: 7410

SEQ ID NO: 7412 - DNA, 1434 bp, mus musculus
attttaatattctcaggtcatctcaaatggaagatcacattactgggagatcagagtgtatacattgctattaatagttacctacttaatatcctttctctctcttcactggcaaattttattcacttagatgggcaccaatacactcaactaaaatatgtgatttttcctttcttattgtctctgatgtttgaaatattcttgtcaccttttatgtattcaatctactccaaattatgaccattctactttgatcatcatccctgtagagcttctacctccttttccagagcagcttttaatctttcagacccattttttatctcctgacatatgcttctcaaatgttcaaggacatttctcgacaagtgttgatcattgtaaaatatttatttttatattttacctggctatgaatgatttcatggaactagactttgaaatgaatgtgttttctcatcattaaatttggtaacacttagcaagactatgaatgggatagctctttttctacagtcatcttggcttaacatctaatgtgtttgcatatgcatgattatagtctcctcgtgaacttacattactaagtacttttaaaatacaaatgcttctctaataatcatattgataatattcctttttttaaattgtataaagacattctgctacatctgaagttattaaaaatgaactctgaatatttttaatacctccagaacactgtccttcttatttaaaattataacccccccaaaataaaataaacttaggacccttatatactgaatgcttattgagcgcttgccactttatttagttcatgtaaccctcacaaaattgaagaagaaattggtgttgtccttgtttaaaagtagaagatatggaagcttgcatagagacattttgtaaatagcagaaattgaatgcaaatacttgtgcttgtaattttaaaggagctgattatgattattctgtttgattactatttatattcatatatgaccagaaaaaaagccacacacctccaggaattcttaaaggtcccacaaaattgagtaaacacaagtactcaccaaagtgatttaaggctactagaaattttctgtgggcagcctcatcagagttctctgcaggtaacatagacagaggtggtgtttcatttttcattctacatttactacagaaagaggtatttacattattcctttgttagagctgaagatcaggtagggaagaagtgcattacttttctagcaactggcaatttattttatgtaagatataatgagactacatttccaaaatgattaccaagtatattcccaatcaatggaattgaaaggtacatcatcagtaagctttcagagtccatcttttgtatactacgaagattcttgttatatttcatatttaatttccatgtttaactgcttc

SEQ ID NO: 7413 - DNA, 1434 bp, mus musculus; identical to SEQ ID NO: 7412

SEQ ID NO: 7414 - DNA, 4102 bp, mus musculus
tagtcagaggtccaatttcagagttgaaaaatgtctgctattttcagcacatctatttctaacttcacatttgttttctctgcaagataatattaaatttaaaaataaaataaagtaaatcattttgactaaatgaacagcacaaagcctttggcatcagatacatcggaaccttggctcaaacatttattttccttgaagctattcactacttaattaacttcccttggtctcagtttttcaatgtatataaaaatgtaagatttgggaggccaaggccggcggatcacgaggtcaggagatcaagaccatcctggctaacacggtaaaaccccgtctctacaaaaatacaaaaaaaattagccaggcatggtggcaggtgcctgtagtcccagctactccagaggctgaggcaggagaatggcgtgaacccaggaggcggagcttacagcgagtccagatcgcgtcactgcactccagcctgggcgacagagtgagactcagtctcaaaaaataaaaaaaataaaaagtaagataatatggaacttaatgtctggtcggtgaggtaaaaaggaaatgagtgtaaaagagatatcatttgtgacctccagacttagatcatcatgtaaatattggtgccaccaaatgcaatagaaaactctgaaagaatgaagaaggccaaatgaatgtgttgatacacggtgaaggttttgatgggcaaatggccatggaacatccacgatactagcaggaaaatggttctggtgctcaacttttgttttcaggctggaaaagtaaagaagaggaatcaaaaggaaactagatctgaagaaaatggagagctaggccgggcgtgatggttcacgcctgtaatcccagccctttgggatgccaaggcgggtggatcacttgaggtcaggaattctagaccagcctggccaacatggtgaaactctgtctctactaaaaacacaaaaagtagctgggtgtggtagtacgtgcctgtgatcccagctactcgggaggctgaggcacgagaattgcttgaatccaggaggcaaaggttgcaatgaatgtagatcacgccacagcactccagcctgggtgacagagtgggagtctgtctcaaaaaaaaaaaaaaaaaaaaaaaaggagaaataaagtgatgaaagtataatagaaaatggaagaattaacagttacagcaggaggagtgaaatatttgatgtgaaattatcagggatagaagagtctagataataacaagttagagagtatagtcaggagctagtattgaggaatgaagcttaatgagatggagtttattaaagaacaataaatcaaagttcttggatgatatttttgttaatctattgttttgcaacaaatatccctaaatatagtgacttaaaaatacaacagtgatttacaaaattacaaatttacaaaattacaaaaatataagagtgacttcccatgtatctggaattctggaatttggggttggcttttgtctgagaaaccctgttttctccctccagtagtctatactagcttccttacactgcagttttagggcaatgttccatgttggtgaagtcagaagctgcaagacttcttgaggtctcaatcctagaaagcacacatagtcacttccaccatattctgttggtcacagtcaaaaggccagtttaaattaaaaagctgaattacttaataaaaaatattttaaaaattataaccatatttaatctaccacaaatggaatatcgacttggatcataaaattacctggattgcaactggatttgagttggaaaaaaataacaatgacccatttaccaaagatataatgaatatatcaaaagcaccaaaaaacttgcggatgatgcaaggaaaaagagatagtttcagcgaggtaggatgactcacaaaggaacaaatattattgtacgattataaaagttataatttggatattgcatatgaagaatattgacctcatgttccagtctcagtgtaccttttgttccagggacccaatgtatcaatgaccttctgctgacagaatcaacaatcccaaaatataaggggcttaaaacaatagacatgtatttcttgtttatgttaactgaggaccacaattcactgaggttctgctccaaaacatgatgaaggtgagatctgttccatgcatcttcttcttctaagaccaggttgaagggacactcctgtcagtgacgtggtattctcttggtagtgggaggtaaaagtgtttaaaactgaacattgaagttcagttttataaaattatacaggccaattataaaattgtccttgtagtttacttttgaaagcaagttatctcagatgtctaacaatgacaaagtctagtcaaggtatccttgacccactttatcagggattatctgcccatgttgtggtcagaatcctgtacttatgccaaatggcaggaagtgatttccagcacagtaaatagactttaccccagtcgcttacccctaatgtgagtacaaaggaggaagtaacataggtactgaactgagattgatgcccttattcgatgaatgttataaaaatagcacctggaatatggtaattaattcctacatttccaaatcagaacagaggcttccaacagttaaaaatcctttctattctcatgatgcacaatgacagcttgttttacatgatttagctagtagtgaacagaattcgatttattaactttttgcaggaagagagacaatacaccattgtgatctgtgcgctgtcttactaagaaagagttgaaatgtacttaacatggtgtttgggcttttgctgagtgatataaggaagggcttaagaaaggttgggagggtctgttttggattaaattctgtcaggaagcgggtcaattatccttttgaatatttatacttcttaattggaaactttaaaatgtttttggtctaggaggtgtgaggaatgaaacagagctagaattgtccttggtaaaaaagaaaaaaaagcagtagtctctcatattttgggggagtggagattttctaatagtattatagtatctttatatttttcttatattcgtatatctttatagagtggtcttgtttttgcttagtgtcatcatgtcacagaatgttttgccttattattgttaaaagtctatgaaattgtttatgtctggtagagaatgctgctgctgttttgttatttcttttgtatttatctttctcaaaggctttagttttttttaaatattgtttgtattgtcctatagtcgttattcttaacaagtcctaattggctttcttaattgtaactttttctatgaattagaaggcctcactttctatgatagacttattaattggtttcatcatttagacttcctttaaaacaatcgctgatattgacatatcgtaacttcatcgctactctcacaacctccatttacaaatatgagactacttggcagtaataactgtagtgctacatattatttcctctttaaaaaagtgtctggaggtacatctttggttcttctgaaaggcactgtgagagcagagatgtacagattagttcctcacttagtcttagagaagaccttgcaattttgccttttctctggctagctaatgaaaactaagttcttcacccaagtcctttacaccctttatgcagcacaactttaacactttaattttaacaagtcccatttcctcatttggtctcttgaaaatatctatgagaaaggaaaccttgctttgttcacatcacagttcatattgcaagatagtgagttcctagatggtttaaagataattttagggtgtataatcaacctaattatattatcttttggatacaaatctaagaacaaacattacatataacatgtctttggttttggaaattacataattttgtttcttactttacccttaaaatttgtgggaacactactcttaacaatgctttggactcgtggtcttctgaaatcttttgtcccactctaggctctgtttccagctgaacttccttgttaactcatttctattttcgtaaagctgtttca

SEQ ID NO: 7415 - DNA, 4102 bp, mus musculus; identical to SEQ ID NO: 7414

SEQ ID NO: 7416 - DNA, 1418 bp, mus musculus
catcatgatttggtggaatggcaagaattttgaggtcattggaaattgagatgaggtggacactagaaagatgacgctggagagaagtctggatggtgaaagatttcctttgccaagttatcagttaacagtgagaaattaataaggaggcaatcctacccagaaaccaaagcaaatgcaccccctgctccaaaccccaggcttcagaaagtcccctctggttcttgttcagttgttcctctcaccacagcacaagaagtctgtggggccaattgaacatgcccacctggagccttccccccaacctttcccccttcctcttgccttcctaactcccataaacccctatcagcccactgttctaaactatactccaggtaattactcctaaccccagaattacccagatgccctcaaatccacttccagagtttgagacagtttcttcctcaactccattctcccaagcacaggcctcactgctggtgtgtgtcctctaaggatggggagaaggccaggggctgctgttggccagaggtagggttatagataaagcctggatatctgagtgggagcagagctggttgcaaagagaagcagaaacagggtaagggagaaccataggttacaggtagcagcttctatttgtacctttacctatgcaaatgtcaggggtgagtttgtagggagttctcaacttttaaccatttcacacaattttcttaactgtaagaaataccagattcttgtatatgttatcatagatattcatactaaaattaaagtcttattatttcttactagctctcatgctgaattgtattaattgcctctcctgcaccttcaagaaagcggtcttcaatctttaaaattttgtaagaaccctagacctccaatacagtaggaagtctactcacccatgggctttcagaagatgccttatcataacggcatgagtgaatgaatttgaatgaaatgaacattttccgacctgcttgagagatttattttggcattgttttaggactcaaatccttggctttggcactgctacagtgaattgataccttgctgtagctgcctctgaattctgctttaactttgaatacgaagctttggagtgctacgcgggctcttatgtccttttcatttatacccagcattcaataccaatgccacaatcttttttcagttttattatttccctatcattgctattgatgcttcacctccctaggtacctcagttccctaggagtcctgacatagcaaacaaccaataataggaataactatgtttttgcaaaatgcagtatctttggcaaattctccatgatgaactacactcctttcacttagtttcccaacagcaaagaaaggtcttaattttctccttaatttttagagggctaagctgca

SEQ ID NO: 7417 - DNA, 677 bp, mus musculus
aaagacaatgtgatctgaaaagaaaaagtaaataggtgagccagattagaatgcttatggggataaggaatgatggtagcaagaaaatgagcctgtcacatgttactgcctgtggtgatcagtgccctaaactgccacatgaggttgcttacttccatttgttctgacctagcctctttgattttccctagcatgaggtacatatgaagatgtagaaagaaaagggagatctaaaagtttcaaaagtcacttgtcatggtattcaataagcctgcccatctgccactgcctaactttgcagcttctatcttccaagcttgtccaggaccatcattgccccactccctacccttctgtctcttagaattgtgtaaggtttctgatgagcacgggtttgtccattcttcatcatttgcataaaatttctctttctggaatgcccaacacctgcttgctgatctgatgaactccaccttattgtataggatgtggtgccacctcttctctgaatcttttccacgcttgtctcacttccaaagtacagtaggttgctgcttgatgagccatgctacagtcttttcataccctttattacgtttgtcatattctatctatgggtatgtgtttgtacatgagtgtcttttacctatttgttccttgactgttgagattgtttt

SEQ ID NO: 7418 - DNA, 186 bp, mus musculus
actaaatgactgtcatttttgtatggctctatgacatgaaatttatattttactttaatatagaggcaatctgggtactttgcaattcttaaaaacttatgataacagagaaaggaagactttttttgaaatctccagtttaaaggtggaggcatacagatttcagaggataaaaaagaacatgtt

SEQ ID NO: 7419 - DNA, 1418 bp, mus musculus
ttcgtaaggtaggctattggacaaatttaggtagtttaattaaagctttttaaatttggggcttaatttggctaacaaagttatagaaacagattcattaccattataaaattatataaagtatatttcagttgtttaatgttttcacatttgttgaaaatagatactataatctgaaatcagaatttaatggcaatctattgcctttctttaccttatccccaatcatttagaaacaacatgacagagttgaaagcacaaagttttggagtctgacaaatttcggtttgagtaatcctctgctgagccccttactaagtatgagtccctgggaaagctaactcttatcttctctgagccttagtttcctcttttgtgaattaggaataacaactaccttgtaggtttgttgtgtataaggaggaatattcttcttaaagcttcctaaactcaatagatgatagtttcagggtgagatctattaattttaactgaatttgaatgcctcaaagtgatctaaatttttcattttctttttttctcaataattcacttgctagtcacctaattggaaaagtttatagaataggttaacagatgtcaagtacgaaaaaaaaaaaaaaagtaataagaagcactgtattttgtcggcatagcccagacaatccattaaaaaaattaaaactggagtccctttttggcccctgggtatgactcatgtgtgtacacagacatataaaaattgcagatccaaacatttccatcagattactgactgctgtgtggcaatatgaaaactactttataaattctataaaaatacaaggacatatatatttggtagaatgtagatatttcatgacaagttaattttaaattagaaaaattgtaggtgaaagagaagttatttatttcagttgcctaagaattccaagcattcttcatctactgcattcaaactaatctgtatgtgtgttcaaaggccttgatagtgagatgcaacaattacatagctaatgctgtttatattttatggtgctgccttcttgtttggctattggttcaattgctaggctttcttttgtctttttctttttctttttttttttgaaatagggtcttgctcctgcctcagccttctgaagagtagaactttcactttaaagttacattttgtcaatgagaaatgacatcagtgattattaggtttgtaagtagaagtcagacactctgactatatattatagtattatatattatatactcctttttatatatattaaagatatatatttatatattataaatatatatgtgtatatattataaatatatttatatatttaatatattaaaaatatattttatatatattatatagtcctgattatatattcctttttagtgtatagtttatt

SEQ ID NO: 7420 - DNA, 1298 bp, mus musculus
taaacttgtcctttttattaagcgtttaagaaactgtatcacagcttctccactgaagtcatgcatctgatgtttaggctctgctgataacctcactgcattgcctttacaatgtgtgggataaaaggatgcaacccatgggtgtctgtgaccagttctgttaataattgttttccttttctcattatactttgacattttagaagccaaatgctgttccacactctattagcctcttgcactggattgggactgaagtttggaacaaagagaaagtaaaaatgtaaaaacatgtaagactgaaatggcaaaactaggataataactttagcacaaatcacctgctgacacctggaaattaaggagcaatcacttacacagacagatcaaaggaaaggtgtgaagagccagggacagagcagcctgccccagatgctggtcagttcctttctcatgggtgttaccagagtatcagacagccattgttgcaaaatatacaaccacaaaatttcagtgtcatacaacattgaggtgttgatttcattcacatctggctgatttaggctgggcttggctgggcagctgtaagctgctgattgcacctaagtctgcctgaggcttcatccttcttcaattaaatgctttccaggggaaaattaactcatggcaacgtgagagaaacgagaggctgcacaaccaggcaagccctgaccacatagccaagcccaaactcaaggaggtagtgaagcatgttttttccacggaagtgtcagagaaggaagtaaatattttggaatgactaatgtccataggcagaggcctagtctgaagcatttctataataatggagataattgtgctaaagaagtcaagggtaggtgattcttgtatttttaagtcccggatatttttactgggaaatgttgctgataggacaatgagttgatactatctttctagggcatatttgcaatatatattagcaatttcttacctattgacttctaagaatttgtctgagatgtatagaaagatttttatataaagtcatccacctcacttttatattagtgaaatactggggaaaattacaggtgtttggttgaataaaatatgtgacatccagataatggaatatttatgccacatttcagtgatgttataccagaatatttaatgacatgggacagtattgccaatattcttgcttaatgaaaaaaagcacgttacaaaacagcagatattttgtttttaaatcatgtatatatgggtattcatactaagattctgtagggata

SEQ ID NO: 7421 - DNA, 753 bp, mus musculus
ataaataaaatccactagacctttaattgtgaaatctttgtagagtcttctggtataaaaattgggctggggaggagtcggtactgtcagttccacagtaataattaggcctgggcagaagatggaggaggcatcgtagaagatgctggagattgctggcagtagaggagaaagacagaaaaacttttagagcagatatgtcaaaaggtgaaggggctgtgtcagccacaatgacatagactgggctctctccctgcctggggcagaggcaggaggcagagccactccagctgataaataaatggctaacatgctgagggcaaatagggtgctgatgctgatgctcatcggattgggcatgtgtgctgtgtctcacaggggccttgatcctggccccagccttggccagagcagtttaagggaagcaggcaggaagagaaggtgggagaagaacaatgggacatctccctgggcggcacccaggacagctaccaccccctggcacatcctacttaacctggaaggaggctgaggctgaagccagaagacatatgtgttggcacagatcttcaaggaaagacccagccacaccacagagctgaaaatgggagggtaacactggataacatgggcgcctgctacatgggaatatgtgcccaaatacaagtgcatctgtgatttaatcactgcccctttccttctcatagaaatattaagggacctacttctgaccattacatgcccgagagttcc

SEQ ID NO: 7422 - DNA, 796 bp, mus musculus
tgtttagctgtatatgtaaccatctgttttccctccacagaaaatctgcagctgtgcctaggggagtttctacccagacttctagatccttctgcagaaatcatcgtcttgaaagagcctccaacaattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctct

SEQ ID NO: 7423 - DNA, 984 bp, mus musculus
gcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaa

SEQ ID NO: 7424 - DNA, 1140 bp, mus musculus
tagttaatgctgaattctttaatagctgagttgcagtaacattaggtattcactgtgggtgcctctgacttccttcagaggtcaatatatagggatcagggtggataactataaaatccaggttgtattcctctgtacagatagtgtagctgtattagtctgcttgggctgccatattaagataccatagtgtgggtggcttaaacaacggaaatgtatttctcaaagtctggaggctggaacttccaagatcaaggcattggaaagattggtttgattctgagactcttctcttggcttatagacagccagcatctctctgtgtgtttgcatgacctcttctttggacatgaacatgtgatgggggaagacacagcaagctctctgatggctctttttttaagggcactaatgccatcatgagggcctcacccttataaccttgtctaaccccaatttcctgcaaagggactgactccaaataccccctcgtcagggcttaggacttcaacatgaattttgggcggatacaaacatttggtgtatatcagcagccacaagttatagtgttctgtgaacctgaagctttctccttataacttgtgtagtttgtggttaaggaccagagccatacatctgctctgatctctttcttacccctctaggcatctctgtggtaatataaggaacactttacccatcaatagattagaaccttacctgtacttgtctggagagagaatttttgttcccgtaattctttttgaagtgtcaagaacttatttagtttcactggattaaagagagcaaaattatcagcttgaatcaggagcaacttgaaggagagatcagggctatgaagcctgttgggagatctgcatttataaggagatggcttcagcaaggataagtcatatcttaacatcttagtcttaaaggacagatttgttgcaaagaaaatggaaatggtaggaaaaagtgctaagtcttttttccgtggcagcatttcagaattgtgtattgtagctcaatttttgctgttgcctctcccttctgttaatattagagtcagaagcctgatcagacacagtgctgttttttctgcctaaccaaagctgtggacccgtgaaacctgtaaag

SEQ ID NO: 7425 - DNA, 1300 bp, mus musculus
aaggagaaagaggagagaccagcagagggagaaggggcaggagacaggaagccagcactaaccacatgccaggtgctgggctggtgcttggcatatgtggccttagttagcgcctgtggaacaaaaggagactaagttcagatggcaggaatagaaatgggagcagaaacagggaaggaagccagccaaaggagcagacattcacaagcaggaggtgtcaccagcagtgatggatgctgcaggaaggccaagaaagatgtggcccaaaggctgttagactcagggatgggagcttgtcaagagaaggctttctgctgtgcatggggccaggagccagactgcacaagattgaggataggtgggtggtaaggaagcggaggcaggagtgtgttactatttcctgtgaaggaagggatgggagagaacaggagctggagggctgagcaggcccagagccaggcagggctggtcctttaccaaggaggaaatgtcagaaatgggcctgtggctggataagggccatgggtgccttgcctattccgcttggaccctcttcctgccaactcgatagaaaccccctcattgcatggagtccagattacgtattatatctaggaagcctttcctgaccccaccttactaggagtgattcccaccctcctctgaacccctgcattatccagcatctgtttttccatgtgacatcaatccaggagtgtaatgatataataacagtgccacgttatgtgccacacactgtgctgaataccttaaatgtgttctttcatttaatactcatgacaacctgtgatgcgtaggtggtctcatggggttcctagccatgcctttagtagctatttacatagctgtgtgtctgtattttcctcactgtgagattgtagtttcctaagagaagggtctctgacttctctctgaatcccagtgtctaggactcattccttcagtattgggtacctactgtgtgccaggcacatagttgtttgtgttgggggaggtagaccatggaatggataaaggaggattcagattcagcataagttctatacagaggagcatctgtgctttgggaacacaggagagcacaactgtgcactgtcgtggtgacattttgcaatgggtcttgaagatcatttaggagtttgctaaggaaatgggctggaggagatagttccagcatacagggtgtattattaagggaacagtgagaagctcagataggacttgggactcatgcaggggaaggttatgatacaaggctggagggacatgttggcagcag

SEQ ID NO: 7426 - DNA, 1300 bp, mus musculus; identical to SEQ ID NO: 7425

SEQ ID NO: 7427 - DNA, 2168 bp, mus musculus
tgtagttggggcttttagaaatattgttaataaactttgagctaatagttgcgaactcaacatgctgaaagtttgtaattaagaacagtattggctgggtgtggtggctcacgcctgtaatcccagcacttcgggaggccgaggcaaggcagatcacctgaggtcaggagttcaagaccagcctcgctaacatggtaaaaccctgtctctactaaaaatacaaaaattagctgggtgtggtgacatgtgcctgtagtcccagctactcaaggaggctgaggcaggagaattgcttgaacctgggaggtggaggttgcagtcagccaagatcatgtcactgcactccagcctgggtaacagagcgagatctgtctcaaaacgaagaagcagcagcagcagaaggccaggtgcagtgactcacacctgtaatcccagcactttgggaggccaaggcaggaggattgcttgaggtcaggggtttgagaccagctgggccaacatgatgaatccccgtctctactaaaaatacaaaaaattagctgggtgtggtggcggttactcagtaggctgaggcaggagaattgcttgaacctgggaggcagaggttgcagtgggccgagatggcagccactgcacttcagcctggacaacagagcaagactccatctcaaaaaaaagaagaggaagagtttaatatttatataatagtattgctgagggagagtctaaatctgggacactataataggttctcttttcataaagagatttgtacatttgagttttcataatgtcctgtgtaatgattcaactttttatttttatttcttaatttttttggcgggggagacagagtcttgctgtgtcacccattctggagtgtggtgtcatgatcatagcttaatgcagtcttaatctcccaggctgatgtgatcctcctgcctcagcctccccagaagctgagactataggcacatgccaccattcccagctaatttttttcatttttttttttagtagagatggggtcttgctatgttgcccaggctggtcttaaactcctgagctcaaacgatcctcctgcctcagcctccaaaagtgctgggattctaggcatgagttactcactgtgctgcccagcccaattttttaatacatctcggtatctagattataaggggcagtgtttcttttctttttttttatttgagacggagtttcgctcttgttgcctggactggagtgcagtggcacaatctcggctcaccacaatctctgcctctcgggttcaagcgattcttctgcctcagcctcccaagtagctgggattacaggcatgtgccacccacgcccagctaattttgtatttttagtagagatagggtcaggctggtctcaaactcccggcctcaggtgatccacccaccttggcctcccaaagtgctgggcttataggtaggtgtgagccaccgtgcctaggctattttttttttctttctttcttttgagactgagtctcactctgtcgcccaggctggagtgcagtggcgcgatcttgcctcactgcagcctctgcctccgggttcaagtgattctcctgcctcagcctcctgagtaggtgggactacaggtgcgtgccaccacgcctggataatttttgtatttttagtacagatggggtttcaccatgttggtcaggctgctctcgaactcctgacctcaggtgatctgcccaccttggcctcccagagtgctgggattacaggcgtgagccactgcatcataaggtgcagttacaggtgtgagccactgcatcataaggcgcagtatttctatagcttcttaaattttgtaaataatgatgtatagcatgttctcccacctcaccccatattttcttatatattccttgatactgtttcagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacaggtaagaaatgattactaaaaggtagtgtagctctctgttattttagtcacaagtatttcagtaaattattaaaaattgtttttaagaattaaggaac

SEQ ID NO: 7428 - DNA, 2168 bp, mus musculus; identical to SEQ ID NO: 7427

SEQ ID NO: 7429 - DNA, 1827 bp, mus musculus
ccttcgtccccctcctcctggctccccatatcagatttgaacagaaattgggccactccatctttgacattagcctcctcctcaaatgtcccagcaggctggggagagcctcagagatgggagccggcttgggcctacaaatctcgccttcctgcccaaaccggggttcagcccactaggccattttcatccagcgggtcaaaaagggcattgccaaggcttctcttcccccgatctcctgcttctaggtgtcctgtttctcagtggacagtgttgatccaaccaactacagaagtctgtcctccatttcccagggacaggggttctggtcccttccaggggcaatgagagtgacctctaggtcttagtgtgaaggatcctggaggtcacacagaacacagcaatgacatgtgtgggctcttgagtcaagtcaatgtttgtatgtactgggacctcactttcctcacctgtaaaatggggagttggggggatttaatgtgtacaatgcagtggctaaaataggttaaataatggctactacagtggctagacccaaaattaaaatttgcctttcctgtttggatcatctggaaaattcacttttttttttttttcttgagacagagtctcactttgtcatccaggcaggagtgcagcagtggcacgatctcagctcactacaacctccacttcctaggttcacgtgattctcctgcctcagcctcctatggagctgtgattacaggtgcccaccaccacacctggctaagttctatattttgagtagagatggggatttcaccatgttggccgggctggtctcaaactcctgacctcaagtgattcacccacctcggcctcccaaagtgctgggattacaggcataagccactgcacctagtctcacatttctactcaaagcagtcgtaaggttcagtgaatcaatgtgagggctttgtctctcagcttgatctacaagtttttgacaaaccagaggtgagcggaaaggagaaagaagctgaggtgagcaggcaggtgtgggtagggatggccaagaggaccatgaagccaagccggttatttgtctccaggtgagcctggggagcccagagctcattagaagcccttgatcagctagcagtggacgcagcctggttagacaactaggccctctctaacggggcctccagggggctgcaccaccctgagtggagggtatcctctggtcacgggtactccgtctcgtcctatgtggcagtctgcagagtgtcagcactggtccttcccagccccaccccgacccttgtggggtagggtgatggtggagagccctcaggcactacagagagaactgggctgtctgtaacctccaggcaccatggaccatgcttcagaatccccaggacctgaaaacctgccctctccatgggacgcacaggaccacgtcatcagtgggtgacagatgctcccaaagagatcctgcaccccttctatgaccagatagggctccactagcccttacctggtgctctgcccccagagctgggcaccagccccttttctaccgtaagggtcctcaatgtagccccttcaccctggcaaaactccagcatgggtctgatagactctctcctgaaagtatttcctgaccaggacagacactgggagcccacctgtcgatgagccagccagccctggtgaacttccaagggtcactgagggccctccagaccgtacgaagtgtccattctctatgaaaggggcctttcagccccacagacaagaaggtccctgcacatgtggaaagcactgtggacccaacgaagg

SEQ ID NO: 7430 - DNA, 304 bp, mus musculus
gcaagcctgtttaactttaggcaaagcaaatagtcttcctttctgaatttcaatgcttaaggtctgtaaaatgggggtgacaataattctcgctttggcccacttcaaagggttgctgtgcgatggaatgagatagataatgctgttataatgttatgcaaatgtaaatcactgctatgcaaaataacttactgctatttccagaaactcctctttggatttaatttaatcaagagtgagaatataagttacttattctatgctctgggtgcatttgtattttaaacctcatcaattatcttgg

SEQ ID NO: 7431 - DNA, 6662 bp, mus musculus
aaaaaaaaaccttcaatccatgctttgcagaaactcaaaatggatggtaggcctaaatgtaaaacataaaactacaaaacttcgactggatgccgtagcttatgtctgtaatcccagcactttgggaggctgaggtgggaggatcacttgagcccagaagtttgagaccagcctggtcaacatagcaagagctcgtctacaaaaaaataaaatattagccagatgtggtggtacacacctgcagttccagcttctcaggaggctaatgtggatctcttgagctggggaagtcaaggctacagtgagccatgattatgccactgcactccagcctgggcaacagagtgagacctggtcttaaaatatttttttttttcaaaagaaaagcatataagaaaatctttgtgaccttggattaagcaaagacttcttacatttgactaaaagcatgatctataaaagaaaaacattggtaaattgaacttcatcaaaattaaaacacctggtcttctaaagacactgttaagagaatggaaagacaaaccctagactgggagaaaatatctgcaaagcatatatctgataaaggactttatatatatatatgtagctgtatccatcttagtcttctaaggctgccatataaaatactcttgactgggtgggttaaataatagaaacttattttctcccaattctggagtctggaagtctgaggtcagggtaccagtatgattgggttctggtgaaggctgtcttcctggtttgtagacagctgccttctcattttgtgctcacgttgcctttccttggttgcaatgcatggagagagataaaaatctctctctttatattattaagggagagagaaaaatctctctctctttcacttcttatatggcttctaattctatcagattagaaccccactcttagttctcattgaaccttaattacctcctaaaagcttctttttaaaatacaatcagattagaagataagtcttcaacatatacactttggaagggcacaattcagtccatagcaataagatttgaacagacacttcatcaaagaatatacctgacaaatgaaacataaaaaaaagccccagaccagacgccacgacacagggcggtaatcctggcattttgagaggctgaggcaggtctatagcttgagctcagaagttccaaaccagcctgggcaacatagtgagacggtctctacaaacaatgcaaaaattagctgggcatgctggtgcgtgcctgtagtcccagctattcaggaggctgaggtggaaggatcacttgagcctggaaggtggaggttgcagtgagacaagatggtaacactgcacttcagcctggatgacagagcgagatgctgtctcaagaaaaaaaaaatgccccaaaacatgagtcattaggaaaatgcaaatcaaaaccacaataagaaattactacctatctttaaggatagctaaaattaaaaagacttataccaagtactgataaagatatgaagaaactaggattctcaccattttggaaaacagttttgaaaaataatttagcagtgtctgaagaagttaacaaacactcatcatgcctcaggcaggcattcattcctaagtatttacctaggagaaactggaaaatttctctaagacagtttgtatgactattcatagtagctttattttaatagctccaaactggaaataatcccaaatgtctatcaataggtgaatattaggtaataaagtatgatatatttatacaatgagataccacttagcaatagaaatattgagctatgagtacacacaaaacatggctgaatctcaaaacaattacgctaaatgaaagaagtcggccgataaacagacaattctcaaaagaaggcatacaagtgaccaacaaacatacgaacaaatgctccacaccagtattcatcagagatacgcaaatcgaaaccaccatgagataccatctcacaccagtcagaatggctattactaaaaagtcagaaaacaacagatgcttacaaggctatggaggaaagggaacctttatacactgttggtgggaatgcaaattagttcaccccttctgggaagcagtttggagatttctcaaggaacttaaaacagaactactatttgacccagcaatctgattactagataaatatccaaaagaaaacaaattattccaccaaaaagacacatgcatgttaatcacagcactatttacaatagcaaagacatggaattaacccaggtacctatcaattgttgatttgataaagaaaatgtggtacatatacaccatggaatactatgcacctatgaaaaagaacaaaatcatgctctttgcatcaacatggatgcagctgaaggtcattaccctaagcaaattaactcaagaacagaaaaccaaatattgcatgttttcgtttataagtgggagctaaacattgggtattcacggcgtaaaagtggtaacaatagaaactgggaactactagagggaggagggaggagggtaaagtttgaaaaactagctattgggtactacgctcaatacccacatgatgagatcatttgtaccccaaatttcagcattatgcaatatacctaggtaacaaacctgcatgtgtatccccgattctaaaataagttgtaaaaaaagaaacgtaaagacatttttttgtcagaccaaaaaaaaaaaaaagaagccagaccaaaataacagtgaatactatactatgctattatttttatacaaatttctagaaaatgaaagttaacctatagcaacataagcagatcagtggatgcctgaggatggttttggagggagagtggagaagggtggggagaaaagattacaaaaagtctcaagaaaacttttgacgatgatagatacattcactttttttgtgtgtgctttgcccttgctagatgtgatgcctgccttgttttgttgctgtgacttttctatcacaaatctggccttccctgcttcctgctgagctttgtttggattttactgcttccaagaactcctccccaaaggtcagacgtgtcaaggacatgttggatagggcattgctcacctgtctggagaccagctctctatctctgatgtcaaagtgagccattactcacttgaggatctccatagcgatgaatggcagcccacgcttgtcacagtcctctctgttgccgatgaagatatggggaagtagtctgacaactggatggaaaaggatgcaacataggacattgacaatctatacatttttatttccagcgatgaatctcatgccatctagcagtcaaagatcattgttttctgtacccaagaggtaagaaaatgcctactacaatatcctgggctttaaagacagagcattcacatttgctatttctgccaaattctaaggccaggctaaacttgccaatacacttaagcactttggcagccatgttagtttgctggacctcatctcttggcccatttgtacctgccttcatgctgacttctgcatggatcccccagctccattcattctctggatgatgctaagaacttccttttgtctttgatattctgcatggactttaaaatatttacccactggggatatgctattcttcctggacctgtgatccatatttttcataagttggaaaaatttgcagccaatatcactttaagtgttacttctccatttcctctactctctctttctgatactctgaataggtgtatattagaccttccaaatctattaatgtttgtttcatattttccattcttttctcagtattgcacttttggtcatttcttcagggatgtctgccaaatcattaattctgtcttcagctgtgtctaacctgttaattaactcaatatttttatatcaataattaaaatttttagttcttattgttccattttttcccacaaatttatcttttcactccccaaagtcatttatggattagataatcctgtgttggcacagctgttctatattctatatctgacagatctcatatctgtaatccacaggattctaaattcattgtccattatttttgccagttctcagtaatagtagctttcattttatgtttagtgatgttgtgagctcattgtttgccatagcaggtgaaaaatctgagcgtttaaattaaggattggagaagttttcctgcagagatttgctcctgcttttgatagtaaggaggaggtgccaccaatctaggactatgtcaatgcatcattgaccttgtccccacctttatattctccctgctctcctttgagggtctcagttcatggtggaatcccaaatctctcttaccttgagattggccccaaactcagtgttctggcggcactgctgcaaccaacattcatcctctggtagatcaggattgacctctcattttctctttatctttttcttttttgtttaattttgcagcatatctctttcctcttgtaagactgatgacatctcaaataatgtattctaccaggctttgctgtctgtagctggatcaccttggagcacaccctcagacattgccagaagaggaagaggttcaccttgtctccctttcccctgcttttttcatctttgacgctacagacacaaggcactgcctataggtatgcaggcctagtgcttgctcagggcagacaaaatatcagtagctcagccttagcatctggcgagacttggcattaagatatattgctgtgccaagcacggtggcttgcatctgtaattccagtattttgggaggccaaggcaaaaggatcacttgagtccagaagtttgataccaacctgggcaacatagtgagaccccgactctaaaaaaagaaattagctgggtgtggtgacatgtgcctgtaatcctagctactcagaaggctgaggtggtaggattgcttgaggccaggaggttgaggctgcagtgagccattatcgcaccactgcactccagccttgtcaacagagcaagactgtttcagaaaaaaaaagatatattgctagacagaaatgactatcatgactatctgatttgttgttttgcttttgagttagggtcttgctctgttgcccaggctggagtacagtggcatgatcatagctcactacagcctcaaatccttaggcttaagcaatccttgtgcctaaacttcctaattagctgggaatacaggtgcacaccaccacatctggctattttttgtatttttgtacagatggagtctcactctgttgtccaggtttgatctcaaactcttgacctcaagctatcctcccaccttagcttccctaaatgtttggatttacaggcatgagcccccatgcccagcttgagtatctgatgtcatttagctgagtttggaaggggtgtgctgtggtttgaatatttgtcccctctgaaactcatgttgaaactaaatccccactgtaacagtattaagaggatgggaaatccaactatggtatttgagaggtgggacattgggaggtaattaggattagatgggatcatgagagtggggcattagtagctttataagaaaagaaagagacacctgagctagcgtgctgattgggtttggctctgtgtctaaatctcatgttgaattgtaatctccagtgttggaggagggacctagtggggaggttattgggtcatgggggtggattttctgcttgctgttctcacggtagtgagtgagttctcatgagatctggttatttaaaagtgtgtagcacttccccctttgctctctctcctgctggccatgtaaagatatgcttgcttcccctttgccttctgccataattgtaagtttcctgaggcctcccagccatgcttcttgtatagcctgcagaactgtgagccaattaaacctcttttctttataaattacccagtctctggtagctcttcacagcaatgtgagaacggactaatatacatgcttagcttgcctgacctgtgatgacttgtactacctcaggactctgcagaaagtctctgccagcaagaaggctctcaccagatgtggcccctagacgttggacttcctagcctccagaactgtaagaaatacatttctttcctttataaataatcccatttcaggtattcagttatagcaacagaaaacaaactaagtcaggtgaggccaggcatggtgacttatgcatgtaatcccagtattttgggaggccaaggtgggaggattgcttgaggccaagagtttaagactagcctgagcaacatagcaaaaccttatctcttaaaaataaaaataaataaataaaaaagacagggtcatatctctgaggcatagccctttggactcttcactttgtttcaggctccagaatgggactcttaccttaggccttacagttttccagtctgtctggtaccctgcataatgcctcataattacctcaggattagagtgtcggtcccaaatctcgcctacctggcagagattcttatcgcggttagtgctggccaactccctcccctgctagatgggattctaatccctataagccctggaaatgaacagatctcttggaatcacaacacggctttctttt

SEQ ID NO: 7432 - DNA, 1473 bp, mus musculus
tgttcttcttttcaaaatttggctgattttatgttaatttcctcctcttttgtatatggcttattctggtactggaataagaaagtgctattcctcttcaaagacctatactgaagcaaaaggaagttataaaatataaaaaataatttaaccctattgttcttaatcagaaaaatatagttgccatatttcatataaaacatgctcacagtaaatgctatctcccttcctttctgtaagaacagagccccatatatgagaagaaatgtccaacgccaccctactgacagcgttcatcctcacgggccttccccatgccccagggctggacgcccccctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcaggactatctccttccacagctgcgtggctcagctctattttttccacttcctggggagcaccgagtgtttcctctacacagtcatgtcctatgatcgctacctggccatcagttacccgctcaggtacaccaacatgatgactgggcgctcgtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgagatggtcatctttgtgaatattgggctagtggcctcgggctgctttgtcctgatagtgctgtcctatgtgtccatcgtctgttccatcctgcggatccgcacctcagaggggaggcacagagcctttcagacctgtgcctcccactgtatcgtggtcctttgcttctttggccctggtcttttcatttacctgaggccaggctccagggacgccttgcatggggttgtggccgttttctacaccacgctgactcctcttttcaaccctgttgtgtacaccctgagaaacaaggaggtaaagaaagctctgttgaagctgaaaaatgggtcagtatttgctcagggtgaatagttaagaaaggccatatatggctaacttttctttttttatttgtaattaaattaaaccttcaacataagcattatacttgaatggagcatttcaattattcagtcttaatttttaattggacagttaattaatttttcatttttttctgcagagtgtttgttagaatcctagttaaagcagccatttcacggtgataatctaagagaaaggataatagtctattcttttcacgttccattaagtaatcagaaaagtaatttattttcttatat

SEQ ID NO: 7433 - DNA, 993 bp, mus musculus
ggctgatctgattttacatccttattcctaaggctatagattagtggattcaacattggggttaccagattattcaatatctgaattatggaaccaagcaaggcactgggattgggttgtagatagataacgatgactggcccataagcacaaaggattgcagtgaggtgagcgctgcaggtggagaaggcccgctgcctgccctctgctgagcggatttttgatatggaaatcccaatgcaagtataggaaacaaggatgagaaaaaagcaaatgagagacaaaagaccaacatttgtaaaacctaccctctgggctaaggatgtgtccttacaggctagaggtaacactgcaggaatatcacagaagtaatagcccaccttgttagggccacagtaaggtaactggaaggtgaggggagttaggatcatggcatggacacagccaatcatccaggtccccgtggccaacataaagcacaccctgtggttcatgatgaccgtgtatctcaaaggaaaacatatggcaacaaagcggtcacaggccatcactgtgtagaggaaacactcagtacagcctaggaaatggtagaagaaaagctgggacacgcagcctgcatacgagatagcatggctgttccccgaaaggtagaacaacatcttgggaacagtcgttgaagagaaacccaggtcaaagatggagaggtttcccaagaaaaaatacataggagtgtgaagtcgagtggaggagatgatagctgtaaggataagcacgtttcccaagagggtgcataaataaaatgaggagaacaggaataaaagggctgtctctaggccctctgtctcagggattcccagaaggatgaattcagtcaccattgtgtgatttctcattcctggggaggaatcaactcttgggtgtccgtgaaaagaaataagtggttaaatttaatatgcatgtaaattacctgtgtttagatgaatgaaatggaaa

SEQ ID NO: 7434 - DNA, 991 bp, mus musculus
tgatctgattttacatccttattcctaaggctatagattagtggattcaacattggggttaccagattattcaatatctgaattatggaaccaagcaaggcactgggattgggttgtagatagataacgatgactggcccataagcacaaaggattgcagtgaggtgagcgctgcaggtggagaaggcccgctgcctgccctctgctgagcggatttttgatatggaaatcccaatgcaagtataggaaacaaggatgagaaaaaagcaaatgagagacaaaagaccaacatttgtaaaacctaccctctgggctaaggatgtgtccttacaggctagaggtaacactgcaggaatatcacagaagtaatagcccaccttgttagggccacagtaaggtaactggaaggtgaggggagttaggatcatggcatggacacagccaatcatccaggtccccgtggccaacataaagcacaccctgtggttcatgatgaccgtgtatctcaaaggaaaacatatggcaacaaagcggtcacaggccatcactgtgtagaggaaacactcagtacagcctaggaaatggtagaagaaaagctgggacacgcagcctgcatacgagatagcatggctgttccccgaaaggtagaacaacatcttgggaacagtcgttgaagagaaacccaggtcaaagatggagaggtttcccaagaaaaaatacataggagtgtgaagtcgagtggaggagatgatagctgtaaggataagcacgtttcccaagagggtgcataaataaaatgaggagaacaggaataaaagggctgtctctaggccctctgtctcagggattcccagaaggatgaattcagtcaccattgtgtgatttctcattcctggggaggaatcaactcttgggtgtccgtgaaaagaaataagtggttaaatttaatatgcatgtaaattacctgtgtttagatgaatgaaatggaaaa

SEQ ID NO: 7435 - DNA, 1007 bp, mus musculus
tattcacaaacagtaagtaaaacatttcagaatactcttttcagggaccttttcacttccttgttccttaaggaatagattaacgagttcagcatgggtgagacaacattatttaatatttgcacctggcaccaagcaaggggttgggtgtggacttcagatagatgatgattacaggtccataggcacagaggattgcaacaaggtgagcactgcaggtggagaaggctttctgcctgccctctgatgagcggattctcaagatggcaatcccaatgctagtgtagcagacacagacactgatcaaaagtgttaaagccagaaagccaacatttatggaacccaccctctgggccagggcactgtcagtacaagccaggggtaaaacagcaggaatgtcacagaagaagtagtccacctgattggggccacagtaggacaactgaaaggtaaaggaggtcagaatggtggcgtgaagacaacccaccaacccggcaccacgaccaagccgacacagactccaggcttcatgatgagcatatatctcagtgtgtgatgtatggcaacaaagcgatcataagacatcacagaatagaggcagccttcagcagaacccagcaactgatagaagaagagctgtgaagcacatcccttaaaagaaatgactgggctctggccagagagatacaatagcatcttgggacatgttacagatgggaacaatatgtcaaaagtagacaggcgtcccaagaagaaatacataggagtgtgaagaaacaatcgctataaggatgagtaaatttccaagtagggtgaagaggtagatgaatgagaagacagcacagagtacagcctccagtccctctgtctgaggtattccccgtagaatgaattcattcagcaatgtgtgattcctcatgttcatggaagggtagtctgggttttcacaaaatgtgtgaaaatatgaatgtggaggctaattgggataaacacaataccaatacatt

SEQ ID NO: 7436 - DNA, 1082 bp, mus musculus
aaggtatagaatatgcaatgatttacaaataatttctctctcacacacaaacacattcaatttctctttttaaaacttagagactgttgacaagatcgtggaccctggaaaccattcctcagtgactgagtccattctggctgggctctcagaacagccagagctccagctgcgcctcttcctcctgttcttaggaatctgtgtggtcacagtggtgggcaacttgggcatgatcacactgattgggctcagttctcacctgcacacacctatgtactatttcctcagcagtctgtccttcattgacttctgccattccactgtcattacccctaagatgctggtgaactttgcgacagagaagaacatcatctcctaccctgaatgcatggctcagctctatttattcagtatttttgctattgcagagtgtcacatgttggctgcaatggcgtatgactgttatgttgccatctgcagccccttgctgtacaatgtcatcatgtcctatcaccactgcttctggctcacagtgggagtttacattttaggcatccttggatctacaattcataccagttttatgttgagactctttttgtgcaagactaatgtgattaaccattatttttgtgatcttttccctctcttggggctctcctgctccagcacctacatcaatgaattactggttctggtcttgagtgcatttaacatcctgatgcctgccttaaccatccttgcttcttacatctttatcattgccagcatcctccgcattcactccactgagggcaggtccaaagcctttagcacttgcagctcccacatcttggctgttgctgttttctttggatctgcagcattcatgtacctgcagccatcatctgtcagctccatggaccagaggaaagtgtcgtctgtgttttatactactattgtgcccatgctgaaccccctgatctacagcctgaggaataaagatgtcaaacttgccgtgaagaaaattctgcatcagacagcatgttaatgaatagaatcaatgttatgttgttacgtcaagataggtctttggtttgatt

SEQ ID NO: 7437 - DNA, 822 bp, mus musculus
cagagctccagctgcgcctcttcctcctgttcttaggaatctatgtggtcacagtggtgggcaacttgagcatgatcacactgattgggctcagttctcacctgcatacccccatgtactatttcctcagtggtctgtccttcattgatatctgccattccactatcattacccccaaaatgctggtgaactttgtgacagagaagaacatcatctcctaccctgaatgcatgactcagctttacttcttcctcatttttgctattgcagagtgtcacatgttggctgtaacggcatatgaccgctatgttgccatctgcagccccttgctgtacaatgtcatcatgtcctatcaccactgcttctggctcacagtgggagtttacattttaggcatccttggatctacaattcacaccggctttatgttgagactctttttgtgcaagactaatgtgattaaccattatttttgtgatctcttccctctcttggggctctcctgctccagcacctacatcaatgaattactggttctggtcttgagtgcatttaacatcctgacgcctgccttaaccatccttgcttcttacatctttatcattgccagcatcctccgcattcgctccactgagggcaggtccaaagccttcagcacttgcagctcccacatcttggctgttgctgttttctttgggtctgcagcattcatgtacctgcagccatcatctgtcagctccatggaccaggggaaagtgtcctctgtgttttatactattgttgtgcccatgctgaacccccaatctatagcctaagaaataa

SEQ ID NO: 7438 - DNA, 145 bp, mus musculus
aatattctttgtaatttaactctaagccatttggaattttactttggcacatgcaatgagtaatttgcctgatcatagtttaacagaataaataactatattttaaattccatatattctaaatgtatgcctgttttttgtactt

SEQ ID NO: 7439 - DNA, 538 bp, mus musculus
tgaatatctgggaaccttttctaaatgaagaataataaagtccctcccacaaccatggggtttttttgttttgttttttctcttcctgcagaaactgactggaggagatgtcaggagaaaataattcctcagtgactgagttcattctggctgggctctcagaacagccagagctccagctgcccctcttcctcctgttcttaggaatctatgtggtcacagtggtgggcaacctgggcatgaccacactgatttggctcagttctcacctgcacacccctatgtactatttcctcagcagtctgtccttcattgacttctgccattccactgtcattacccctaagatgctggtgaactttgtgacagagaagaacatcatctcctaccctgaatgcatgactcagctctacttcttcctcgtttttgctattgcagagtgtcacatgttggctgcaatggcgtatgaccgttacatggccatctgtagccccttgctgtacagtgtcatcatatccaataaggcttgcttttctct

SEQ ID NO: 7440 - DNA, 538 bp, mus musculus; identical to SEQ ID NO: 7439

SEQ ID NO: 7441 - DNA, 1298 bp, mus musculus
tttgtaacttaaattctggaccaacttggagaaggcccagggaactttagggagacaaagcagaggtatcaagtttagagacaatgaaaactatgactcagtctgttagctgctgtcaacctcccttatgcaatttggttttgtttggaagagcagtgagggtccatgttaaggtaattcatactttctattttcacagaaatgcctaaagaagaatgaccatggaaaattattctatggcagctcagtttgtcttagatggtttaacacagcaagcagagctccagctgcccctcttcctcctgttcctgggaatctatgtggtcacagtagtgggcaacctgggcatgattctcctgattgcagtcagccctctacttcacacccccatgtactatttcctcagcagcttgtccttcgtcgatttctgctattcctctgtcattactcccaaaatgctggtgaacttcctaggaaagaagaatacaatcctttactctgagtgcatggtccagctctttttctttgtggtctttgtggtggctgagggttacctcctgactgccatggcatatgatcgctatgttgccatctgtagcccactgctttataatgcgatcatgtcctcatgggtctgctcactgctagtgctggctgccttcttcttgggctttctctctgccttgactcatacaagtgccatgatgaaactgtccttttgcaaatcccacattatcaaccattacttctgtgatgttcttcccctcctcaatctctcctgctccaacacacacctcaatgagcttctactttttatcattgcggggtttaacaccttggtgcccaccctagctgttgctgtctcctatgccttcatcctctacagcatccttcacatccgctcctcagagggccggtccaaagcttttggaacatgcagctctcatctcatggctgtggtgatcttctttgggtccattaccttcatgtatttcaagcccccttcaagtaactccctggaccaggagaaggtgtcctctgtgttctacaccacggtgatccccatgctgaaccctttaatatacagtctgaggaataaggatgtgaagaaagcattaaggaaggtcttagtaggaaaatgagtcctgatttgggggatttatagatgggaaaaatgaatagttccaatgaacatatattccttttttctattttcatgttcttctgttgtaacatacataatatctagattttaaaaatactttcccatctatgattgattcaactttctcaacaaa

SEQ ID NO: 7442 - DNA, 1223 bp, mus musculus
aagcagaggtatcaagtttagagacaatgaaaactatgactcagtctgttagctgctgtcaacctcccttatgcaatttggttttgtttggaagagcagtgagggtccatgttaaggtaattcatactttctattttcacagaaatgcctaaagaagaatgaccatggaaaattattctatggcagctcagtttgtcttagatggtttaacacagcaagcagagctccagctgcccctcttcctcctgttcctgggaatctatgtggtcacagtagtgggcaacctgggcatgattctcctgattgcagtcagccctctacttcacacccccatgtactatttcctcagcagcttgtccttcgtcgatttctgctattcctctgtcattactcccaaaatgctggtgaacttcctaggaaagaagaatacaatcctttactctgagtgcatggtccagctctttttctttgtggtctttgtggtggctgagggttacctcctgactgccatggcatatgatcgctatgttgccatctgtagcccactgctttataatgcgatcatgtcctcatgggtctgctcactgctagtgctggctgccttcttcttgggctttctctctgccttgactcatacaagtgccatgatgaaactgtccttttgcaaatcccacattatcaaccattacttctgtgatgttcttcccctcctcaatctctcctgctccaacacacacctcaatgagcttctactttttatcattgcggggtttaacaccttggtgcccaccctagctgttgctgtctcctatgccttcatcctctacagcatccttcacatccgctcctcagagggccggtccaaagcttttggaacatgcagctctcatctcatggctgtggtgatcttctttgggtccattaccttcatgtatttcaagcccccttcaagtaactccctggaccaggagaaggtgtcctctgtgttctacaccacggtgatccccatgctgaaccctttaatatacagtctgaggaataaggatgtgaagaaagcattaaggaaggtcttagtaggaaaatgagtcctgatttgggggatttatagatgggaaaaatgaatagttccaatgaacatatattccttttttctattttcatgttcttctgttgtaacatacataatatctagattttaaaaatactttcccatctatgattga

SEQ ID NO: 7443 - DNA, 309 bp, mus musculus
ctcatagcgttttgtgggaattacatgagttaattcacataaagtgttagaaatgtgcctgacacataataagaacctgataggtgttggcacccctgcccctgttactcatccatatatataaaaatcaggatttattgatcttggtactttttacattttggataagttttggttgtggggctgtcctgtgtagcacaggactcacagcacagcatccctgacctcacccattagatgccagtgatattccccctaccatacagacacaccaatcactaaatcaaaatattctccattgtcagacat

SEQ ID NO: 7444 - DNA, 1045 bp, mus musculus
attgcctagtgtgggcataaccacagtgtttacagggagacttggcgcaaacagagcctcttgctggtctcagaaatggggaaagtgagaactaaccaccaaccccaatgagaccagtgcaggaaggattttgaagtttggactagaaggcaggaaagcatctgtcaaaaatctattacttgatgcactaacaagattgttggaggtccctcccctcccatgggttatggagatccaccctttccaaaggggcctctggctctctgtgaacagcccagcagtcgctcactgggatctgggctccatctgcagcatctaaggacatcggtacatttctgagcatttcagaaggaagctcctccccactagacacctacttttcatataatggagagaggatccttccctaactgccacttgaagttgcagaattgacacgttcctgacctgagaaagagtggaagttgaggatgtgcacatgtaagcaaggggactgtggtgggaacctcagtgagtattacgtggttttagatggaattggatttactctgagttctcacatatgctataaattcatatataatggtgtatttacatagcataataaatgctatgcaaatatgctggagcctctgggtacaaagagagaaggagaaagacttgtgttatgtaataggggtatggagtcagctgcaagggtgcagtgggacatgatgcagccactatccccataagaagccaggaggctggtgttgtaaatgtctgcgacctgtaaatggattggtgagacatatcccactggccagaatgttatttgctcacagtctaggtggtaatagcaattttctcccttcctgttgttgctaatgtcaaaggtatccttttacctcaggtatttgtagccagaatctgtaaaactcatgacaccctgcaccctgatctgatgagagtggcaagtagctttgtgaccaccaagaggctcttcagagacaaggcctggagtagagaccctgctaaacccagaaccatgactgtaacaaccatc

SEQ ID NO: 7445 - DNA, 1045 bp, mus musculus; identical to SEQ ID NO: 7444

SEQ ID NO: 7446 - DNA, 694 bp, mus musculus
atctatttgaagttgcccatgccactaccaccaaatgacgtggaagagaatgaagtgaggcccccgtgacctagtgacccaaatgaagtaaatcctgtatcaaaagaagaaaatccacttctaaaagacggaaatccactgaacacggagaaaaacgaccccgtccctcggcttctgcttcctcggggaccccttcgattcccaaagaagtcctcaaaagggtcttcaaagaagtcaaatgaaaatgggtcccttccaccaaaaaattccctgaagacatcatctgggttacggaatgtgaagccaaattcaaatggactgtcaaaatgacttccacctcctcctccaccatttaatccttctttgccatatttgtcatagatgtcctgtttcttagcatccgacagcacttcatatgcctccgctacttgcttgaattttctctctgcttcttctttattctcaggatttttatctggatgccacttcagtgccagtttccgatatgcctttttaatatcctcgggtgaggcatgtctctgcacgcctagaacttcatagtaatccaccatgttttacgagattgttggaatgggtccgaggacagaagcggccggtggcgggacgcaggggaggcagggtgacggcccgaatctcctcacagctccaggactgctgcgctggtggtggcggc

SEQ ID NO: 7447 - DNA, 1082 bp, mus musculus
attataaccccattgtacagatgaggacagtgaggcacagggaggttaagtaacttgttcaagccctcagagctagtaagtgtagagctagaattcaaacctaggtgcgctagtcctcaaactggaacttccgctcctgatattttgtttaaggatggaggcgtggagggaccaggagacccagtggagtaaccctgacccgcacctgcacgatgcccgcggagtgcaaagcactttctcctagcgcgcagagcatatatctgaaagcttctcgcccgtcctccgcccaacacccccgcaggactggcagggtcctcctttttttctccttgtgtaccccccaggttccttgctctaactccttcacttatcagcctgaggattgggcccaggctgcattctgagggagatgccgtcttccgcctgtcccccggacgaaaggaggttgctagccccagaatgttcacagtgacccacccctaaggtggtcttgccggcgggtctcgaagctgagtttcaagaccacggatctgttcttagaatgaatgctgtttggggcggctgggaggagggggtgtgatggagattggagaagctgaacccaccttggccccatcccaacggccccatcttggatccgccactgggcgagggtctggacacctggctggtctccacctcttgtcagcctgctctctctggtcaggattggactccctcggggtttcctcagcgacgccgcgtggtctgggggctcggagaccctcctcctccccaacccgcccgcccccggccctcccgccgccgcggcctcccacgtagcgttctgaacccgctcagcgctaaggcaagaaccagcgtggggagcgggccaggcgagcagaggctctaaatcttccttcactctgtgagtagatgaagtctgagaaacaaattcaaagcaggcgcgcctgcagagccttcctgcagaaatattccccggcattcaagcgcatccaggggcggcttgagctgccttgtttggctaaggtcagacgagactcgagttctccaataaaaataaatctcaaattaattatggc

SEQ ID NO: 7448 - DNA, 1298 bp, mus musculus
gggttggcacacacaaggcaaagaagcgtgtctcgccgggtatgtggaggaaactgcaagtagccaggacatctccagcttaaggtgtgaacaggcaaatggtggacctcgtatgcctggctgaaatgtgaacttggttgtttaagcagttggcactgcctttatgagctggaggtgacatgatcagacttacattttagaactgtctctctggtggcaccataaatgatggatgagagaggccagagacggagcagggaccagttaggagagaatccagtgatcatcacgaagacttgaattaaagggtggcagtgggaacagagaggcaggaatagagaggaggacaattttttttttattattatacttcaagttctgggatacatgtgcagaacgtgcaggtttgttacataggtatacacgtgccatggtggtttactgcacccatcaacccatcatctacattaggtatttctcctaatgccatccctcccctatcctccccacccccaaacaggccctggtgtgtgaggttcccctccctgtgtccatgtgtgagaagaggacaatcttgaagagagaattggcagaatcaacattgcggaaggaagcaagaagggagttgagaattctgtggtttctggactgggccagcaggtggatagggacgccatgaactgaagtaggaagacagaggacagagtagacttaggtggggaaaggttgagttctgttctagacctgtgcatttggagtgtctttgggcagatgatggagacaggtctgtgaaccggaggttagtagatgggctctccaggtatgacatggctgtttccacttccctagcatataattgagagcctcatgaacttgtgcacccagtggagtgggcacctttgtctatggtagcacggtggtatgtcagacgggcttcagcgtgcatgactaacatattaggctgatttttcagaagtcagagaattttttttttcagaaatattagttcttcttaaacctcctggggctccctgatacctgcccaggcatctctcaggtcacctacacaggattgattcacttatctgggaggacaccattggctggcatggaagctgccatcttcacctgccctctcagatgttcctcgcctccctacgtgaccagggccatgagcactccctcctcccacagctctcaccctcctcctctgtgtttgtttctccagtttcctaggtgaccccatttaagcgaatatgcagggaagtgagaatttgtaacggtggcaggtaatgaga

SEQ ID NO: 7449 - DNA, 3309 bp, mus musculus
gagacaccagatgacttactctctccaccatgtggggcacagagagaaggtggccacacgcaagccaggaagctcgccctcaccaggaaccaaatctgtgcaatcttggacttccagtctccaggactgtgggaaataaatgttggttgttcaagccacccagtctgtggtattttgttatggcagcctgagctgactaagaaacagaactactgcaattaattctgggaagaatgaaaatggaataatttccaaacatcacagcccaacaaagctacagagaagacaaagtgacaaagaagagataagtgttctagttgtaactctccgactaacataacatgtgactttaggcgaggcttcccttttctggctcttaactgtattcagctataatataagctggttggactgaaatgtgttgagcccccctctagttccttcagactcttcccttctttttattgttggtggagttgttatgaactataactttacctagcctaaataggtgaattatatttgttcaaagagactgaacaattaaacatttaaaaaatttatttttctaattgatccataattatacatatttatggggtacacagtggtgttttgatacatacaatgtatagtgcgaccagaccaaggtatttagcacatccattatctcaaatatttatcatttctttgtgttagaaacatttaataccctccttctagatatttaaaaccatatattattgtgaactataatcatcctacagtgggatagaacactataacttacttctcctatctagctgtaactttgtatcctgtaacaaatatcttcctatccttattcctctacttttcccagcctctactatcctctgttctacttttgacaggaaagtaagttctttcttgaaagtatgttctttctaagaaatgttatgagattaacattttcttggcttccacatatgagtgagagcatgtggtgcttaattttgttcttgcacttaacgtaatgtcctctaattccatccacgttgctgtgaatgacagatttccttcctttttatggctgaatagtattccattgtatatttcacgtattctttatccattaatctgttgttggatacctaggttggcttggctactgtgaacactgctgcaataaacatgggggtgcaaatgtttcctcaaaatactgatttcccttcctttggctagattcccagtaatgggattgctggattatctggtagttctatttgtagtttttgaggaacttccatattgttctccatagtggctgttctagtttacattcccatcagtaatgtataagagttctcttttctccatattctcaccagcatttgttattttttgtctttttgataatagccatcctaactggggtgagatgttacctcattgtggttttggtttgcatttccctgatgattagtgatgttgaacgttttttcatgtatttattggccatctgtatgtcttcttttgagaaatgtttgttcagatcatttgcccattttataatcacattgttttttgctgttgaggtgtttgagttccttgtacattctggatattaatcccctgctggataaatagtgtgcaagtatcttctcccattctgtaggttgatcttttcactttgttgattgtttcctttgttatgtagaagctttatagcttgatataaacacatttctttatttttttggttttgttgcctgtgcttttgatatcttatttgtaaaactttttctcaggccaatctatgttttcgtccagtaattttgtagttttggatcttacattcagatctttaatccattttgagttgatttttgtatagatgacaagtgggagtctagtttcattcttctgtgtatggatatccagtttccccagcaccatttattgaagagattctcctttccccagtgagtattcttggcacctctgtcaaaaattagttgactataggatatgtggattaatttctgggttctctattctgttccattggtctatatgtctatttttatcctagtaccatgctgttttagattctctatttcttttttcttttctttttttttttgagacagagtcttgctctgtcgcccaggctggagtgcaatggtgcgatctcggctcactgcaagctccgcctcctgggttcacgccactctcctgcctcagcctcctgagtagctgggactacagtgcccgccaccatgcccggctaattttgtgtatttttagtagagatggggtttcaccgtattagccaggatggtctcgatctcttgacctcatgatccgcccaccttggcctcccaaagtgctggggttacaggcgtgagccaccgcacctggcctggattctgtatttctaaacagttctcatttatctgcaagttatgcaatttcttaatttcaataacaaattttcctaaacctggggctgactgctagaggtttctggggctttggcacaatcatgaatggttaatacattaagtgcctgagggcaggtttggttgccagacggctagttttaagtttttaaagaactaaaacactagggctggttcagcagtacctgtacctcttctgtcactgagagctgcttgtggtgagctcgtgccagcaacaggtgttcagcctcaactgtcatcacaggtaggtgggcaagaccaattaggcagtgcaaaatcattagtgtgtgtaattattccagcttccctttgaaaggctggccatgggagagatagatggacagtagaggggtctggctgtctgggtgggtggaggaaggtgggagtgtttcatggaatttcacggtccccttggcaaacataacttgagccattagactgatctcatccatcttgatgttatttccctcagcaagcaataacctcagctttccacggcctgtggtttctgtgagttgggaatgaattccctcactctgagtgaaggtgtccaactggaaacagaaaaagaagaagtatttagcccataaaggctttttgtcatcagggagtggccataatttggaggagtcccatggataaaggtcactttggacaccagtataagctggaggggcgatgaatcagtcagtcaggcattcttagaacttattaagcatccgctgtgtaccaggccctatactaactgtttcatatactggagatgaacaactgtggttcttatgttccaggaatttatatattaacaagaaggatgaaagcagaaactattagacttaataac

SEQ ID NO: 7450 - DNA, 1088 bp, mus musculus
gtccccacaccaccttctgcacctgccccgccccctgcgctcagggttagagcaaggccacactcaccccaccatgccgtggtcctatcccggctctcagactactgtgtttctcagatattaacgaatatgacaccttgcgtagccagagtataattgacgttgaccttcacgcgtctcctagattgtgacctttcatgacattgtgtgtggttggtgacaacacagttcacaacacagtttataaaaaaagaaaaaaaaacagatttctccttgtatcaggccttttctcccactgttgtgaagatacatgtggggctttgttctgctttgctttgcaactaagacacacacagacaccacgtacacatacacacactcacagacatactcacgcactcacacatacacacactcttacacgcacacagttttcatgggttttgtctgtttcttctgtactccacacacacgctcacacagtttttatagggtttatggctatttcctccgtggcctctggaattccatcccattacccacaaatatgtaggctaagcctctgtctaggagacgagagggggaaggacacactccatttctcctcggacacttatagtctatttaattataaaaataggaggagtcggtattttctaaggtgagtgagaccaaaaaaaaatgtgactctggatgaatacattgtcagaacaaatcacgggtggaccctggcaagaggcagcacttccgcttgagagtcctggctgggaaaaaggcagagaaactccttgatatgatccaagaagaggctgccagtcctggcacctggtttgatgatgatttttacagtagccagaaaaaattagctgggcatggtggcgtgcgcccgtagtcccagctactcaggaggctgaagcagggaggcggaggttgcagtgagccaagatcacacccctgcactccagcctgggtgacagagcaagactctgtctgaaaaaaaaaaaaaaaagacagagagaagtgtcagggcctggggctgtcatctgccttatttgcaatagaattaaataaacggaacagtcgtaatg

SEQ ID NO: 7451 - DNA, 1088 bp, mus musculus; identical to SEQ ID NO: 7450

SEQ ID NO: 7452 - DNA, 1381 bp, mus musculus
atctcttatcctcatagagcctagagtgtagtggtaaagaaggcaagccagcaattgccatatagtcacagaaagaacatggttaagaagacttccagtaggaatcctaatttaagattttcctggattcatattccagaccagtttgggcagaagttagaggagaaaatcagcacttgggctgatttatcattacatctcctaccttggtttggccttggcgacttgggtccagtggcttagaggtgctttcatggcttagagtttctgcagatgcgggcagggcagaaaccatacggtcagtctagtcagcagttttcagttatgagtcaaagaaggagcagaagcctgagctgtgtggggacaacctcttccagctcatcctaggttctggctgctttctgtcttggtctggccatattgttcgacccaggagattgggtacttttataactccaggaaaggtacatgtttatgataaatgggaaaatatttcttggtcctttcaaagagatgctgatccaaggtgagaaactgtgtgattatgagagactgatcatcctgatcatctatatggtacagctagctgccttgcttctctagatttctctagaaatctaggttgttaaaatccttgtaatgcactgtgctatggcttgaatgtcttccccaaagtttatgttttggaaactaaatccccgatgcaacaatgttgagaggtaggacctttaagagttgacttggtcatgatggccctgccttcatgaatgaactcatattgttatcttgggtgggcttgttattgccagaagggtttttttttataaaatcaggttcaggaaactcttgctttcactatcccccaccctgtgatgccttccagcatgggacaatgcagacagaagaccctcaccaaatgcatgcccccaaccttggacttccagcctccaggatagttagaaataaatatctgttctttataaattacccagccccagatattctgttgcagcagcacaaaatggactaagatacactgtctaagaaatctttttatatcttcatggagactatgcagtttgacttgctcgcggcccagttgattttcaagattgacaatcagcactaactctattatagaatttgcctggctgctgcactgagaactcactgctgtgagtattgtctccagcttcagtggacttcccagaggttgcctttgaaaattttacactcaaccatttccccactcactgaaagcttaaaagagaacaagtctaaaagagaatggttatttttagtaggaagttagttgtgagattttgagtgggagagtcagcctcagagaaactagacatcttctcagctattcttgagtcct

SEQ ID NO: 7453 - DNA, 940 bp, mus musculus
aactgaaataatttgaacaacaaaatgaataatgatagtattggattgtagcccaaagaacaaagttcactaataagttcatgctgatacaaataaccaacaagttaataagtgggataaaaggactagtcttccttacagttgaattccaattaatacatatagaaggatgccgagcatggtggcatgcacctgtaatctcagttactcagggaggctgaggtgggaggattacttaagctcaggagtttgaggcaacacagcaagaccccatctcaaagaaaaagaagtcttaataaatgtagaaggaaagagaaaaacagaaaatcaccattagacaaacaccactataataattgttgcagacaagatctaccaatgaatgctaaaactagtgggtgaaagttccaggaggaacagaatttttacaattccaaagtgtctcccccaagatatttattaactacaaagggaaaaatagtgattttgaagtagagaagccaggcagaaaccaccttaaccaaatgaccaaggtcaacatcaccagtaataagatagtaataagacatcaatatctctctatatcatgaaccatggatatgatgtactaagagtgacacaacatttctgtggtattcttgccaaacatgcggttcaatcacaagaaacataagacgaacccaaagtgaggggcatttgacaaaattaccgatcactactcttcaaaagtgtcatgaaagacaagacagacaagacaacaaagactgagcaagtgttttaggctgcaggagactaagggaaaatcacaactaaatgcaatgtggggtcctgaatgggatcctagataggatcctggaatagaaaaggacatgaatgtaaaaactggtgaaagttgcataaggtctttagtttaatagttctctaccaatgttaatttcct

SEQ ID NO: 7454 - DNA, 670 bp, mus musculus
ccattactgattttatgttataaaaacatagcttggtgtattatttgtacccagttttagataaaattttacatgaattaaactgataaaatggaatcaatggtatatgttcatgtaaagcttgcagatatgcaaatacatatcccagtatattacatagcaatatattctcttttttgtttgtttgtttgtttagtagagacagggttttgccatgttggccaggctagtctcgaactcctgacctcaggtgatccaccggccttggcctcccaaagtgctgagattacaggcacgagccacagcgcccggccgtaacaatatattcttatggcaactgggactgtgaggatgctgttagctgaagacatttaacttgctcacttctggaaggataaaaaaattcaggtgccaaaaaaactaaatgcatttgcttactatcattgtttaacagctgttaccaatcaacgtggaaactttgtttaggtaggaagcactaatttccaagggtcagtgaaacaactttgatttgtcatgctgatttttgactctaggtttctctgttttagtatcacacaaatggggtttatgtaggagtcaatgaatggcaaatgccccacctctacctgccctaccttctacttctgaaaagactggttattaccaagat

SEQ ID NO: 7455 - DNA, 674 bp, mus musculus
ctgccaaaccctcgctccaattccgtccttttgtggacttcatttacttttctggccttatgatatgcccactttcttgcctccccgccgcccccgaaccacaacttcactgagcttaatgaagtggttgaagcattttccctgaaagctcttctattaaaatacacaacattattatgtggatttagtagttcacatatccttggtactgaggaaggaagatctgacagcatccttaagttcctggtcctccaaaggtggtgtacaacataagatttcaaaattctgcattctaatttatcaaatgacttaggttccaagttcatgcgtccgagagcaggtgatgggctttagagtgagccaggctgccacctgctgtcctttagtggttctgctaaaagtagaagaggaatcgttctgaccttcaaaggcaaagcttatgagaatattttgttctccaaggtagagaaggttagtttatcagaaatggtttttccttccaatggtcttgaaagggattcccctcggccatgcagagatatggggcccagaggaagcagacaaaaccaggccagaagctgctccagcttcctaagcttggctttttaagagttgataaatttgcctgaaagtgctctacctgtttgggtggggatgataacccttccaaaaga

SEQ ID NO: 7456 - DNA, 409 bp, mus musculus
ttcagtcctgtgtctgacaggttcctgctggagtggagtgtctggggctcctggtacgacagaggggccgagggtgagtgcacggagctgcagggccatgtgctgaagagcagtggcattttggtccactaacgtgagaccattccctgtggggtgggtgacagtggggataggtgaccctgaagcatcgttgttcacatctcaccctgcgtggccttctctcatcacatccctcactcctggctctgtgtgtgacatcatcttgggacaccgccactccatgtgccatcatcaccaccccatgacatcctgccctcatgtgccaccatgttttcctgtgccgtgtccaccctgtgctgggcttatgttccggccagccaaaagtgtcttccatcactgtaagtagccc

SEQ ID NO: 7457 - DNA, 964 bp, mus musculus
tcatacaatttatcatccaaattgggatacatttgagaaggaaaggcggcagattatgtgggaacaaagactggcccatgccagctgggacatgtggtcaccttacttatgatctatgagatgtataatcaccccatttgttgataccaggtgcagtgagatgcatgctctatgtgcagtgtgtgttttcaccctgtatccccatcttctgctgggagcgggactccctttctccccgcctgagcctgttctcctcagtagcaggatccagctcaagccctacccccacctgctccaccacaactgccccactgccaccaccactaggcttgctccttaacctttctgtgcctcagttccctgatcagtaaaacggggctaactatagtacctactactagaactgtgcctgactcaaagtaggcaccagatgtgtcctgctatgatgatggggagccctgtgatttggtaacttccccaatctctctgcacttttgtttcctcatgtgggaatcagggacaatattacctaccttttaagggcctggaatttaagaaaaattagcccccttcccccttagaatcagcagcagacatcaaagggcgagttttaatacttcccacacaagttcacagatttattacataatatgtttagttgtggttaaagaacatctaaggggcgaaggagctgcccaaggggaaggaggcagacgagagggacatgtgtggctttgcatggaaaagggaagtggtatcccagataaatggtggccagccttcgagggctctcaggcaagagagaaaactctagacatcaccagtgcctgggctttgttgcaggcagaggtgctttctctagaagggaaagcaagtccctatagtcataaaatgagcagctcttcagctgctagtacttgacctccaaccagaattgatggggtgctcagaactattctaggta

SEQ ID NO: 7458 - DNA, 1290 bp, mus musculus
agtgtattggaaagaaagcggccagctaccttaggtgctctgttatgaatgtatttccttagacccacacagggttctctaactgtcttttcctgaaaattcttccaataagcatttattgaacttttactatgctcaaggcacagggcttggtcctgctggcatgcagaagggggggacgtggccacagctgccctgggaagaggggggcatgtggaggggatccccatttcctatacacagggccctggctccgtcacagatgaggcctggttggtcttgggtccataacttgtactttcagagtcaggaagcagatgctggcaggcttggaaacctcgtccaggttggacggtggtggtagcagagggatgagcagcaagtgcttcctgggcatttatcagcacacgtctccaggcgtaagaccttctgtctgccaggctaatgggccacccctggcaccccatggcactgcatctggatggatttacaggggtcttggctctcagcctcatctctgttccttaaacccggctgcctctctggatgctgcccagaggtgacgctgatcagattgtgtggggaagcctgtgtgatggatggctcattttgtgtcctgggtctgcagcccacattcctgccaagagcatacctgatgcagggccctttctgcagtggtcctcaagaaatattaactggtaatgaggaccagagactgaggttcacccgtgctggcttcttcaggtccttgttctaccatgactaatagccctctccttaaaccaccccccaggtcccaccctgggatgaaagaccagctgaccctgatcctcacagcaggtttgtcctatggcggagatcccgagggggccctaagtcacagctttggccatccagacccggggagccatcactggaaagtgcctatcaggctaaggcagaggggtggggtgtgggcgggctgtgccagcccaccgggcaggtgagggacctgcaggagccgagtgcctgagctgtcctcccctgtctattaactccccattagcatgcatcagtgccgttgcctctatcagtttgatttatgccactgcggttttgcttacaaattagaagccgctattgtgctaggtcggctttaaaatcgatgcagagtaattgcagtacatgggtagttggatgacattaacatgagaaatgtgctgtagtcgtcatccttggaacaaacacgtccaattacagtgaaattctgtgccccttacccggctaatttgaacacagctcaccgccaag

SEQ ID NO: 7459 - DNA, 4443 bp, mus musculus
taccatggggcgcaagttggaccctacgaaggagaagcgggggccaggccgaaaggcccggaagcagaagggtgccgagacagaactcgtcagattcttgcctgcaggtaaggattagttgtggcctcctgatccctcagcttttgcagtattctgtattataacctcttctcttttttagtttctgttcattttatatttaagtggaatcttctctgtatgagttactaggaggtatgaatgaaacagccgtttagattgtagggaactgtttaggtcgtagagatgtgaagacacggacacaactattattcatgcaagggaaaagtgtgatttaaaacaattgtgagttcagaggaagggggagcccatgcagaactgtaaaagtttttgttaagctgggttttgaaaaatgggtaacattgtagcaagaggaagtagtgaaggggaggggtcagtcactgatttgccttttggaaggggtggaaatggaaaagcacggatctggctgcttcatgccgagtagtagtatactgtgtggaagactggtgggaggtaacactggaccgggagtttgtgttgggcattggataaaggatgcagtttattgagatagtaggaagtcctgggcactgtattaaacttgttggtcatgttatatcgcttaatcatcttagagtcctgtgagagaggcactattaaggaaacactttgggaggccgaggcaggtggatcacctgaggtccagtgttcgagaccagcctggccaacatggtgaaaccctgtctttactaaaaatacaacaattagctgggtgtggtgatgggaggctgaggcaatagaatcgcttgaatctgggagaaggaggttgcagtgagttgagatcacgccattgcactccagcctggaagacaagagtgaaactccatttcaaaaaaaaaaaagaaacttgtatacagttattaaataataacagggctgagatttaaatggactccttttaattagtgtactaattctcttaccatgtttatttccgttcccatttatttttaatgtcccctgtaacttgttctgcctcgtttttcttttttaaacagtaagtgacgaaaattccaagaggctgtctagtcgtgctcgaaagaggtaagtgtgggtgtcaaaacttaagtaggttaaattggtactgctcatctttgaccacagagttaattctagactctcacatttccctatggtggaaatggcagagcctggaagtatcttcccatttcttcactccttgaatctcttgtgtcttttcagggcagccaagaggagattgggctctgttgaagcccctaagacaaataagtctcctgaggccaaaccattgcctggaaagctaccaaaaggtccgtgaaactaagagctggatgctacatgaggagtccctttgggtcctgggtagggaagaactcgctaaacatttccggagtgaaaggaacagccaaaggacattctgaggggtagaaagtacaggctcccagggtgtggggccagggaatgtgtggctgccattagtccaggactcttcaaacccttagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcggtgagattcatctttttgggcattcatagaaggatccttgctatttagtttctttcccagattcttgagactgtttcttagtggcaaggataagcctgactagaggaaaggggtttttgtgctccatcactgtttccctactgccttatatcctcccagtgcactacaagtttgaaagagctgtaggatagagcatttaaaaaaatctagaaggctgtcttggtgtaggtatgggaaggtggacaatggtgtgctccactgatgggcacagaaatgcactttttataaagcagttatctcagaactttgaaaaatttgttccttttggctgggtatggtgcctcacatctgtaatcccagcactttgggaggctgaggcaggaggattgcttgagcccaggaattggagaccagcttgggcaacatagggagatcccgtatctacaaaaaattaaaaaattggcctggcacagtggctcatgcctataatcctagcactttgggaggccaaggtgggcggatcacctgagctccggagttcgagaccagcctggacaatatggcgaaaccccatccctactaaaaatatgaaaattagctggtgtggtggtatatgcctgtaatcccagctacctgggaggctgaggcaggaaaattgcttgaacctgtgaggcggagatggcagtgagccgagatcatgccattgcactccagcctgggcaacaaagtgagactctgtctcaaaaaaaaaaaaagttaagttaaaaaatggtttaaaaattagctgggtgtggtggcgtacgcctgtagtcccagcttctcaggatgctgaagcgggaagatgactggagcttgggaggttgaggctgcagtgagctgtgatcttaccactgcactccagcttgggtgacagagtgagactgtctcaaaaaaaaaaaaaaaaaataactgcttccttttgacatagtaattccctattaaggaagatgatccaaaatgtcagcaaatagttctttactgaggtgcaggaagttattatacaattagtgtgtggatgtattattagaatcgtatagaataaaaagagaaggtccccatgtgcacccccttcctacatccccttgtatctacagggtcattattaggtttgcaggcaccatgtggatcataatgccaaaaactcaggaaacttccaaaatacacaatatgcttaagtaagttatggttcatgcatatgatgcagttacactggtcattatgtctatgaaaatgcctgtgatgtaactgaagtctaaaaagcaagaaacaaacttgaaaatggattatgtgaaaaatacagagtaagtaaaaaaaaaaaaaaaacgacaaaatgggccaggcacggtggctcacacctgtaatcccagcactttgggaggccgaggtgggcggatcacctgaggtcaggagttcaaaaccagcttggccatcatggtgaaaccccatctctgctaaaaatacaaaaaattagctgggcatggtggtgcgcgcctataatcccagctacttgggaggctgaggcaggagaatcatttgaacctgggaggcggaggttgcagtgagccaagacgcgccattgcactccagcctgggggacaagagcgagacttctctcaaaaaaaatatggcagaatggtagtcaagggccatttttgtccttctttatacatccaggtatttttcaagttttttttttttcttaatggaaaagtgaaaaacataatagtagaaagaaaaatgtaatgaaccctttaatttattacttaggttttttttttttttttttgagatgaagtctttctctgttgcccaggctggagtgcagtggctcggtcttggctcactgcaacctccacctcccgggttcaagcaattctcctgcctcagcttcccaagtagctgggatttacaggtgtgtgccaccatgccctcattacttagtttcaacagtgagcaatgctgcgcccatcttattttcatttctttgctcctctatttccttctgagagcaagtgttggatttttatttagcgaaaaaataagatatagagatagaactgctacaagggctgatggaagggcaggcctgtattaatagcccttgtctctcttcagttgctgcccattgaaagagctgctcggaagcagaaggcccgggaagctgctgctgggtgagttttggaagctattgggatggagcataggaagccactggggtggggaagctgtgaggaaggaggaggtatctgttttggtctgtgaatcactctgttcctggacctgtttctaggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatatccttgcagggcagagtgaagagttaggaggaaggtggttgggagagggatttccaggccttaggacatcatgacacagttccttaacaggcccacatgcccaggctccagacctgcaacgagttcacaag

SEQ ID NO: 7460 - DNA, 619 bp, mus musculus
gaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtctttttttttttt

SEQ ID NO: 7461 - DNA, 619 bp, mus musculus; identical to SEQ ID NO: 7460

SEQ ID NO: 7462 - DNA, 1115 bp, mus musculus
aatttcctgtcttgtttcttttgccaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattg

SEQ ID NO: 7463 - DNA, 444 bp, mus musculus
tctaatttatttaatgtacaatgaaaatccaataaagaatttgtaccaggggaatgagaaggtaagatttgcatttatagagagatagaactgtgctgtgaaggatgcagtggtgaatgcaaggcagattcaggaaagtccagctgtgaagatcctaaactgatctcagtaagtacacagggatgattgtggccttgctctacctagtggatcagcattgatgatggagataaacacacattagagatactgcagagacagaactggataaaacacttgcctgtgtctaactacagatatagaaatatcagattcaatcattgtgatttttctttcccctacacacagtatttcaatgtgctgggagtggtataggtaagattgtattgaaacaattacttctggttaccgaaattgagaaagcttgtgaatataagcaatgta

SEQ ID NO: 7464 - DNA, 282 bp, mus musculus
cccagtgtggagctcaaaggtgccattgttcttctcctctttataaagggagttgccacgttcctcccagcacagagttgggagtgactccagagcctcctgcaagatgctgttgattctgctgtcagtggccttgctggccctgagctcagctcagaacttaaatgaaggtaaaacagaagggggagaagatgtggtgactctgcttggggcttaggaggtgataatggtaattacggggaagagaggagaatgaaaacacagatggggctgcagagtttt

SEQ ID NO: 7465 - DNA, 1129 bp, mus musculus
attggagacattcaaagctcagttcaatccaaggcatgatttaggagtaattatctttgctggagtgctgacaaagaacaaaataatccaccagaagtccaaactaggtgaaatgattgtaaagtctatttaagaattttgtgctatggcttaagattggtcgtcctgcaagacataccccagatgatttacacttggtgctaagtgacccacacagcatacagtgtcaaccatgtctgacaatgacaaggattaattagaattccaagttcataagtgagagctgaaaataaatgtttgcagtgctcataaacccttaacactggagagtaatataacaggaatatgttttaaaatgatgtatgaagaaccagacccagaactttgagatggtttccaaagccctattaatgcatccagctagtatgtcgctgcaggtaccattctcgttataaatctaagcagtccatttaaccatgagggctggtcttctagaataagatcagctgatgagagccatagcttttagctcctggaaaataccatcccagggagattcctgaggcttctgtacgcttggactttcttgccctcccagacttggagaagcagggaagggccatcccatcctctcagcagcagagccctgaaggttttaagtggttcaggttatcagcccccggcagtggcctaaccaacaggaagtttccccagagtttccatcacaggaaatttcctgtaaggaagtccttactgcacaaacaaagagttcctcgctctgctcccctccaccaaaacttcagtgccccaccgaaggaatgtgggcaggagggcgtgagtatcaacagggcttgaaggtagcaggggttgagggctggatggcataggaagaaatggaggggaacaaagatgttatcttacttctgctggccttgggtttgtcagataattgcttattcactggctcatgctggctttcatctcctggcctgcctgaacttgcagtgagaagaatgcatgcgggtgcaggttctcctggtctacctccacccttagcctatctgagtttgattcgtcatatctgagtttgattcctcatctgtacaccaaggaacactgtaatgattaa

SEQ ID NO: 7466 - DNA, 1129 bp, mus musculus
ttaatcattacagtgttccttggtgtacagatgaggaatcaaactcagatatgacgaatcaaactcagataggctaagggtggaggtagaccaggagaacctgcacccgcatgcattcttctcactgcaagttcaggcaggccaggagatgaaagccagcatgagccagtgaataagcaattatctgacaaacccaaggccagcagaagtaagataacatctttgttcccctccatttcttcctatgccatccagccctcaacccctgctaccttcaagccctgttgatactcacgccctcctgcccacattccttcggtggggcactgaagttttggtggaggggagcagagcgaggaactctttgtttgtgcagtaaggacttccttacaggaaatttcctgtgatggaaactctggggaaacttcctgttggttaggccactgccgggggctgataacctgaaccacttaaaaccttcagggctctgctgctgagaggatgggatggcccttccctgcttctccaagtctgggagggcaagaaagtccaagcgtacagaagcctcaggaatctccctgggatggtattttccaggagctaaaagctatggctctcatcagctgatcttattctagaagaccagccctcatggttaaatggactgcttagatttataacgagaatggtacctgcagcgacatactagctggatgcattaatagggctttggaaaccatctcaaagttctgggtctggttcttcatacatcattttaaaacatattcctgttatattactctccagtgttaagggtttatgagcactgcaaacatttattttcagctctcacttatgaacttggaattctaattaatccttgtcattgtcagacatggttgacactgtatgctgtgtgggtcacttagcaccaagtgtaaatcatctggggtatgtcttgcaggacgaccaatcttaagccatagcacaaaattcttaaatagactttacaatcatttcacctagtttggacttctggtggattattttgttctttgtcagcactccagcaaagataattactcctaaatcatgccttggattgaactgagctttgaatgtctccaat

SEQ ID NO: 7467 - DNA, 1169 bp, mus musculus
tgtagtgtaagtggggggaaaagtttactggatttagaaatttcagacattctggtttatcacatattctctagaaaatttttcactcatcatatttctttttttttctttctgtaagaagcaagccagtttagaaaagcagaatacatccacttgagcataaaaaagtccttcttccctgcaagactgctctcatatacaaaggaatatttttccctcttgtttaaactaggttcgtttggaattactacctgtcactactgtattaatatattattcacattatgagaaatataaaatgtagacattttggaagaatgagattaacataatagaaatagaagtttgaatattttcttcttctatatctttggagactagtggtgtagacgaggatatggacataaagacattaagtgattgatttcttcccttatctgatttgcgttcaccatcacattctgactcatgagtgtcactgggtttgatgtgtcctggagagtgacagggatgtagaatgcatttccataaattcgcatcacacgttttacttttagaaagattatctggcttcctgcaaaactttgataggcaaacagagatattaagtgtttgtttataggctcctcattctactctttatggaagatgaagagatacatagttctgatgagactggggactactcccagctgggttcgtgacaggttaaccctgaaacaagtaagtttagggtaaatctggatgaccctttgctttccacactattcatgggtctgtgtaaaagctgtgctttttctggatttgggacaaactacaataaaattatttttctaaaataatatatggggatcatttatttaaagaaaatatcctaatagctttctaatatctcagaatgacagatagtaaaataacatgttgtaagcataaaactttacataacttgagggaaaatattcgtcctgggttaaaaattgtatacctgaactagaaacttcgattgaatactgtatttcatgtctccattgattttctttcactaaaaattgagataaatgccttttttatctaaaaaagagatactttattaatatatatttcaggaagattacaaagttttgaatttatatacaaaattattttaattttgcatttactttttaaaa

SEQ ID NO: 7468 - DNA, 1974 bp, mus musculus
cttgtatgaatcaggatcttatctctcaatagcattctttaattctttagaatttctactcagcttaagttgctaaagaaaagtgactcattccaacttaattatcaataggaaagtaaatttcctatgaggtctattaattctgccttctttcagagaaagagagacaaaaagatagattttgcttttaacagaactttgtgtttgtgggctatcacaggcaagagtaaggaagtgacagttgggtgcaaaagtaggtccacaccaggctgaccaaccctcccagttcccagctggggagtctgaggggtttgtgaagatgtggaactttcagtgctaattactgggaaagtctcaggccaaccaagaacagttagtcagaatttcttttttggatttggagcttcagtacgttggttcaggagaaaaaagttcagagtgcacttctgttctccaagacattacgtaaactgagatacgttggaatcattaactctgtagcttcaacaaaaaatagccaaaagacagacataaggaaaggaagaacagtagttgggtgttaggtaaagaggagtagagaagctagggagggagacagaaaagtgacgttaggagtcagtgctgattctttttcttccacatgaagaatttcaaaccagtttccatggaagagctgtctaggttgccattcagaaccagttgtcacgattcaaggaaggtactttgccccttttaatgtcagaggttggaaacatggggcaggaggagaggactaaggaaagaggaaaatatgcaagtaaatataatttatggcatacattttcatatgggtttctttaatcaaatatgtattttaaacctattattttggtaggtcatactgataaagttgcattatgtaacaatggcatgaatgaaataaagcacagaacatttggtgagtttgttttcaggcttgattgtgacagtaacacagtttattcactttctcacaatagtatttgatgaatagcaaaagcaaaaattatgaatcatatggaaagcagggctcatggcatttttgtttgtttaggctttaaaaacaataattgaaactatgatgcttttgaaacactaatgtgagaattcatttgcccttcatgaaattacgtgcagaggacattcttgtcaagggaacattgcatatacattaatcagatgactttggtgtgtgctaagtattacattctggtgatgtttgctgtattttgactgctttaagtattttattggcccaaatataggaagattgtttgtggggaataataataacaattcattctttcattctaatacagtattgaatacattaaaaatatttctaagccttgaatgctaaggggattagcaactcagtttctgtcccacctaactccttctcttactctgagaatcttaccctttactccctccttccctcctgtcctgcctctctcctccttgccctccttcttccctcagcatctaccagcattataaacactcctttcagatatacttccatcctttcataatacgcttcccacttccttgaccccatcccactggtcagtgagtagtagagcgagctgaaaagaatgagggctccttcccacaccggtttccacaggtgttagtcatttgccgtgaagtggactgatgaaggttgatgtgttgtttttgagtaatagtttaattaaaaagtgatgtgtctgtgtgtggtgtgtatttttgtttttgatctctgtggaaattgggaggactctgttaaaatcaatactacctgatatttgggccattttagaatttaaaagtaaatactgttctaatcaaaggaccagattaccaaaaggtctttttgcatgtaatatgctaatcctaaattagaataattaaaattgtgccagtgcagtatctaaactttgccttaattacaaataattgtcctgtatcttt

SEQ ID NO: 7469 - DNA, 639 bp, mus musculus
aaggtaggaaccctgtctgttttgctaaccatgcactcaatatgtagagctaccctgtctagtgtggtagctgttagtctatatgtggttattaacatttaaatgtaaactaatttatatgtaataaaacttaaaattcagtttcttagtggcactagccacatttcaagtgctcaacacttgtgctcagctactgtattgagcagtgctaatatagtgcatttctattattctaggaagttgtatgggactgtgcgagagcactgatgggcacattctggttacgtagtaattatttgttaaatgagcgaatgaatgaagtagtactcagattggcaggtgccaattaatgttgaatgaatcttgtttgaataatcatgtttaaaagttattttagtttttaattaatccatgttgacatttccccagccaacttcaaaatactggatttatcattagtaaaaggaaagtatataatagtggttaaaagcacaacttgttgctgatgtcatggccaaattacctttacttataactctaatttaaagtctcagattctcattaaaatgagaataagaagttctttttacctcttaataagaagtaagataatgcatgtaaagtgcttgcacagtggct

SEQ ID NO: 7470 - DNA, 866 bp, mus musculus
ttgatttaagggtgttttaaaatgcgataggctagcttccagaccatgattagtgtcactcctgagaagcagaggtttaatatttcataactgatttcattgcagatttatgtcttccatattctctttaaaaaaaaaaaagataaacttatgttagaacctctctggaaacagacttgctgacacaaactgaactgtataggaaatctgtaagaagcactgcctaattgacaaaaatggtcctatgattaacatgtatgctaatatcaactaattgatttttttggcttattctcaacaaataacctcatcctacttaaccccctactaccttacagcttgggctccagagtaatagcagatatggttggaatccgtgcactgctactgcttagttgtgtgacgttgtgtaattgaggcagggaaaccagttaaaagacttttactgatatttcctgtgagaattgataagggtctaaactgaaacaagtgagagtgcagtggaaagagtgcatgtgagggggtaaggaaggtaaggaggtagaattgtcaggacttaaatattgattgggtgtggtgtggccagggaatggtggagtttggattaaactataaggtttcctgcttgggttgataatagaatatattcatttaatgtctcccttctctagcattctgttagcagtcatctgctggtgcaaccagtcatagccctgagtgataaaacgtgagagatttagtactcaggctctgaggtgttgttttgaccactaccatctacagattcccaactctactggatagtcaggttcctgaaacatgtaaatccagataatcagagttttattgtatatggaacatatctt

SEQ ID NO: 7471 - DNA, 549 bp, mus musculus
agtaagtagtcctttatcctcaccaaaatgtaggtggtgattacaaccttcaatacattcacatttagatatgctctacatcaagttggaatgcatccctgacaatcaagatattaaaataaactatgaggttaactaatttttatgatagcctgatattaaagcttcctcagctatctttgcatatatttaaaacttaggtaaggctaggcacggtggctcacacctgtaatcccagcactttgggaggctgagtcgggcagagcacaaagtcaggagattgagaccaccctggctaacacggtgaaaccccgtctctactacaaatacaaaaattagccaggcatcactaatcccagctactcgagaggctgaggcaggagaatcgcttgaactcaggaggcagaggttgcagtgagctgagattgtgccactgtactccagcctgggcaacagagcaaaactccatctcgaaaacaaaacaaaacaaaaaacctaggtaatttcattacttatttggtaagcttgtagatcttccctagtcttccc

SEQ ID NO: 7472 - DNA, 1483 bp, mus musculus
ctgtgaattaaaccacaattggccttaactattactccttaaagtgtagcattttgtcattctctttgatactaaaagatgttcacatacttgtaattggcagataggcttaatttgtgctggttatagtgcaatgagcgaggcaattaaataggttctgatttttttaattggacaaaacactttgcttagtcacaaatatagggacttttagagggtataaaattccttctgatagaagataattatttctttgatctcaattaaatttcttacagtatttattgaggagaaatcattcttcatttgaatatagcaatctttctaaacaaataacacattcatttatctcacactcaacagtaaaaattaccaagactatgttattataaaaagaatcttttttttgtttgtttttatttttctttccaccaaatttacaactgaaatttagggattaacaacaaagtgtaatttctggaacactgctttgtgtataaaccttaatgggtgatttgaaatgtatctttgaaaagcaggggtccttcctttactctcatcaagcttgagtgaaaaaggtcaaggctcagtaaagttactagtcttatcctgggtattaaagttgctaaggctgtagtttttaactgcaggaaagaatgtagtctagtggaaaaagcatttgaatactcagagataagagggtccaggtatctctgggaagacattccctagccatgtgacgtttgtttagttaatcaaactcaattccagtttccttatctgttagataacatgttagataacagggtgagtcctgtccaacttctaaacatcctctgattctttaacacaatacattaaaataaaatcgaaatgttacatgtttaattgtctatgttcaatgattaaaatgcaatacttcccatataggattagcagtgttctttttctgtccagtattatccctcccccacttttttttcattcttgagctgccaggagacagttacagaagagatcagattggataaattctaaaatcaagtattataattattatatttataacatttacttttataattttgtaaatttataaaataatttaatcaatatattttataaatataataattataattataattataataaagtataaataatttatacatttaagtaatttcagaaatactcatcaaactaaggcctgaaaatatatgaaaacattaaaattccaaaataaatttgatatttcacccgaaagttggcaaaggagttagcctttgagtttgaagaccttctgtgcatcactagattacaaagaaagcatatgttgtaacacagtactaagactatagcaatatctcttattacaaattgatgggaagctagaaataaattcataagaaatgccctaaagtacattccgtatgtaactctagtagaagaagaatcacataatgaactgtactgaaaaaat

SEQ ID NO: 7473 - DNA, 530 bp, mus musculus
tccctcattgaaaaaaaaaaaaaaaaactacattagtaaaagtttgggggccaggggatatgctttagtaatctgtaatgagttattgattctatagaccatcatcatgaattgaaataattctcatttgaaaaactctagaacctgtggtttggggtaagctatatcttctattgttcatcatcttaacactgtaggatcattctttacagagatacaaacacggttgatttacctattaggcattgtaggtactgtagatcatcaaagaaaatgttatgatgtaacattaatatattattattgcaactgtatggtaaaatataatttcgaatatgcttttaatagaagaaggggcatacaaagtcaaaagtgggtggtctcacagaagtgctaatgcagccctagacggtgaatcaaatgacataaaccaacccctatatttattttattttcagaagatggtgaaagtgtctccctcctttgctagaagtaaagttaagcccctttgccttgaattcccaaggaaa

SEQ ID NO: 7474 - DNA, 1333 bp, mus musculus
tatcccaacattagaagtagttaatgtatccataggcaattgttagatacatatgtaagaaagtgaaaaaccgacagacagacaaaacccacctaagtcaataatattggcaataggatttagaatgctgttatggcacatgagatgctccacatcctacctacatggaatatggggtatgtgtaaagaatattgtttagccctattttttcgtttgtttcttttgaactactccgttttccttaactctccttatctttttctgaatgaccttaaactcaaggtagtcgttgagtgggagggatgatttttagccatctttttcctccaactcaggtagataggatttaccagcttggccttaatttcctcctttctgttaacattgaaaaccatcatactaactgtaaaaatcaaatactgtaataagagtgagggagtgcatgttttaaagtctgtcgctatattagctcataccacatatgtggcaagaagcagatactgtacaaatcagttcaataatgaggcattgaaacacaagttacatactgtgctaggaataaaatgataaacagagtaacactattctgtccttttggatttttatagtttagtaggaatgtattaagtaatgacaagtacatgaatatgattaaagggatgtaaaatactgaatagcaaagggattttactttgtctatgggaccagtgaaaacctttgagaaagtgttctttaaacaaagacttgaaagttgagcaggaggtagccaggcataaaggaacccagagagttttccaagtggagttttccaaaaagcatgtgtgaagacttgcaagcttgtgcaacccaccattttttttgttgttgctgttctgttttgttttgctttaggattttagcagcctgaagccatggatctttgtttctgtctctagttttaagtggaaaagtgggctgaggaaggggcttcactggcccagcaagaaacagaaatttggaacccatgactgtatttctcctgtggacaccccctgcctaggacaagagagagctgtgctgtagaatgctggggaaatggaaaggcagcattggtggaacagagagcatggagaaatcgtcagtgctgggaaattgtgggagctgagcaacaagtgtgagatgagacaggtgggggccaaatgatgcagggcctagctctacttgtcaaggattttgaaatgaaccttaaaggaagctatttaaaggcttagtcaagggcctattatggtgtgatttgtgttttaaagtagccattcacctgcattatggagaatgaaatgaaaggaagccagg

SEQ ID NO: 7475 - DNA, 798 bp, mus musculus
ggactgattattcaatgtttttgaaccaaaggaagagaaactgcttggcttgtttttctttggcctccagaataagttatgctccaaacccagggtattggatgaaaactgtcgtatgtcttttcctggaagaatctattcaagtggccagagatcaattaaggatttgccaaatgcaaataattctgaataactgtgtactcttgctctacttctgcagttgcaaatgaagagagagagcctgcaggccccaaggatctttccgttcatgtcattgagcttccttccctctctttttacaggggatgaactgtagcctccttggaacatactacacttgcaataatttgcgcattaaccatcaagacacttcagtaaagctatgcagtgccaatagtttaagctggatcctattttgccctaacacaaagtgaactgagatgactatatttatatttcattatacttttgaattttagttacagtgatttttgtgtcaacacctccatatattagataacttaaaatgtgctatagtatctcaagtttttcagtagtgtttttaacataattattttttctctttgacattagcattctagatgtaacactttggatcttttaaagataaatttaggataaatgatagcagattttattattaaacaatttatttgtattttctggtcactgactttaatattatgactgatgagaaataatatgatatctgaatccccaaaaacagaaggccaatttgaattatataatttaatcctttgaagaatattgcaattt

SEQ ID NO: 7476 - DNA, 798 bp, mus musculus; identical to SEQ ID NO: 7475

SEQ ID NO: 7477 - DNA, 880 bp, mus musculus
aaatgagttgatgggtgtgaagagcttagtaccatgcctggcacttgataaatactttatacatgttagctgttattttcctgaaatttgagggccaaagttaaatgcatggaaaatttgcttagagaaactgagcatcttgtcatgatcccgccaaagttgatttgggaataaattgcctattgctaaattattgttaggaaaatactgacttttaaacatgtatctacttttgcctatactttagccacttcatctgtatactaggaggaaagtcaacaatggcctctccaaggaaggtaactgagaagcggcataacccagtggaaagcatctgtagaaagatcagagccatccacaagagagaagcaatttcaaatccaattcagcagattatcaaataccaatctagcagttttgatagcccacagacgaacaccaagaaatattttgaagaggtactgaggaaaatgactgctgcttgtgttcctacgcccggctctcattggtcaagttctgaggaagtcgatgccttcatttcatcgcctcaaataatatctccaagaaccccatccacctctcacctcagctcccctgagactgcaacatactctgttattctcacaagttctgaaaacgtctcaaagccgaagtcacagagcaacaagaattatacatctttgatgtcacagatcagaaaagcagagtttttctctaacaaggatttgaataactattgtagtgaaaataattttagtaccttaacacttgactttgattccacctttgttcaaagcttgaagtgttttgatcctcaggattcagtggtaaaaaaattatctctgaatgaagatggtaaatattcatcttttaatgtttg

SEQ ID NO: 7478 - DNA, 591 bp, mus musculus
cttatctaaagtagagtttctgcagtaaggagataggagaaagtaagaaatattggtgacctgggccactctgtgagaaaccgtaactctactatcgtttagaagaaaaatgaactcatgttcttggccatacccagtagaacctccatcacactgaacttggaggtggagagcaagttatggctcgaatcccagagagtcgcttttcctaataagatttagttaattttctttaataaacatttctacatcttcagtatgttattaggataccttccagacactttaaatggttgttgtttttacaattttcattatttatagttgttttgctgggaagagtgtccacagagcttctcataccacctttgggaagtgcttctccttaacatgatgaattagcctcctatggctgctttaacaaattaccaaaaacttgatggcttaaaacaatacaggtttattctcccacagttctggagtccagaagcccagaatcagtttcactaggctaaagtcaaggtgttggcagggctggttccttctggtgatacgaggggaattcatcccttgcctcttttagcttctaga

SEQ ID NO: 7479 - DNA, 10734 bp, mus musculus
acatcttttaaaatgttttgtttcttttttactctatgtcattaggtacattatctttgattccagataacaaaagtgaagcagtacgacagtgagggaatcattttctgatatttccaggatcatcacaatcaactcggggaactcagtgtgcagaagccctgcaggagggaaggggctgtcactcatcagtggtgtcattcagacctttgccccggacttcaccggcaaaatccctgtcaggtctttttccctccttctggattccagttaaagtttgtggccaaaatatgcagtgacagatggctcatgtcattgctgtaatgtcagcctttgggtctccgaggggatgactccaggaatagaaagtggagcacatacaggagtggatgtaaaacagaatctaagacaagcagggtcctccagttctcagaggaatcaggaacttcccttctaaactcatctaacaacagggagcagccccttctctctctcaatgtgcatagactgagacttgtgcatagacttgtgcatagactgagacttgggttcggtacctcctctgagccttagcagcttgattttgaacctgctcctcaattttctcataagtaaaatgggcatcatcattgtacttatcttctgagattcttgtggggtctaaataacatctgaaatgaatttagctaagtgctctgccctagctaagcactcaataaatggtaatgctactttcctcccactattaacttggttttatatgaaaaaacaatgcataatttaacataaaacaagaggcaaaacatagaaaccctactaattgaaatgttgttttgttaaaattcccaattcagatgggacttagactaaattagactaaagccagcatttcattgtgttattatagaaccagagggttttcccactgaaacaggcctggagagacaattagtttttcatttcacagttgaggtctctaaagctaagagagattgtggtctgcccatagttagatctaagaagcttccctgataaaatttcccatgttgaccattggaattggctctaattttccatttttgtttgcttccttttttgagaaaacatgtaaagttttctatcacatgcatttacaaagctataagttatgaaggatcctgtttttctctaatttggtatatcctgatcttttccctagaggtctgtgttggtgctgctgttttccagtttgtcagtttgtcttggcatcagtgcctcaccatttggcacctgactcaacatagttttaccaccattatctaaacagtaccaccccatctgaatgtatttcacaactggtcgtctccgtgccatgcctctgcctgggtctgctttccattacgttacccaaccatctgctccaaaagaatgtcaggaggaagtgatgctgctttgtgcagtgtgttaaaatcttgacctttacttgggtttagtcactgtgcatcactggattcctaactttttttcttcaagattctttccacactgagagccacgcaaagttcatcagattcatattttctgaaatatcctcataagcctcctcacctatgattaatttgagtgtaataccaattatagttaattactgggtgccagaatctttacatacatgacttttaattcttataatagccctatgtgttccgaagtgctattatccctgttttatggatatagaaactgagaatcgggggatttaactgacttccccaagaacccacagtaagtggctgcctttcccactaagccaagatgcccaggaggtgcctttgaagggcacaacagttgttctcaaatgttggcatgcataaagttgcctggcattattaaaagtacaccccatagaagctgggtgcaggggctcacacctgtaacccccactactcagaggactgaagcagaagaatcacttgagcccaggagttcaagtccaacctgggcaacataaggagagcccctttctttaaaaagtgtagctcatagagtctatcgcttaaattccaggctcttttccccaattctgattccatgggtggacccaggctctgttttttctgcacactttcctggagattctgatgcagaccatctgtgcagcacatcagctcaggtgagccacagcttggctctgcatccccagctatgcaccagctccaactgaagcaccacatttcctcccttccttctgcttaaagccataaattaaccaagtgctgagattcgcttttataataaaacgtaagctcaatgaggttttccggaattcaggttttgttggaggcagacatctagcctggggattaatagaactggtttctttgtctcttccccttactgactttttgtatgtcatttgataaaataacctcattgtgtttttattcttctcctctgtaaatggaatgtgaaaatccatgtctactacacaccataaaagactctaaggaggaaaaacgtatccgtgagagttgcacgcaaatctccatgcagagatcatggtgtgagtcctcaggatcaaattactctcttatacgtgttggacatgttgatttaatcatggttgctatttacttcacaaaatacaagggataacacatttggttggaatttgtgagacttgaacgcactatcttgcaatgcacgggttttgtactcttgggagagttatttattgtctatgtacctcatcgtcttagtgtgtgaaatgaaaatagtaatactattatcaacttcatggggttgtgtcacttagtgctttgcataactgaactataacaaattgcttagtccaaatattttcattctcaatagcctggcttcaaattattgacaatatcagcatattcattcttaagtacgtgctatacttgctgcaatattaggtgctacagaaaacaaatatgccattgtccttgctcttaggagagttacattgaagtagatggatgctcttacctgatacctaaagcaactgacttgggggggatttttgccatgtgtagttaaggatgaaaagccagatgcagaaaaatatatataatataatgttagtttttaaaatcatgaccaagtctccctttttttttcttttagagacaaggagtctctctgttactcaggctgtggagtgcagcggtacaatcatagctcactccagctttgaactccttgggcttaggtggtcctcctgctgtagtctcctgagtggctggaagtacaggtgcatgccaccatacctggataattttttatttttgtagaaacagcgtctcactatgttgcccaggctggtcttaaactcctaagctcaagtgatcctcctgccccagcctcccaaggtgctgggattatagacatgagccactgtgcccagtccccatatttttatatgtatatataatatatacagatataaaatatgtataatttatattatatataatgtactaaatatatgtggatatattatacatatgtatcattaatatatgttgtttaggacagagaataaaggaataaagaaaaggagagacacaaggaaaaatcacaagtaaacaacagttaaaaaattacaggactgttcatggtaaaaaaaaaagaacatatatgacatgattacattcaaataaattagtatctgtctgtgtgtgtgtacataaagcaaagcacaaaaacatagccaaatgctaacagtgtctaaatcaaggtagtgagatttaagtgatatcaactctttttctgtattgttagactctataacaacaaatgtgatttgtaataactaaaaaccttttagggaagacagactgtgccaaatatatttattattgtacataatacattgttttatctttttaaaattgtctctaacaggtatgaattacttttgaatgggaaaatatgttattctttaaacaaatattctcagtaatcataaaatgcagtggaacagagttattctaaatggaaggtcaaatctccttcagttacccaaataaagtaaagtgcacaatgaatttgctctgcaagaaaaaaaattgttactgaactctttttttccttcctttttttccttctgtagacgtttcaattatgtaattcctagatttgttgaaataatttcatttttaagacaactttacaatatgatttgacttctgtttttccaactcattattattttctacaactccacatgtcccaaacagagctcattagcttctcttccaccttaacctacttctcttcccatctccctttcaagaggaatgtcaccaccatcctccagtcacccaaactggatatctgggagccaccatggatatcttgctctagttctaggccctctgcaggcaatgagtcaatcatttctgtagatgctacatcctaatatgaggtctctccttatcacaccacttcttctccatagctattgtcctcattggtcctacctaaattgtagcaattatctttaaatcagccccccgtctccactttgaaattttgatcaagtaacaccacagaagaatattcaaacttcttcacttactatgcaaacagttatgagttgtctgcctagattcacatccttcaaagaaccaaccttctccaaaatctgtcatcctgggggctgtcagtcacggtaccctcactccccatcatattataagccagacaatgagagtgctctctccccataggctcagtgattgcttcagagttcagagatgggcatatgtaaaagaagcatcaagcattctgccccaaatcttttctgctagagttagagggacaaccctctcttgtttttggtgggttactgattaatttagcaaactcctttgtaagacttatttccttgaactttctgggaaagctctagtgtggaaacacagagcaagagaattattttagtcgccctataaataggacatggattttcatccagtttaggaaccaatctcaattctagaaaggtagccatgttatgtggtgctttatggtgatttctacattattataaatgtggtggctccaaaaaagggaagctattaattccaactatattttcaactaggatataaatgtctttaggtttttacaacgtatattatacaactgccataaaattatctacttttctgttctttttgttgattaataataggcataaaattacacatagctgaagtatacaattcaatgcattttcacaactgaatgcaactttgctactgtatctttttcatgtacataactaaattttaagatagctaaggtcaggactatgttttcactttccaaaacacctagctcagtcctaggtccagcaataatgctgcccaatattgatgttgctgtcttttacttaccagacaggtattgtgtaccagaaagtcactgggtgtaaaggtagaaagactacttcaacataaattcatgtaaaacaataattatattaatctctaacaattatcaaggatttagaggttttattattatttctgttttacagattaggaaactgtaatagacagagattaaaaaattgaccaagattaattagccagaaatagaagagcaagaccccaagataaaacttaatttccaaaaaataatttaagccatgcagtctctccactatgataattatcttttctttgagactgagaaaaaacttagccatctttcttaagaccaaggaatagaacacactttctttagtaaacattagtgatgattcagcgttggaggaggaaagaagttgaagaaactgtagtagcgtttaaaattctgcaaagaagatgggcaagaccacatgttagaaatgacagacttactttttgattgaaggcatcttccctttcttcctggatccagatcacctctgcagcactggcttcttttccatgctgttgttgtgtgtaattgctatgatccttaatttgggagctctgcctgatgggtggaattgtacttttgagtgggcagcagcctgcctcttgtctcttgaaatgcctgtcattttatcacaaagagatggatgtgaaagtgagattgtccttgagtccactgagaagatatcaaccaaacaactcacaaaatcacatttatttaaattgtttaaggtaagaacatttttcagattcttgaattatatgtttaaagtaatccaagatttttcttggagataggcagtctggaaagctgtatattctactaagaattttggataacatctttatgttctgactcagagtgtattgtcaatatttctgttaaaaaatgaaaaacaagcaacaggcattaaggatttggtaactaactttctttggctatatttttacttaatatagctaagacaaagaaaattttagcgacactttaaacaaaattatttaaagtgaagacaataatatatatgctaatttgatgtcactgccatgtaatgctctaaatagtacaatagaattgacatatttgattctgaactagtggagactacacatgaagaatatgtagattatgaatctgtagacaaggaagataaggtagaattaaagaatgattttggaattctcttataattaaagttatgcatcactttagttttgagagcaaaaagaagtctaagtatttaaaaaattatctttttaaagtaagatttccattttttcattactaaaaaaagtatgacagttgtgaaagacaatgttaattcacactagggagaaacatggccttaacctttcacaaatatgttggtctttctacctctgttaatgaatgtctttcaaaccaaacagtagaagcacagcagccataccagtgtgtgattgttttaataatttgatgacctgaagaacaatgaaagggtgataactccactaagctatcaacccaaactgccctgcatatagccctataaattaccaggaaagttctatttttccccataacatatttttgtaacaaatgttcttggtggattgggtggagaagaaggcagaatgagtctgcaattctatttaagacttgcatggtgatagaattttagagcttggagggactttagaagtcatttcatctaagtctctcattctacaaatgaaggaaatgaggcttagagaaggtccacaacttacccagaataattaagtaaattcatagtagaatcataaccccaaccttcctctattgattcttaacaatattaactaacagttttaagcatagactatatacaagcacggtgcttaagtgctttacatgaatgtttattgctctatgaaattggtggtatcattatctccatttaaccccaaggctctagccaaaaggagtaaatgagaagtagaccattcttggcagaaacaaaagcctaacttcaaatcatctctgaagtggaattaatgtgatcctttatctcaatcctttatctctactgcttctggccacttgtcagtagccaaggttaatcctccctgagagaagataacatcttagacttcaaattttcaaatcaatggctagcatgtactcataaataaccagatgtatcaggagccaagatgacatgaccacaaatccaaagaaacaatagatgataaaaacagagttcaggagaatcaggctaatgttcaaggaagtaagatacaggattggagacttcggcagagagctggaaactacaaaagtaaatgaaaattctggaactgaaaaatatcaccttaatggagattacacagcttataagaaacttagaaagctaattagaacataagtccaaagaaaatatccagatgaaggacagacacataaaaggatggaaaattgagtaaataagagacatagacgataccatgagaagctccaattgttgttacggaagtcctagagagaagagagaaaatagagtagaagcaatatttaaagataaaatgattgagaatttccaaaattgatgaaagacataaagattgaagaaactctaaaaaattccaagaaaaaaataaaaaggacaaccctaaaggtacacaacaataaaaccactgaaactcaaagacaaagagaaaatcttaaactcagccagagaaataaaaagacaaattgcctttgaaatagcaactgcaacaatggaatctacaaggcaacagaatatcattcaaatactgaaataaaatagctgtcaacctataaccagcaacatgtactttaaaaatgaaaaaaagacattttcagacaaaccaaaaaagaaaaatcactataagcagactgcactaaataataaatatttttaaatattgtttaaatagaatcggaataaattaaggctacgttttaatttctagattaatcaccaaataaaagaatagtaaaagagtgtatagccatcaagctaataacggaatagataataaagagaagaaagaagaggaaaaagaacatgaacaggctgggcacagtagctcccacctgtatgtaatcccaacactctgggaagctgaggcaggtgaatcacttgtgcccaggagttcaagaccaccaggggcaacacagtgacacctcgtttctgaaaagaaaaaaaagagaaaaaaaaaacataaacaaagtgagacaagaataaactaaatattaaaatggtggttttaaacctaaggatagtgtcaattacattaaacataaatgtacaaaatcttctaattaaaatagaaaaattattaagagaaatattttaaaatactactaaaaatagcaatattctgtttccaacatatacaaaatacagaacggttgaaagtaaaggaatttaaaataatatactatgcaagaatatttatcagaatgccaactacagtatggtacctggtaagtactcagaagtcacaaaatcagcttccattcaattgggagtagtagaagagtgagagatcacaaatgacctcaaatcatagttaaacaaaactaatataaataaatctggtcccagcatagaaaaacattctctattaagttaacatagcattaagcaaaaccaaggtaggtaaagacatccacaaattaaaattgacacccacaatttagcacacttctgctattatgcacaaatcaggatcacactacataatacttttttaaagtttagaattaacaaatatcacataactttctttatgaaaaactattaaagaagtaattactatagatgtcacaacagtatttaaggcaggaaaaggaattgttgttgaggaggacacatgaacagtttctggagtgctggcattgttctatttctttgtccggatagtggtttcatgagtttttccattataataattaatcaagttgtatatatatttaatattttataaatatttaatatttatgtaaatatatggtcatatatgtatattaatatatacatagtaaaagtcattatttttttaaatcacaagagccattttcttgattatgctcctgttttcaattagagcaggatcaagttaggccaagaagagtcccagaggtatattcaccaccctagcctgccctgcctcactgcatcctccatcttcatgaccacatgatgtctcaaacttcatcttgctaaagtctcaaggtcacattgattggtttctatgcatttctaaaaaataggtttctttgatatgcctttttctctgatacatagtaatttttacattatcacaaataggcactaaatttctttatctttgtaaaccaacaaaatcaggtgaaagtccccatcatgcccagaataaatttgacgcttgtttaggcagagcgagctttccatcagtacaatgctaagccattaagcaaagtattaataacaggtaggtaaagactatattgatggttataagattgttcatattaaagaaataacatcagctgttgaacattcactgttccatgcattatgcttatctgatatctcacaacaacctatgcgttaagtacagttgttttcccaattttacaggtaaagaaactgaagcctataggacttctcagtgacactgctagtagcttgaagaagaaggatttaagcccaggacttcttaggagttgagttaagacgtcctcacacagaaggctgtgcatgacaatagtccaccacaaagctatgctatagagaaagggaaatagtgggcttttctaaaacttgtgtctatgaagatgttacacagggaatttatctaaattccattatggagtaaagtaaaataaaagctaaagagcatagaaagcaatcttccttcgagaacaatactcatgaggtaacaccctgagaaaccccactaaaggtcttgcctttctttttctttttagtttcccatctgtgctcccgcaagcgtgaaattgaacggagaggagatgtatgtatatttccaaacactcccattcccaacagactcaaattccttatctaaattccctagaatatctccttctccaacctccttattttttattttattctttatttggttccactgctttctatagcaaagcgataaatagttccaagcctccctttcaagtctctaaatcttcttgtctttattgaatttctcctcactctattctgatgttttcattttcatggtccatcttactctgtattttcttctgtgacggtgaacattataaatactcctgcctctg

SEQ ID NO: 7480 - DNA, 1091 bp, mus musculus
cctacatcaatttcaagaacaggaacaataaatgtaaatacatcagaagtattcaacttggggactttcaggagaatacaaaaatagaaataaggagacattcttttcatcctattctggttcaattactttgttctctgtacaagctggagagcacatattctcccatcatgagagaaagggtggcggtcattcaacccaaaccaatcacatgtgctttgggcagaaactgtcaatattaaggcaaatcacatccagtttatcacagactcagttaaaatagaaggaaaatattccctgaaatatggtctctgatgcttggtaacagtgctttggagcttgacagatgtagagacagccaatcacctttacatctgccaaaatatctattctccaaagccagaaagataaaacgcctaaaaccacaatgtgaagagttgaatattgaaaattccatatgttttgcaggttgatgctaaatcctatgagaaaaaccagcacatcggggctcttgtaaccaactttcaggaaaggaatcctaatctccgagaggcaggtataagaaagattactgtttataaaggagtatggccatgctgaccttcaaagtgggcagagccacagcaagccacctcatcaggtctgataaccatgtcctggaaatgggtgatttggagatggctggtagggccaactatataagagttggccttattggtgaagtagccaaacaaatgaggatgcttcaaaactaccattcgagtgaacggagttgggcagtgggggacaggatttagggctgagcacctaatttctcaatcagataaagggcaaggtggttctcctcctcccagcttgggtaggaagtgcaatcagtccgatttcacaacagagaaggcaaatcctcctatgctgatgtcttctcctaaaatctattccttgctcactctatcataggcacactggcctcctgactgtcccttggttgtgctgtgcatgctcctagcaagggcctttgcacttgctgttctctgtgcctggcacactcttccccctgatttcctcatggccccctttctcacctccttcaa

SEQ ID NO: 7481 - DNA, 411 bp, mus musculus
agagaacagggcagaaactcagaaaggaccacaatgagcaaggtactgccaagtcagtcaaggagaaccactgggctccatcaaactgagaaagtgacccagacataggttaaacctctggtggacctcagccaggagtgccaacagaacgggcagcaacctgacaagagacattgcgccagagaggcctgagcacagaacgaggacatcacgtggacctcggaaccccagccccccacagccacaaggtcacaaaaccacataccgccaggtgaaatctgaaagatcacacattttcttcaaaagagagtagacatttacctcaagagattgtttacattttttgtcactggatcaaattttaaagaagtgactgaagtggccgtttcctggccatccagcaggtggagc

SEQ ID NO: 7482 - DNA, 132 bp, mus musculus
cctacaaagtatttattacaatgcctggcacagaacaagctctccttaattgtaaaaatgctaactcttattcttcataataaataaaagtaattaatgttatagaaaacaaaatcaaggatactgatttat

SEQ ID NO: 7483 - DNA, 579 bp, mus musculus
ttgatttatattttgtcagtctataactggtcttaactaaggtaagtattaagatctcatttttaacagcgagtattcttttgattttagttcattggaaatcctgggattcagaaatgtggattaaaagtaatttcttctattgtacattttcctgatgcattagagatgttatccctggaaggtgctatggattcagtgcttcacacactgcagatgtatccagatgaccaaggtcagtacaatttgaattcaggatttagaatagatttttgtagggcattagctggtgactggatgtctttaaatatttttcttcagttttgagatttaaaacaattctttttttttattttcctagaaattcagtgtctgggtttaagtcttataggatacttgattacaaagaagaatgtgttcataggaactggacatctgctggcaaaaattctggtttccagcttataccgatttaaggatgttgctgaaatacagactaaagtatgtgcattatcttggaaagaatttgggaacttgtgcgaatttcacttttggagcagtttgtgtaattcccacttt

SEQ ID NO: 7484 - DNA, 914 bp, mus musculus
ggattttcttgtgcttcgtagattttcacacatctgatgctcattaaggtcacttctttgtgtaacatgtaaatagctgctgtgttttctccttagcatcagcttagccagtgtactcccagttccacagtaaacataaactgctgtctccatggtaaacaaacagaaggtgtagaagtggtgccttgagaacagggtgcccagaggaatcaagcattatatttaagctcagctctttttgtaggcagaagcttacagcgtcagtgaaaatgggtggctcccattgtataggcaggcaaatgccaggacaaaatcaggtaagttgattcaagccacattttaaaatcagaaatgagtgtcacagtacaaacctgagagcagaaagaacccaaaggcaaagcaaaattgaagaaagaagactgaaaagaggaataaaaggaggtgaaaaatcaatattctgtttttctccatctggcattttggaaggtccaactgcagtttgtggagttgaaccgaaataaagcaaagcctagttcatgtttactcgggccttatcctcaaatagttcagattttagaaggatcaagagcctagtgtttttatacaatggggtgtatttatagagtttggctaacagggaaactaaaatgcttatcattattagttcatttccttcagaatttctgtttttctttcctttgaaacgagacctaagagaacattgccagttgaatagtcttggccgctggcatcataagcacattcaagttttccttcacagctgaggtgtctctaatgtgactagttaggtaaagccagcactgctgtatagtgtgcatatatcacagtgaaataaatgctgctgtgaacctcccaagtggcctggagaccacagcctaccttgctcttggcag

SEQ ID NO: 7485 - DNA, 914 bp, mus musculus; identical to SEQ ID NO: 7484

SEQ ID NO: 7486 - DNA, 914 bp, mus musculus; identical to SEQ ID NO: 7484

SEQ ID NO: 7487 - DNA, 569 bp, mus musculus
ccctccctgctcagctgtccagctcctactcatcctccggccccagggcaaattcactcttccacaaagcctgacctctcttcagcccacaggatctctcctgcctaggagcttggttgtgcatatttgtcctgtgtgcctttgacacagcacagtcatctctgactgccaacatctgttgctgccaacatggtatcagttaacccctgcactgccatttaacttttcctctgaagttctttgagaaggggaccctgcctcatgggccctttgtattgccatccaatgtgtgttagaatctaaacagttagataattatcaacctgtgcctgagacctgcaatgaatcaatatgtaaatgaatcagggcactggtcagtcttccagccccacttgatattaaagactcagtgaagatggttagcaaagcagaggacagcaaatgggtctccggcagctgtgaagcaccagagtttatccaaaggggggacgtggggtctagagactcatctcaaagttgcattttcataacaaatacactgggttttttttttttttagctatattgtg

SEQ ID NO: 7488 - DNA, 1057 bp, mus musculus
ccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccaggtaaggggatgttagtactctgttattctggaacagctgtaactcttcatggcacatctaatctaagagcccttcttttttctctttccttccagatccccttcctcctccactctcacccatcatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcc

SEQ ID NO: 7489 - DNA, 1395 bp, mus musculus
agtggaagaagagaaagggtgtctgaaacctaaaccaggtctcagtgaatgatgtcagttctcttaggctggtcctgaaagacacactcctctaccaaagtagcttcaattccacagagaacagaattggagatgacaagggagaaaactagaaagcaggtaaagcatagtcacaacagtagccatagtccagacaatacttctttgagttagatgtcatcagaaagcagaccagactgggaacacagtgcccacacctgggtctctgagcttaggtgtcttacagttctttcctcacttttctgtctttggtctcatcccacccaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtttgtgattaaaagtgcttcaacccacctctactgtctcaacctcttcagtgactctatccgcagtttcctgaatccataagctaattaagagcttttccaggtctgattcagaaggccctggacaccaaatttttcctttctgtgcatggtaggaagagtcagccagggtgcttacattttagagctttatgtttt

SEQ ID NO: 7490 - DNA, 1382 bp, mus musculus
tgtacttctattgccattttccagaatagtgtgtaaaggaatataatttggggaaagtggtgtagacctctttttttttttttttttttttaatatttaagatggaggtttaggagcttggagaagagaaaggactaggcagagaaacgaaggagcatccagtaaagtttagactgaaagcttctggaatgaggtccagacttgagcctagcttctggcacagtgcgcagcacagcacttggtgttggtggtgcatagcaaagaagggagaaatgccacagggaactgctgttttggatattgtctgagcagattattgccacaatcatatccttcctcttggcctctcacagggtgttgtgctgggatgttactttgggcctgctgcactctacatttgggcagtggggatcctggctgcaggacagagctccaccatgacaggaacctattctggccagtttgtcatggaggtacgtgctggtataggatagagggagataacacaacccttttgttacttcttcttcttcttcttttttttttttttttgagatggagtctcactcgtcgcccaagttggagtgtaatggcatgatctcggctcactgcaacctccacctcccgggttcaagtgattctcctgactcagcctcccgagtagctaggattacaggctctggccaccatactcggctaattttttgtatttttagtagagatggcgtttcaccatgttggccaggcaggtcttgaactcctgacctcaagtgatctacccgccttggcctctcaaagtgctgggattacaggcgtgagccactgcgcctggccccttttgtcacttcttaatcccattcttctgaggtctctcctgaacctccccaaaacttttttttgtttcctgttgcagacagtcatctgctcctatgttttcttccagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacaggtgaggaggaagctgaggaaacacatcctagttattcaggtagcattatgtactgcccttgggtaccaagcctagctgagtgctggggggatattgagaggaagacagaggcatggttgtggtctgcagtaaatgtatatgaaatccttggcatctaaaaggattttagaaatggttggttttttaaacctgttgaatgggaactatgaactttacttacatatgggacacaaaattgtagttcattaatgcaagcaaacattaaatgaacatataggacactgtgcta

SEQ ID NO: 7491 - DNA, 1382 bp, mus musculus; identical to SEQ ID NO: 7490

SEQ ID NO: 7492 - DNA, 1382 bp, mus musculus; identical to SEQ ID NO: 7490

SEQ ID NO: 7493 - DNA, 1382 bp, mus musculus; identical to SEQ ID NO: 7490

SEQ ID NO: 7494 - DNA, 1382 bp, mus musculus; identical to SEQ ID NO: 7490

SEQ ID NO: 7495 - DNA, 1114 bp, mus musculus
tgacctcaatggcaacctccccattccaggctccagttccagctctctgtgtcatccccaccgcttagcaagacccgtgctgccactggctccaccgcccactgcccacatgtgccacgccaccctgcactgggccaacacccctgtgtgcggatggcattggctcatggggggcctcagtgcagcagtgccaagctattttccctgatctaggagtgaagagcctttccccccccacattgaggcaccctctgccaacggattcccacagctaagttgtcaagatttctccaatgggtcaaagggagacagttcattgcaaggtggccattgcctggaaggcccaggtcccacaaagaggatggagtagattgacccttactgctaattctccacccaggtccaatcagatgtggccagtgtcagagtcaggcagatggcagaggctgtgagtgagggctgcttttagatggagatgtgggtaggactggcaatgagtgtcatctctaatacgctttgagtgctcaagatgtgccaaacgctgtacttcaagtgcgtaattcatctaactctcgcaacagtaggcattgtgattccttctttacaggtgtggaaactgaggttaagaacagttaagtatttgtatgatgtacagccagtagatggcagagctaagattccaacctaggtctttctgagtccaaagcacatgtgtgctcatacatcactgttataaccacactggttcagctggtctagttttctaggcccagaagaccactttgagagctgagtatttggtttggccatatctacactgactcgtctattgaatcaacaaataatgatggagcacgtgctctgtgccagcccccgtccctgatgctcaggccacagtggtgaacaactcaggagtttccagcccagaaaggagcaacagaaataagtacattacagtgaggaggaggctggtctcaccaatacacagtgcagaaaacctttgtaaggaaaccctaggctgatggttgtcacatggccctggccggggcaagtcaagagacacggttctggttctggtcctcactcttctcattactagcttcagtttccttct

SEQ ID NO: 7496 - DNA, 1141 bp, mus musculus
catgccatttcatatgtattatattcagcaaatgacaacaaatacacagccacatcaaaattaataataagattcctgagagctgaatagtttgctttcttcctttgccgttattccagctaagattaaccagcttttcagaagtctattatcatggtttctttccctttggttcccagcccttgcccaccacctcctacttccccacatttctttttgagcccgagattcactcaaccttctttgacaaatctttataggtgtatgattatctttgtcacactttcctaccccaaaactgggcataaaccacagaaaatagtctttttattcctttgtttccccatttgggaggacccctttccacagggacctgtgaggggagaagaaagggaaggctgattcttggttcacacaagcatgctcatgaatgcccaggccctagggtgagtccgctgtctacccacacactcagagctctccaggaacttacttgagtctctcctacccccacaaataaatgtacccacctgtgtgctcagcaataggtgcacataacgtgcacacagggcatcagtcaggattgcgtgtgtgactatgcctgccccactggacctgctctggcgccaggtagtgtcgcgggcgcttcctagtgcgggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcggtgactcctcaggctgagcggaatcgccatccaggcgccggaaacgacccgaatcccaaaatccgtggaagaaaattgcgctgaaagaacagagccaacgcccccgtcctgccaagtttggcgagacggcaagttggcttcaggagcacaatgccgctaaatgatgcctaagagaaaaattctcccagagaattgtctgggagcaacagcaaagacatggtgtttttattctcttagacatggtgtttt

SEQ ID NO: 7497 - DNA, 1810 bp, mus musculus
agggttgagctttgaaacaactgatgagagcctgaggagccattttgagcaatggggaacgctcacggactgtgtggtaagatttggaagggacaaagcagtaaaacagccgatttccttggcttatcttggtgcagtcttctccgaatgcttatgaaagtagttaatagcattatagttagagctttgttggcaaaggaacgtcctgctttgattttaaaagctacctcttaaatctagggtagtgggaaactggacgactttttataaaaggctggtgtaaagtttcctattgccctattcaaagttaaaatgacaaaagcttttgcggtcagactttgtgttacataaattaacactgttctcaggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagtgagtgggttttttttcttcttcttcttaaacttacttggatatgtgctgctatggacttaagattcgggagttttctaaacttaccaaaattttttattcgagtataggctttgctaatctaaacctatggtttttctcctattaggattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcagtaagtatcagatagtggcatttagtaagggttccacaatctgtatggcattctaaaccctgataccatgttgtatctatgttttttttttagttcagaaataccatactgtgaatggccacaactgtgaagttagaaaagccctgtcaaagcaagagatggctagtgcttcatccagccaaagaggtatgcttgttgcttaattaaaccttaaaggtaactttgagttactccagtatgaatgatttaatgcttaaacttcatgtcttaaggtcgaagtggttctggaaactttggtggtggtcgtggaggtggtttcggtgggaatgacaacttcggtcgtggaggaaacttcagtggtcgtggtatgtatggtttatctacatgtagttctgacttctcaccatctttgctatgaagattttacagtacgggaactgcattcagaatgtcactttaagtccaagtcatacttaaaacttgaaactttttcttacaggtggctttggtggcagccgtggtggtggtggatatggtggcagtggggatggctataatggatttggtaatgatggtaagttttttaggaataagtagagaaaaattcctggcaacctggatctttagaataggttagtagagactaaaattctggtgcatgtcaaactcaactttgcccataacacgcatgctgtgagcaggccttcagccgttacacttgcacaagttttcattgtcaaatacttttgtcttattgagaagaattgtattcttgtaggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggt

SEQ ID NO: 7498 - DNA, 1810 bp, mus musculus; identical to SEQ ID NO: 7497

SEQ ID NO: 7499 - DNA, 1037 bp, mus musculus
actctgggcaagtaaactagaacttcaaaatctttatctgcaaaatgatgagaatgatatcttgcagggtttttaaacactaaatataactggcataatacatgtggcatgaggcctggcaccttattggtgtttaataatcggtagtcattccttttttcttcttcattatcgtcatcaccatcattccctcctatgtgggtgagatctccatcacactgctctggtggaaacagagactaatgcagaggtggactattgagaaaaggtgacccatgggagtagaagcagtattgagtaatgattaaaaccatcagaaggaattactgggttgcagtctggagtgtgtgactcagctggagtctgagtacaaaggtccccaagcagaagcatcagggacagacagggggcagctgatactgtgcccacagttggcacagtccaacaagatattcaaggataaatggggaaaaaaaaatcagtcctgagagagagcactgctgaaccatgttgccctgtttctgagcagcagctgcaagcagagctagcagctgcagctgttcttaggagcctggattcccagggaaagtgggcatcaggcaaagcaaaagggaaggagaggcaagcacagggtaataccttgcgttctcaggatgggagattccaccgcacagaaataagggaactgggcaaagagggaggtgtgagggatgacaacgactgggcgttctgtatgtgaaatgatgccgattattgaaagcaagctgatggatccatagaaagagctagactggggatcaggatctttctagtcacttatatctttagagtgctacataaacatggaccaataattactaacatgaagtgagtgctaagcaagtacaggaaacgttcttaatcttttacaaacgtgaaactgtgtaattcttactacaatgttacgacgtctgaggcacacaggggtaaagcaactctaccaggctgtataaccagcaagtgtcagagctgagatataaccccagaagtgtggcttc

SEQ ID NO: 7500 - DNA, 1075 bp, mus musculus
cttattttgattttactgtggttgcttctaaatgtaaaactattctatcagatgcactgccaagaaaactccaatttgtatcagcgtttttttgtctgttttttcccgttggcaacttcagggaccaaaagttgaccaggcttcattataatccactcatttttctcagataggtcttggctatgaagagcgaactgaacaggaattactcagaggtgacagagtttattctgctgggattcagaacatcgccagaagcacagattctcttattcttcctgttcttgcttatctacatggtcattgtgttgagaaatctcagcatgttagttgtcattgaaatagactccagacttcacacacctgtgtatttctttctcagaaatttgtcctatttggatctccgctactccacagttattgcttccaaaactgactactttattttccaaggaaaagaaaatttcttacaatggttgagcaacacagttgtttttctttgctctctttgttgggactgaaggtttttttctggatatgatggcatatgatcgcttctcagctatttgttcacctttcttctatactgtatgtatgtctcagcaagcttgtgtttgtttggtggttggctcctctatctgtggatgcatcaactccatgatacaaacaggttttaccttcagtttgcatttctgtggagaaaacagattagagcactttttctgtgatgtctcagtcatgatcaagatctcatgtattgacatccttgtgaatgaggtagtactgtttattctctctgctctcatcaccaccaccacaactgtcattctggcttcctatgtgcatatcctctccactgtcctgaagattctctcaacccacggcagaaggaagactttctccacttgcagctctcacatcactgtggtgagtttattctatggaactgtattcttcatgtatgcccaacctggggccatctccaaagagcaaggttatagttgtattctaaactcttgtcatccctatgttaaatatctgatttatagtctaagaaataggtgcaaaatgcttt

SEQ ID NO: 7501 - DNA, 1228 bp, mus musculus
ggcttctgtttaaatgttagcatcataattttttatttatggcctgtaataatgtattttcagtgaagaaagactgatatttaacttctaataatatttgttacttgaatgaaaggcagattggaaactacagagggttgctaatggggaactcttaaaattttatagattattcattaattatgtatattttaaaaatattatgcctatcttcaacagttttattttttttttaacattctataggaggaacatacattttctcttctaaaggggaaaataaagatcagcaatgaaaaactacacagtactcacagaattcattcttctagggctatcagatgacccagaatttcagattgtgatttttctctttttaattatcatgtacatattaagtgtcactggaaatttgaccatcatcactctcaccttggtggactcccatctgcagacccccatgtacttcttcctcaggaacttttctgtattagaaataacctttacaactctctgtttccctatatttctggccaccattatcaccagacacaaaactatttcatacaatagttgtacagctcagttgtttttcttcatctttatgggtataactgaattttaccttctaacagccaagtcctatgatcgttatgtggccatctgtaaaccccttcattatatgaccatcatgaacaagagagtctgcatattgcttgtcttttgtgcttggttggcaggttcttaaatatcttccccccagttattctttttctccggttagattactgtggctccaatgtcattgatcactttgcttgtgactatttctccctattgcaattatcctgcatagggaggcacatggctcctagaagtgattggtttttactctgcaatagtaattctgcttttcactttggcattaatcattctatcctacatgtttatcattaggacaattttgaaactcccctctgctagtcagcgaaaaaaggcattttctacgtgttcctctcacatgattgtcatttccatttcctatggaagctgcatattcatgtacgctaatcactctgcaaaagaaagagcgtcgttgaccaaaggagtagctattctcaatacctccgttgctcctatgatgaatccatttatatacaccctgaggaaccagcaagtgaagcaagcctttaaggacaccatccaaaaggttatgtttttctctggt

SEQ ID NO: 7502 - DNA, 1009 bp, mus musculus
atttttaaaggaggattgggtagatatcaaagaacagtgatgaaaaaccacacagtaataagaacttttatcctgctgggactgacaggtgacccacacctgcaagttctgctttttatctttctatttctcacctacatgttgagtgtaacagggaacctgactattatcaccctcacattggtggaccaccaccttaaaactcctatgtacttctttctcagaaatttttccttcttagaagtctcatttactacagtctgcattcccagattcttgtacaatatatcaatgggggacaataccattacctacaatgcttgtgccagtcaaatattctttgttattctctttggagcaacagaattttttctcttggcagccatgtcctatgaccgctatgtggccatctgtaaaccccttcattatgtggtcatcatgaacaacagggtgtgtaccttattagttctctgctgttgggtggctggcttgatgatcattgttccaccacttagcttaggcctccagctcgaattctgtgactccaatgccattgatcattttagctgtgatgcaggtcctctcctaaagatctcatgctcagatacatgggtaatagaacagatggttatacttatggctgtatttgcactcattatcaccctagtttgtgtgattctgtcctacttgtacatagtcagaacaattctgaagttcccttctgttcagcaaaggaaaaaggccttttctacctgttcatcccacatgattgtggtttccattgcctatggaagctgcatcttcatctatatcaagccctctgcaaaagatgaggtggccataaataaaggagtttcagttcttactacttctgtcgcacccttgttgaaccccttcatttacaccttgaggaacaagcaagtgaaacaagctttcagtgactctataaagaggattgcatttctctcaaagaagtagaagctgtgatgaattggcataaagtgaatga

SEQ ID NO: 7503 - DNA, 1601 bp, mus musculus
tagatacaaaattccaaagaagtttgtgtaaattgattttattttttaataatgtctacatttgctgcatatagctatgacttttgcaaatgtgtacaaaacagtcatgatgaaaaataaaattctcttgtagtgagattaaattatgatatatttatatttttaataaaattcagttactcttaatagtattttatcaaaggaaatgattaaatcgttatgtttttttaatctctatttttttaataagagtgaaaacaactactaatgaattcagaaattgattatatattttagagtcatattttcaactaagaaaatggtgatgcacttcatttattttttcagggatagagtctcactctgttgcccaggctgggttgcagtggcccaatcatagctcactgtaacttcaaaccctagttcctggactcaggtgatccacctccagaagtagctagaactacagatgcacatcaccagacctggctaattgttttgaattttttttgtagagattgttgggacgggtgtaggggatgtctcattatgttgcataggctggtctcaaatccctggtctcaagcaatccttccacctcagcctcccaaagcactgggatcctcccaaagcactgggattataggtatgagccaccacacccagatttgttttactcttgagcaaacctttgttgttaatttgtaaagcagctaaattatttccaaataaacttaaaacataagaactgaaagagaaaaaagtaaactatattatgtaatatacaatattttttcttctctcaaaacatttaattaaatttcttctgaattaaattttgtcaatcaatatttttgcctgttctgaagtgttatttttattgttgaatatgtaatgtttttcttctacatgacttagcatattatctcaatgtaaattcaagagcccccacattcatctgtcaatgttaatcctttggcaaattttttctctatcatccttcttagtatatttcttctcctcttgtagtaatttttcagtcaattatttccaggcttttaatggaaatggtaggtgttagagaaccacagaaaacctgcttccttgatctcatcttattttgctacttttcattttgccaatgagtctgtgttctaacatatatattttctgtaaaatacattaagcatttctgtaaattcaatgtgattatcagggtacataaagcagacttttattcttcaaccagagcaaatatggcaatcaataagttttcattgctcacacatgttggtcaaaataagcagttccaaaagaaatattttttctatttttaaaaatgcatgaacacaatgaagtcaattctccaagaaaaatacctttaaccttgttatgtttgattgacttctaaaattgttcaggttttctttatctagatggaagtagaacaaacttcattccttccaaaattctacagtgcagtgttggtttaaattattaaagcattagaaatgcaggtgcaagtgagtgcataaatgaaagttcacattcttgcatttagggattcataacatggaaaatgaggaattattaatgtttta

SEQ ID NO: 7504 - DNA, 1045 bp, mus musculus
aatcctgagagaatgtacagctgtggaaattgggtgaaattctaacaaggagacgggataataacttcccctcttttttccacttctgctttcctactcccaaccaagagctgggatgtttgtgtctaagttctttgggggctatgtgcctgagatggtgctcacccctgatgatcagcgcctgctggcccatgtcaccctggagctccagcactatcaccagctacttgagaaggttcggtaagtaactgacacctctgtcttttctgctggcatgttgagagcctccttgtattggtctctgtaggacattacaccttggcctgcttcctcccttcccaggatccgggatgccttgcgcagtatcctcaccatatctcgacatggcaaccaatatattcaggtgaatgagccctggaagcggattaaaggcagtgaggctgacaggtaggtaagcggggagggttggctaaaggcataaagtggcttgtaagctgtatcctcctggaggtcttgactaatgtctcctcttcctcaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtaggtggaagagccagcctctcttaaaattgatactcttgccatgcagcttttggagtgggtgagagaagacctaacatctctccagtgttactttggtcatgggactcctaagtttctgatataaagtccttggtagtcgttcacaagtccggaattatctgtacatcttcattgttcttcatgccagaaaccagaacctggcacacaaaactaactggtaaacagatatttgaagaaacactgtgatcacctagtctccataatgctagcagatagtgggcagggaaaatacaggaaagccatttcctctttgacac

SEQ ID NO: 7505 - DNA, 908 bp, mus musculus
gccccatgtaatctggacgttgacctcccgtgcccccttttgctttccgttaggctacagtggtaaccacagtactgtctttttgccactaggggtcactgtcacatgtccaaagaagtgagcttggccgctgtagattagaaccacaggggtggtagactgcagatctatcaggagaccctagggggccatctcaaccccacctcttcctccaccctgaaataattttggatggataggtgtttttggaactaagacatctccagttaaggcgatgtttgcttcacgcctgcacctgtgtcccatcctcttcccatctgtatatgccaccagtaagctttaggaaacgccccacgaaatcagtcagcgctcccctcccatcttgctcagtggaggtggcaaagcccctctttttcctcctctgtccccaggtgctctcctctagcagcacaggaaccttctttgttcttgtgtgtcactgggtttctcaccaaggttgctttagggcccagaagtggcacagagaacatggccagtctcttactgggctgcatctaagctgagccctctccaggggtttcccagaatagtaaaccaggcacacacaggcagaaaagtctgagaagcagagaagtaggaatgcagaagaggagttggggagacctaggggtggaggtgcaagcctgggtcacggggggcggtggtaggggggtctgcttgttggtattaaaggaacaggacagtaaaccaaagtgtgtgcagatgccacctgttcctgttctgtgactgagctacaagctgggccctcacaccctctttctctttctttcccagtttctaagagggactgaggcctcttctcagcatgctgcaaacctgtggtctctgatactaactccctccccaac

SEQ ID NO: 7506 - DNA, 1457 bp, mus musculus
aaagagctaggaatggtccagtaactatgccagcaatgtggcagactaagtgggagagaaatggcgtagagtggggaagaaagtgggtataaataaggcatgggaatgttcagctcacaggggtgggtgaggagttggggaagggggtatagatttagctgcttgtgttgactgacatttagctttacccatcccaacacaagatccaaaggctaaagcctggcaggaaggccacctcaaactcaagtaactgataagtatcccacagggaggtggagcacagagaaggaggacctgtcagatgtggtgtttgggagttgaggcaggcaatgtccaatcattctcttgtagatggacgatgtagacagggggctaatctgtatggctagggctgacaatgactagggtagagcgagacagtagtaagtcagataagagagtccaaattgtctacaagtaaaagtgcttgatgccgatattgggaacctgaatgtgaaaccagaggaatcatagcaccaaatatatggaagcaagaaaccatgggtccagacaggaggctgaccctggtgtgtccctgagacacagagtatgtgacccagctggattctttgttttttttttgtttgtttgtttttgttttgttttttttgaaatggagtcttgctctgttgccaggctggagtgcagtggtatgatcttggctcacgacaacctccgactccatgattcaagcgattttcctgcctcagcctcccgagtagctaggattacaggcatgcactaccatgctcacccagctggattttatgtgctctctttggagtgacatctggggttttcagccacacttaaagggcaggggatatggacaggcaagtgattaattgtctccagcaaaatctgttttcaggttccagggcactatctagagcatccaaatgctgctgcctaaactgaagtcccaggtgcccagaaggtacgttctctgggtggattttttctggttggcctggagaggtcatggactacttcctaaaatgggccactaaagaatttagccttcgtgaacccgggaggcggaggttgcagtgagccgagatagtgccactgcactccggcctgggcgaaagagcaagactctgtctcaaaaaaaaaaaaaaaaaaaaaaaaaaaaagtagccttcaatagtttttgacacttgaaacaataattactgcatttcttgtatggaattttataccacctttatgtttactaaatgaagctcagtcctgaaatattttctgcccactttctgaggagaaaataatagagttgtatcctttataagtctatttcaaaaaggaggctgcaagttgctcctggggaggcatggcaaagacaggttctgtacctttgtggccacagggcctaaatattagtgagatccatttccagagaatgccaacattaatac

SEQ ID NO: 7507 - DNA, 2657 bp, mus musculus
tagtgcttatgatttacttagcatgtgtgtgctgagaggtcaaccaaatattttacaaatgtgaagtcagctttagctctattttacagatgaggcaaactgaggtttacagaagagcttagtgcagttgcaggggatttaactctggtctgtcttatacaagcccactggctaccttatactacagtttcttttcttttttttttttttttttagtatttattgatcattcttgggtgtttctcagagagggggatgtggcagggtcataggataatagtggagagaaggtcagcagataaacacatgaacataggtctctggttttcctaggcagaggtccctgcggccttccacagtgtttgtgtccctgggtacttgagattagggagtggtgatgactcttaactagcatgctgccttcaagcatctgtttaacaaagcacatcttgcaccgcccttaatccatttaaccctgagttgacacagcacatgtttcagagagcatggggttgggggtaaggttatagattaacagcatcccaaggcagaagaatttttcttagtacagaacaaaattgtgtctcctatgtctacttctttctacacagacacagtaacaatctgatctctctttcttttccccacatttcccccttttcctttcaacaaaaccgccatcgtcatcatggcccgctctcgatggtcactgtctcttctgagctgctgggtacacttcccagacagggcggcctggcagaggtgctcctcacttcccagacggggcagccgggcagaggcactcctcatttcccagacggggcggccgggcagaggcgctcctcacatcccagacgatgggtggccgggcagaggcgctccccacctcccagacggggcggctgggcagagacgccccccacctcccagatggggtggccgggcagaggcgccccccacttcccagacggggtggccgggcagaggcgccccccacctcccagacgaagggcggccgggcagaggcgctccccacctcccagacgaagggcggccgggcagaggcgctccccacctcccagacgaagggcggccgggcagaggcgctccccacctcccagacgaagggctgctgggcagaggcgctccccacctcccagatgaagggtggccgggcagaggcgcccctcacctcccagacgggggggccgggcagagacgcccctcacctcccagacggggcggccgggcagaggcgcccacttcccagacggggcagctgggcagaggcgctccccacctcccagagtaagggcggccgggcagaggcgctcctcacctcccagacagggcagccaggcagagacgctctccacttcccagacggggtggcggctgggcagagactgtaatcttagcactttgggaggccaaggcaggcggctggaaggtgcaggttgcagcgagctgagatcacgccactgcactccagcctgggcaacactgagcattgagtgagcgagactccgtctgcaatcccagcaccctgggaggctgaggtgggcagaccactcgaggtcaggagccggagaccagcccggtcaacagggcaaaaccctgtctcctccaaaaatacaaaaaccagtcaggcatggcggcgcgctggcaaacccaggccaaggcaggagaaccacgggagcccggggcagggaggctgcagcgagccgagaccacggcagtacaatccagcctcggtaacagagggagaccaaataaagaaatgggggagagggagggggagggggagggggagagggagagggagagggactacagtttcaaattagtgtttttgtgtagatattttgaatgttggaaaagtaaacctatagtacaaaaatgtaaaagctaatggagaatggtgtgtttcttaggcacatttaaatatgttatgagactacctcaattgaccagtctcctttattcttttctggcaggggagtagctatttgggggcagttttcaaagaatgttgaattatttaaacacacagtactttgtcaccaaggcattcctatcagtgtctgaagacggaaagggaaggaagatgagtttattccatatggttggataattattatcatggaagaaaacatggactaggagttcatatctaagaactgctcattttttgactttgtatgtgtcacaagttttcagaatattggtttcctcatctgcaaaacaaggaatagaattctctgattactttctgtgagtaataaatggatggaatgacgtaatgtgtcactttggatgtcttagtcacttgaaataatattagactttcacataattatatattttttatatctgataaagccaaattagtgtttctgaattgctcgtgtctaaatgcctagtgtccttttgacttttctttgagagcgtttcatagtggtaatgttaaacacaaatcggaaatcatctgtgccatgttatatcttctgtccgctctaaagaggttgggattatgtataatcttcaaattcccagcagctattggttcctgctacatagtagacacttaagaaatgctttttaaatgaataaatgaatacatctaagaaagttgagctttctctgctgttactgga

SEQ ID NO: 7508 - DNA, 856 bp, mus musculus
actcctcaaaggtaacatgcaacttagttctgttatatgagagtctttttctttaatgtactggaaaaagcctatgtgaatctgttgatagaatttaaaattccaggccgggcgtggtggctcacgactgtaatcccagaactttgggaggccaaggcaggtggatcacttgaggtcaggagttcgagactagcctggccaacatggtgaaaccccatctctactaaaaatacaacagccaggtgtgatggtgcacgctcgtaatcccggctactcaggaggctgaggcaggagaatcgcttgaacccggaaggcagaggttgcagtgagctgagattgtgccactgcacgccagcctgggcaagagagtaagactctctctcaaaaaaaaaaaaaaagaatttaaaatcccaatttattttctaactcttttattggatgtatttagaacacagtatacctatagtatacctatgtgtttattatgtttgtaaatggtaactgacatttaattattagaagtacttacccctgccttcctccatttttattcatggctacttgagaaagcaaaaggaaaaaataatagttatcagtagtgtcactggaaagaagagaggagggacaaaactgagcagcagaattcgtatagacatttacgtttaaattctaaaagcccaattgagatgttcagggagggtttgttttgccctttggcctcatgaatgggtttcatgaatgggcttcagtggcttataaactctgtaaaattctattctaaattttgtacatttattttgttccggttaattccagaagacatttcaaacatttttcttacaccatataataaaaa

SEQ ID NO: 7509 - DNA, 695 bp, mus musculus
aatggctgactcatgaacacggaagtccagtctgcttcaaatcatgataagtctgctgtactacttatgctccagagtcccctattgatcaggccaaggctagacttcattagaggatatcctcgtttggtaatttgcactttcctatgtcacttccctttttctgatataggtttggcctgaagaacacttcctcaataagtcccttgtcctcagtttctgacttaggctctgcttctggataacccaacataaaatgaagaaaatttgagttcctggccatacttctggttatcacacctaatgatttctgatcttcacaatgactcttcgaggtagggattactaatcccattttatgaattattaccttaataataattcaggtacactgagccagattcagcgaaaaaggtagggtgcagaaagatagttcagatagatactgaactgcttcagtggttcctatggaggaactgatcaaggctgccttcagcaggaaggtacttggcgacccaactccagggccctaggctctaacttctcacaaaccagttccttcagagggaaggcagaggtgagaggacagaagctgtatcttttctcaatccatgttacatggtcactcttctaaacctttgaaaattaatcttagtcatttccgatgtctggcaggtggaatatgttaaatatgt

SEQ ID NO: 7510 - DNA, 939 bp, mus musculus
tgcctaatttatctgtcatcagcagcatcctagccatgcaagaatgtggctggttttcaagataataataaggtatcttggttactgaactaattactaaaaatcccaagaaatattgattgacaagtttggtagatatttagaagggagaataatgtgtttcattgattcccattaatattcaattatggcattaacctatcattaagtgtgtttctgtattccttctctagggttctctaaatgccatgtggtatgctgaggttggttgcttttgagtttttaaaaactataatcatagattacttgtgtaatttcagttggaataaaaagtaggtgtcaatatttttcttagctgctatgaatttctccctgcctgctggtctgaaataaaataactgcatcatgctttagcttgattgttttagtttttgcttaaatgcacagtctgatgactgtatgtggctaattttgccttcctttgtctttggtccctggctgtatttgtgcaatgtctttgatatgctacttggtgctgtttgtaaagaagcatttacaatagtatatgatgtctgaactctcctgaataggttaaagaactccgagaaaaggctgagttttataggaagcgagttcaggggacgcatttttctcgggaccatctgaatcagattttatctgatagcaactgctgttgggatgtctcctcaaccacaagctcagaaggaaccgttagtagcaacatcagagcattagatcttgctgggtgagatattctttgtggatggcaaaaaaagtttgttgaagcttatgtagatcatagaatgatataggaaaatgacctgactactcaaaatgtgtctcctagtcgaatggaattgtggcagccatttatttcatttttattctcagtgaaaaataaagcaatgtagattgctt

SEQ ID NO: 7511 - DNA, 556 bp, mus musculus
aaaaggcaaaaaatgtaaaaacatgaaataatgctatgctactcactaagtttctcttgtttggaaaaataaatacattatttataaaaatatgttatttacgttacatgcaatgggtttattattgttattttaaaatgaatgaataaataattatttttaaaatgtttatagcatgtttggttgggcgcgatggctcatgcctgtaatcccagcactttgggaggccaaggtgggcagatcatgaggtcaggagtttgagaccagcctgaccaacatggtgaaaccctgtcttttctaaaaatataaaaattagccaggtgtggtgacgggcacctgtaatcccagctactcaggagactgaggcaggagaatcacttgaacccagaaggcgggggttgcagtgagccgagattgtgccactgcactccagcctgggtaacagagcaagactctgtctcaaaaaaaaaaaaaagaaagaaaaatgtttatagcatagttaatatccacagatataacccaaataaacaaaagatttttgagatcctcaattatt

SEQ ID NO: 7512 - DNA, 942 bp, mus musculus
ccttatttttaatatggagccagagaagcccaaaaagcttaagtgatttcaacattcattaaccaacagttttggagctttcactatgtagcagatatttactagttggtgagtaggcaaatgttataagttgggaagtagtggagctgataagtgaacacaaaccctctagtttctattctattatggtaagtgtgagtgtatgtctccacactcactgctgctcttgatctgcaattgttctttggtatttccaacagttccaagggcagcattgcctttaactccattgactctagtagccatcaaactttatcttcttttcccatttgtcccaggaggatcctgggagtgtggaacgaaagataaagaaccttaagctgagccctaagtgccctagactggctaaagaggtaggtctggaggtcaggagtgctcttaaaccccagggcttgctgatgctcttcccaggtctgagtttccaaccccacccagagattgttggtttgagaatcagcatagtttacctggctgaacttcgcgttattggcatttctgtcccccagaacagtaaggaatttggttaccctgggccatggctggggcactggttagcagctgcccctcctgctcattttgcggctctatttcaacaagacttgaaaacctttgtcttcagagaactctccggctctaagcttttgtgcttttgtttggagcagcctgttcttgtacttgtagtttcaggtaaggcatctgatgtgtaattaaaggataaacacagagagaaataaaagtattttattacttatatgaagtgaagtaggtgcaaataataaaaagtgcaaatgaatttgagagaggaattgtgcaagcccttaaggggctattacccatctttaaaaaccaagagttgcttaacatgttactactttgtatttt

SEQ ID NO: 7513 - DNA, 1058 bp, mus musculus
tcatcttacagttttgctaattcccatggaaaaaaaaaatccccatgaatttcaattctagtaaactgttgaaacagcaagcacctgggatatctcttgggaaagcacaggctgctgcagtagacctgggatccgcagtgtctctagaaacagtaccaggcggttacctccaggtgactaaatgaggcttcatctcagcacacaagcttagaaagctttacgattagtcctgcttgctatggtaaggaaataacacaaagaagagtgcaaatggaagtcgacttcatcacaacatgcagtcaatttccaaacaggtgagataatctctcatgataggcagagggtcctcggtgtaatgttaagagcttaggagggtaaatattaagatttatgtctatatctgttcatgtaaatgtagaaaaatgagtcagcatagaacttatgtgatatctagggaaatatctttagcctaaaagtctgaaattaaaagaaaatgctatgcagtcattcaaaatatcttaacagtaaatatctaccataatcataaggagtttcttgtaaagttcataatcatcctaaggagagtagaattataaatatgttcacttgaacagaactcaaaagttcttaaaagacattgagtggagcagatattttctttgttttgtttagtgtggttcccacactgacatcagggaaaagatgactacaactagaaacgaaaattgagagagggttacagtgggttaattcactaaatctagacatttttataataatgacatctcggataccctgtgtttgtgtgcagacttcactaaaagactagtcagtatcttctgttataattgcatgtagggtccagtgagtgaaagtcagtgctatgagacatcatcagctaaattcccagctggggaactcagctttgttgttttttatcagtaaaccaagaaccttactctttaatgttggcttaaatatggctcttatttaaaatgatgtataaatttattaatctgtatagaaagtgctatcctgaggtgaaaaacctcgcccaa

SEQ ID NO: 7514 - DNA, 1058 bp, mus musculus; identical to SEQ ID NO: 7513

SEQ ID NO: 7515 - DNA, 1174 bp, mus musculus
actattattctgctgtctgaaatttctctgtattgatgacctaattcttcaacatatttccaatcaatttgtgtgtttagtactaactgcccatgtggataacagggcaaaatgcaaatgatgggatcagaatattcttgggaagtcagccagagaaagataaacatcacatattctcgctcatatcagagaactaaaaaaaaaaaaaaaaaaaaactggaaagttggggacctaattctaataaatttcagcatttggctattaaagaatgtatatacttggtgtcaaatgttcctgattcaagatatgctaggcattaaaataatccagtgttacaaaattaatctggtcaatatgttctacacccgactaattgttagaattaactgaggtacttcttttaaacatacacgttcctaatttacccctttccatatctgtctgtccctggctagcaatctgtcactttatagtctcccagcatctctaatatttttaaagttccttcagtaattttaatgtctatccacaaaggtttgggagcctcctggactaagccatactagtaggaggctgttcacatggatcatgcatatgaccgaatcatcaggtaatctgatggagtaggtatgaatgtcagtctataattcaacacaggaaagaaatggaactttattttctgtaattcaacttattttctacttttgagatgcccatctaccacagagaggagaataagtccaagttagcccaaggtgtccttgttttgtcccaggatgggtctgaagtagagagatagagaggcagttttagtgacaaggcatttcaagtggaaggctgttgtgtcacctgcagaagcagatgacataacccacccaaacgcatgcagtttggatgtcaatactgatgatgccacacacatacatcaaaagagtataaaaatgtttattaatcacataattgaagtatctggggacaacagggcaggcctctcaagaaagtctgaaatgaaagagcaaagaaaggagactggccttggtttttatgatagctaaggagtggggcaggggacaagagttcctacagggcaggcgattgtggtttggctggtaccaaaattgaaagcatgaggctttcttatcagctcgtccagatgtggggcagaaggggagg

SEQ ID NO: 7516 - DNA, 742 bp, mus musculus
tctactctgttggcatcctgtaggcaccagctttgcctattcacattttcctttcacgtagcttgtgtacccattttaaacacagcaaaagatactttgagaataccttctgcactacttttatcttttattttctttccttttcttcttaccttccttcctactctcctttatttttggaagctgcattcaccctactggaagaacctattctgaacataaagtaatttgcctcatcctgcttatccccatgacaaatagtttaagtagcatctggtgagacaagagaaaagagtaactatacatttacccttctgcaccctcatcttctacccagctgtctctcctcccttttcctctttatcaatattttccccttctttggaccaactatttaaactgttcttaaaatttattaaatagaagtggacctccagcaatttttcttgctcctataatctaaagtattcaaactcctcacttgaaacatgaaagaaaatcaggatgtaaacgttcccctttttaaacttttttattttctaaaccatcttcctctgcataaagtcagtctgccactctaaacagcacttgtcaggaatgtgtgaagttattaaaagagaaggaactttagaagatctaaattcaaattaccttgactaccattctttagtaataaaaggggagatagaaagaagacagaaaccaccagattttctaaaatctccagcaatattcatccatc

SEQ ID NO: 7517 - DNA, 473 bp, mus musculus
agcaatatcagaaagctgccaaagagagggcagcaaagttcagtgacatgagttttgtcctgtctgtgctgatctgcaggccaaaattcttcagtgttatcaccagagcacacaccagaccctcagtggctttgcactagccagcgtgtaagtgtgctgtgttcattatgccaaacagaacatgcttgagaagagatcataatatcaacttctggaacaagcaaatctccttcaacattaattccagaggtagaactttttttattttttcctagcaagaaaataacccatttaaagagaataccattaaagagaagcaccagagggtgaattctgaacaaattatatcacattttgatcagtaatgatttgaaaagacagccctcttgacctttttgcactttcaacttctactggccataaaaactttctcttctaaccaagctccttcatttcatgaaccttcactctaa

SEQ ID NO: 7518 - DNA, 370 bp, mus musculus
gggattagaaagagatttatgtttgttcatagggcacttcagggaacagttaagactcctaatggaaagtaaagtagaaatgttttggaggcatgcactcacctgaagacctaggagagccacctgagaatgcaaaggaagtgggaggctaggcgaggttgattgtactttgcagagctgggacaggaggactgggctgcccaagaccttgcataatttgaaaagagtagggcagcctgactgagcaacagaaatgctatactggcgagcagagtttgcctaagggggtgttaagcagctgagcaaggaaatctgctgtgactggagactgcaatgtgggcaatccacctgtgcataatcaatttttggt

SEQ ID NO: 7519 - DNA, 1537 bp, mus musculus
ttatttgcttccctgtgatcattaattttgttgccaaaacaagaattttaggtttgcataacatataatttctaaatagtgtgcacacattactttacctctccctcacaacatccatgtacagtaggcagagtagagcttattttctaatttatttactgatcatgaaaatgagacttagtcaatctggtcaaaatccttggctacaaagtggaacatttagaaccaaccacaggccttttaatttcataacataggctcttccccaacacattctataaacaatttctagcttctaaagttgtaaagccatatttttgttttatcttcaccttggtgaggtattcgtaatttcaggatggtactaataaagtgaaagtagaaaacgtgaaatcagaatttttcaaattcttgttgtaaaatatcaattttgctccacttctcaacttcattagtctcactacaaccataaaatcaagacacatctacaatatataaaatacttggtaatataatacattatgagtatacaatacttagatatcaaaaagagtattttatctttcaatctaaaactcctaactttatgtaccagttgtagtcattttttccttagaaatatgttgcccaaacatcataaaattttagaaatgtaagcaaatcatacattataaaacatttagagttgtaagaaaagcagattgaaaaaataaaatgtaatttgtctttctagaaataacagtgactaatattttaaatgctattttaatatttaaaattattatcaaattagtatttcacattcatattttattgcatttttgtgtgttcatattatttataaatatttataatattttacatgtgcctatgcagccatgtacatataacaatgtttacataattagaaacattgttttattttatttatttatttattttgagacaaaaatctcactgtgtcacccaggctggagtgcagtggcatgattttggctcactgcatcctctgcctcctgggttcaagtgattattttgcctcagcctcccgagtagctgggactaaaagtgcaccacacctatcaaatttttgtatttttagtagagatgaggtttgaccatgttggccaggctggtctcaaactcctgacctcagttgatccgcccgccttggcctcccaaagtgctgggattacaggcatgagctaccacaccaggccagaaacactgatttaaatatggtctctcttacatagtatggcattgtaaaaatgtttctgttatccaattttttcaaatattattaagaattatttttagagtatacaaaaataccggagacttgacacagcaagactgacacagccgttccacagtggctgaaccttaaattgctttttggtatagaaatatctgatatactaaatccccatttttcctctcccatatctggtcatctagcatccatccagttttctcccctccaatgcatttcataaaaatagagtgctttttacattcatttttgataatacta

SEQ ID NO: 7520 - DNA, 1366 bp, mus musculus
ttttttactaatataacaccaactttatttgcatgtcaacatactactttaaaatattcatataatcatactactttgttgatacagatatcacatttatagctgatgatatgttagcagatatctagtggatagaattcccggattgtttcctcataaaaagaatagattcagctgattttgcctttagtctttttcctttactttttcccacctagaggtcacatggcttattagaagttggactagctgacttgcaaccagggatataacatgcacatgcttaacgatgctggattacaaagaaatgtaatatctacttgatcagttgcagtttggactgcttagctctgggcctctttgttataataaaaatataatcttattagggaaaccactgcagctagctttcttttttatgcagctacatttatttttaactaatatagtcatactagtatagtggcattgatagaacttgcacttagcactaataagtcaatacaatactgtttccactaaactatactgtctataagcattcatgttttagtggtcacacatttacataccattgatagtaaaaactaaaaggatgaaagaagaaatctttacaaagcaaaatttaattataattatgatatcataacataattataatcgtgatctcttatatccttctttttttttttgagacagagtctcattctgctgcccagggtgcagtggctgctcactgcaaccttgaagttctgggctcaagtgttcctccagcttcagtctccagagtagctgggattataccacatccagctaatttatttttattttttatagagacagggtcctgctatgttgcccaggctgatcttgaactcctggcttcaaacaatcctcctgctttggcctctcaaagcactaggattaaagtcatgaatcaccccacccagccttatatatgttttgaagaaaacagaagagaagaagttgagttttagaatagcttttctgtgaactattatacaaattcttactcccctgagtaaataatcattattttctatcagatgatgctttcctctttcttcccatttatctccttcccctagatcaagaacgctgaagtcactccagccttttcctgctccttaacttctctgatgatttaattatttttcaacccttttacttatttccctcagcatttttcaaatgtatggtatcctcttgaccatgcatagtcaggtcttcattgctaataaactaaatcattgcaattttattatctcttgtcttcttgctttccatattttcctgatctaatatattctgcataattttgcaaatcaaaaacctttctgaatgc

SEQ ID NO: 7521 - DNA, 1974 bp, mus musculus
gtacagttcctgaccacacaggccaaagaggcttataagtgtttgctaaagaatgctttcctgtactctacagtcacatttaatctggcatacaaatatgtccttatgtacagcagcataaatgaagaagtaatggaagatatttataattaatgttctttgctttgcttagttaatcttacaatgaatccattgtcaattataactgactgcagaaagaattacagtcagggaactttaaaaaaaaaagaaacaaagtgagcatttacttttctttatcccttttctccttattacatgtacttttaatcagtttctctgtaatgagaacatttaaaggttgaattagagtttatgaacctatgagaaagagggttttgaaagggataaaaattcaaaatatatttggtaggaagaatcaaatgatacaaagttcagtgacagggtaagacagatgaaaaaatccagataagaacttttaggctgggtgcgatggctcatgcggataatcccagaactttgggaggccaaggtgggtggatcacctgagatcaagagttcgagaccagcctgatcaatatggtgaaaccccatctctgctaaaaacacaaaattagctgggtgtggtggcacatgcctgtaatcctagctgtttggaggctaaggcaggagaatcgcttgaacctgggagacagaggttgcagtaagctccagcctgggcaacaagagtgaaactccatctcaataaaaaaacttttttagaaaagtataagtgcaaaatataaaaagaatcattttaagtaataaccagtaaaaggagataaatttgaagatgaaaacaacattttgtggaattttttcgtcctccaattttcatctctttcatgaattcaaaacaacatgatcaaaaccattgtctacatctgtcacaccaggcacactactgtctcttcagatgcaggttctttattcctcactaaatgatcttcatacattcttgttgctaagaaatcacaaagaaactcacatgctttctctctaggccaaacagctctttgctgtttctctaaatcctgcatttcaaattccaagccatgcaatcctaaaatattatactccttttgattatgccatttaattaggccttgcatagataattttatattttatgagaactttctaggctttggttttttcattggtaaaatgaaaataagacaaaggattttaatgaaaacatagtacttatatagtatataaatatagtaagttctatatcaatgttatttttaacataatattaatcttgtatagccatttatattttaagtatatgtcctccttcagcaaatatgttattgaattttgttgtgtttccagcatatttctcatgaaatatgttcaataataatttactgtcattttccatgtccaattatatgttccctatttttaagggatctatttggttctattttgagctttgtctctcttatctctctgtattataccaaggaactatgatacaaaagatcatcaagctgaatctcaaagttgcactccagctatataataaccaacaaagcaatttccttcgcatctaattttgtctccgtgtctacaatcatgtcttattgttcagacttttacatgctcaattctagaataagcaaaatctcacaaattaatgttagctccacagaattctagtttaatcatttgtagctaaattcagactataagcatgtattacctttttcttcttagaaggagaactggtaattgatgtggggccaaacagcacagtacagcagaaaggatctaaatttgggaattatactgaggtatgttattttttcatatatagcttttttgtcatgtaacctcaggagaagtactcagactctttgagtcttatttaacacattattgtaataaaatatttcaaatttgatcattattgtgaatactact

SEQ ID NO: 7522 - DNA, 318 bp, mus musculus
tacagaattcaggatcatcagtggtcttagtgtgtacaccagagaaaatagcaatgctgcctaagttctttaaagacaaaattagcctcacatatgtatcattttccagttaatttgaataacaccaattttgttactaactccttttttaagctgccaccttgttacatgctttgaaggaaaagagttaatagccctaatgcaaggttttgattttctttcatggatgctgctgaagaaagataattaataataatgagaggcttattaaattcaggaggaagtggtggcatacaaattattcctacctagtaaaaa

SEQ ID NO: 7523 - DNA, 595 bp, mus musculus
tttgagagaaagtcttctccagcagagtgctatgtggttagggattatctgtcttacttgcctttttatctgtgtctcaagcacagtaggaaggggcttaataagtatttattatatagaatttactgagaaaaattataattagctttattgcattgacttattgtgtatctcttaaagtataaagggtatattcatatttatactgattcaaaaagttttttttttaattaaagcaaaggtggacttctgagtcatggacaaaccagaattcttgcccaccagtgtaagttacgtttcttcacatttggactgtttaatgggcacatatataacatacattgactagttaaaaaacaaagcaaaattataaatgtagctatgattgtgaaccacagaaaaatctatatgcatatggatagcctgaaaattactataccaaaattaaaatagctgttgtgataagatggtagaattataggtaatacttctttggttttttattttccttaatatgttttacattttcctgaaaaagtgaaaatatttgtttatttggaaaattcagctatatgcattcattaaagagatgtgt

SEQ ID NO: 7524 - DNA, 862 bp, mus musculus
ttatagctagattattttataggtaacacaaaatattttccaagatgaagttctttgaagcaaagtcattaattttgttatataattgaatttagctcctactttttaatctaagttacttttagaaatataaattagaaagtcatatgaatagatagactccttattgaaagtaaagtagcattatcttgtaattgtacagtaagaccaaacgcaaatgtgacaaaccaggttaatcaaataaatggtcattgaaaattgctattaaatgtgtaagtggtgactaagagaggctgaggtaatgataattatatttccatagttttctgataaagtagatgttttggatggaaaaaatactgaggtgatgtttatttacttattattttattctttcatttaacaaatattgatttaaattgacgctttgccaggcactcttctattactaatactaaatttgtgaacaagccagataacaaaactgctctcagggaacttaaatctgggaggagaaggcagatgttaatacattataactatggtgaaatcaggtggatttaattgtgagaagaaaataagaaagaccagaaaatgatgtggggagacagggccaatttagattgaatagtcaaggaagtctcctttgaactgagatccaatgacaagatgccagccattacaagattgtgagtcctattctctaggcaaaagaaagagccaaatgttccaagggagagagctgatctcggtgtgtctgaaaaatggagagaaggcacattagagtggagcatggagaactggaggaaggaagtggagaagaggctagagcacatgcaaagtacaccacatagggccttgt

SEQ ID NO: 7525 - DNA, 862 bp, mus musculus; identical to SEQ ID NO: 7524

SEQ ID NO: 7526 - DNA, 982 bp, mus musculus
ttcacttacagggaaagaaaaggaacagtgccttctttacctatgccctgcatagcaggtaacaattacctaaaattcattgtggaggattggaatatccaagagttttagaaacagttatgctcagacacctctgtgtgaccctaggcaaagtgactaagctctccaacgtattgtcctttatacacaataattaaaaagagtcctcaaaacattatctctaagataagatatgaaggtagttatggtttttcccaaactattttgacttgttctttgtcagtagcatgaggctatattaagatacaactttaaatagtgcttcataaacagtggatggccatggaatcgaattagtggcttgtgattggcatttgaataaaatagaatagaaaaaaataaaggatgtaagttacatcaaatgcagcaaggattagtattgctttgtgaaactttgtatatttgtactgtgtatatgaaattgtgctgtaaaatgtatttcttaccgtgtgtaaaagttttccaaaaatgtttaaaagatgtcagcctacagaattggaccatctagtacaacatgaaaaccccctaaaaaataccactcaaagatagagagcacagactggcattcagcaccactagaaagaagcagtgcagtgatgatcttcagggtctgtgattgctttgggcagtcttcttgctgtcatgttgcagtaagtaaggtatctgagctgcagtcatcatgtgggtgtaataagtaaaaactcacacatgcccattcagttgggcacttgtgggaaaaaagcaaatagaatagtgtatccttatttagtatatgtaagagctgtgtttaggtatctttcctcagaattcatggtactatgatgactgcagagaaaattctctatatgtttcctctacaaacttttacacttgctctttggcatttttttgtcagcaacaagatggcaactgtatgctaata

SEQ ID NO: 7527 - DNA, 982 bp, mus musculus; identical to SEQ ID NO: 7526

SEQ ID NO: 7528 - DNA, 130 bp, mus musculus
tcattctttattttaaaattaaggcccaaagaagttagattgcctgcctaaggtcacacagctagctattttgagaaagtttctcatatcctagctacatttctgaaataaaaggaaatagtaatatcaa

SEQ ID NO: 7529 - DNA, 1073 bp, mus musculus
taaaggaatctatacagaagacaaaattgcataaaagtataacaaaacatggaaaggggtgaaattgggataaagtctgtagcattaacagtattgtaccaatatcagtttcctggtttcatataaactccagttacataagatattaccaatggggaaaactgggagaaagttaaatggtatgtcctgtttttgccacttcttttgactctaaattgtcatgccattgcactccagtcagggtgacaaagggagaccctgtctcgaaaacaaacaaaagattaaaatgtcatagaaacacattctgtgtaaaaataagtgcatataaaacaaacaaactggatcaccattatggttgctgtgaattacagatgtcaatgattctataatgcgtcagtcattttgctagtttttgcagtttatatggtttaatttgtggaatactctttaaaaacagaagttcaaagcaaataaatttatgtggagataaaaaggaatacaatatttttaaaaattaattgttaaatattttattttagccccaaaggacccacctaacaacatgacatttcagaagataccagatgaagttacaaaatttcaattaacgttccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtaagaatccgtagcttcagttaattacccaaatgacaatgtcagtttatgaacttggcatttaaaaatattgcagtttgtgtacacatgacatttcccatatctttttgtgagattgtttgacatctcaacaaaaataaattttgagaactgaaattacctattttctgctataatacaagtactattaaattaaaatatgtaaataaccaagaagtttgcacaataatagtagaaactcagacataaaagagaaagaaaatgcacattaaaagtaaaagaacagtga

SEQ ID NO: 7530 - DNA, 998 bp, mus musculus
tacaattggaagagatttttaaatcccaggggccaaagttaccccctcattcttccgaattgaaatgtgcaaccttaaagaaatatctatgcttctctcactgtgcctttccaaacggattgaacattttaagactagttcttgaaaatagctaatacagaataattatttgttttgtacagaataaatattatgcattttaaatgcttaagaaaagacatcccatatgtttttgaagtcctccatattttggaataagccaaatagaaaattattattatattagcattaatgtttcaatgtgaattttccctatgtattggatttaattttgagcaaaagttgtaaatgttgattcagtagtgttgttttggcttacagggtattgatgtttcttgtggataatttccaggactgtcataatgatctgtacttccatgtacacccctgtgttttgaatcctctgttttatgagtgctgagatatcatctcatgatcccgaacagctgaacagtaaccccctgacactgcagggattacttggcctttatacaacacacagtagctcttcagggacacttagggctatttaatttgcattgtgatcttcagtttgagaaccttaaaagaaaaattaaaagtgcaattgcacacatgaaattacagagtaccattctagcaaacctacatttgtaaactttaaaacacaagttttaccccctgtattgtatattcaaatatatagtaaatgtatcagagtatttgcccattagatatagtcaacctaatattaacaattctgaagagtttcttcagcaaaaatgtatcaaaagagtaataaaaacactgtgcgtgtttcaagcttgtaaaccaatgatgtgctgctgtggtgccaacagagacttccaaatggattatgttaaatggccgtcatttcatttcccaaggttgattttgagcagtatacttggtggaactgaaaacaaagaaattaacca

SEQ ID NO: 7531 - DNA, 532 bp, mus musculus
tttcaatagccactggataaaaaaaaaatattacaacaccagcctctgcatctttaagaaaacattttttttctctttcaattacattatgtttactgtttaaggagacagaaatgggtttgacatattatttaaaagatctcatcaaaacttattagactgaaaaggtagggtaaggcagtttcagaagaaagctggaacaagatatcccacagggctgaagcaggtggtagagatgcagaggcagatctggattcagttgccaatgtgcacatgcatggaggcagacagcaggtccagagagtacagtaatgagcaacagatggtgaacccagctaggacacatgagagtagactagcaagaggtagcatatcataacaggcaggtgaagcaaggctaaagagaatccaggaactggcactaggcaggtccaagtggcagggaagcaggtcagcagggagcaagattctactcgccagctagactcagtggtggctcacttcctcagggtgatatgcaaagtagagaccc

SEQ ID NO: 7532 - DNA, 630 bp, mus musculus
tctatcatcctcattttcctcctaatgtaccatcctgagacaatctatttcaataaatttgagagggcttgaattgtgtggagatttctgcatcacagtgaatttgactcaatataatgtatttgtattgagtgctcaacagatacaactatgagtaaagtacagtccttctagtctagtgagattgaactaggtatgaacataggtgatgcaagatagaaggtgatcctttagttgggaagataggtgactacacacaatggagacaaagaaattagttttcaggctgtttaattagtttgggactttacataggacagcatgcttaacagggaggaatcagatttggttcaaagttaggagtctaagactttgagaacatatgagggtgcttttgaatattcactgaaatagaatcagaaggatggttggaggctagggaaactaaaagtctttgacatactcatcatgatgtgtcttcaggacatttaacatgaagatgcccagtcaagagttggtgatgagagtctgagcccaagagttacacatatggggttggagatagacccttgtaggtcactggggtacaggactggtgattaaattgtgtgcgtgagtgggctttgcaaa

SEQ ID NO: 7533 - DNA, 2421 bp, mus musculus
tgtatatatgcttttctttgtcccagccataacaatttaacctttagaaataatggactttcagctagtaggagagtaaactctatgtgaattaaaggctagtagtgttaaaaccataaatgatgaaatagccatctttaaaaaggaaagaaaactttttgatgaccagattcagcttagtaaacaggatggtttgggggaaaaaaaaaaaaaagaaataagagattggtacctctcagtcatcatagaagaaaagaacctctggaataataggtaatgagaaggagtacacagtctttgaaagagatggggttgataaattatcttcaggatggggtgtacttgttcctggaactatcagaaaaaaacgtaaaatgtgtattcatattatattttattaatgttaattgtgatttttatatgtgataaaattacattcattttggatgcatttctcaaaatattttattgataagggcaaacaaacaaaaagtttggtggctactattataaaagcatggcttaatatgaacgtgatagaatttctgtttgtcataaacaaaggtgtgatgagaccacttggctaaagtaagctgaaataaaagtgtcccataggccaggtgtggtggttcacacctgtaatcccagcactttgggaggccgaggcgggtggatcatgaggtctgcagatcaagcgagaccatcctggctaacacggtgaaaccctgtctctattaaaaatacaaaaaattagctgggcttggtggcgggtgcctgtagtcccagctacttgggaggctgaggcaggagaatggcgtgaaccctggaggcagagcttgcagtgagccgagatcgcgccactgcactccagcctaggcaacacagccagactctgtctcaaagtgaggctctgaaaatttgctccaggaatagcaactaagtagttacttcaattatacataaaattgaacagcagcccttgagaacaaaagtggaggaaagatttacgactgttttctggaatagagttttatccctcgagtattattataatctcctataggcagtgtggtacatttgattgattttacatagataaaataaatttttactttttagcactcctgtgtatctactgcagacttttctgaatgccatttgttttgcttaaaatcatttgtacaaataagagtcacttgcataagtaaaaatcacgtctgttagtaattatcgtgctcattattaacttccattttggttttgttgttgattttaactattgtccatgtggcttaactcgaatccctatttagaaattcacaagcccagtgataaagaaaatttactttagttttctaataataaatcacttatcaatagtgattcttttaagagagtaattagaaaagagtcaactttaacttcttaataaaattgatatttcaaaatgaaattacgaaaaaatcagaagacacttgcagtttgagttgttgattctctatagtaagagcaattggtataagaaatcactgtaagtaaagcatcatgtattgatgataagaagatatatttagaaacctgataaaatacatttagaaaaattcatactattagcagctttaggataagaactaggtgacttttgaatgttggaggcaataactgaagaagatagtttttaaaaaaagagcaaattttcatgaaaaagtttaaaaaattattaagagccgaataatcaggaaccagagcaaaagtcctgcgtatgactaaatgagcaaggagctggagaaacgtttatctgatgcatcagatttaacttttttttttttttttttttttttttttttttttttttttttttttttttagacagggtctcactctgttgcccaggctggagtgcagtggcacgatcaaggcttactgcaccctccacctcttagcctcaggtgatcctcaagcctcagccttacgagtagctgggactacagttgcatgccaccatgcccagccaattttttttgtattctttatagagatggagttttgccatgttgcccaggctggtctttaactccaggggtcaaacagtctgcccaactcggcctcccaaagcactgagatttcaggcatgagccacctcacccagcaacgtttcagattttaaattaaatttaaaatgtatttacaagtgtcccttaacattcaaatctatttgttttctgagttcatattgccatcttgaagagtaagggtgctatattatgataatctgcttggttcttgagtttctccttgttacagtgacagtttagatataaaatcttatccaaacatttttttctgaattaattcaattcccaaattcagaacggataattaagagaagagatttagattgtgaatgatatcttgatatat

SEQ ID NO: 7534 - DNA, 2421 bp, mus musculus; identical to SEQ ID NO: 7533

SEQ ID NO: 7535 - DNA, 2421 bp, mus musculus; identical to SEQ ID NO: 7533

SEQ ID NO: 7536 - DNA, 2421 bp, mus musculus; identical to SEQ ID NO: 7533

SEQ ID NO: 7537 - DNA, 2421 bp, mus musculus; identical to SEQ ID NO: 7533

SEQ ID NO: 7538 - DNA, 671 bp, mus musculus
gaagccttgaattgaatccttcacttcttaaacatccaaaattctctcccccaacaatactctcagctgatatcctggcttcttgattttccaaaaatgtgcacagactcccatcaccacaattaccagcatgtaaacccacatgctctgcctttccatctgttattaaagatagtaccattcttcaccaaatccagtctcttctcttgtagattctttctcttctcatctactcaaggacatggctctagtgattatccacttttcatcctacatcatcagtttttcatcctctcctggagcctctccctcagcacaacatgctcttattcctattcctcctttctttgccaggggctgcccatttctttgcttccctttgaaacaatgtgctaaaaaagtgttgcataagaatatggattccaatttctctcctcccatttatttttaaatttagttcaatcaggctttttttcttaaccctccaataaagccagattacattgttgaatctgatggtcagttctcagtcctcatcttagttgacctctgagaaatattcaggttaattactggattaacgtgagcaatttagttcacactgctcttttggtcttcctccaatgttagcaattgctcctacagatttttctttgctggtctcccagggc

SEQ ID NO: 7539 - DNA, 671 bp, mus musculus; identical to SEQ ID NO: 7538

SEQ ID NO: 7540 - DNA, 671 bp, mus musculus; identical to SEQ ID NO: 7538

SEQ ID NO: 7541 - DNA, 384 bp, mus musculus
aaaatactatgtgaatgccttgaagccctagatgaatatgttattatcactaatttatggtgctgtgagttttcccccaaataatagaagggaagagtatatacatgttttcatcttccatggctcattatctcatccatataccatgttaaaaatataccaatttgagcttagaagtatgtttactggaaaagagattgaattgacatttaccacaaaatttctataaaagaagtggaacaacagcaatgaaaattaatcttgacaacttaggaactggtaagagctattcaaactatatatgcaaaaattttcaaatatttgttgctggcaaaaaagcccattcttcaaaacaatgtaatacagtaatacacatgaaaggca

SEQ ID NO: 7542 - DNA, 314 bp, mus musculus
atatattaagcctaaatttgacgagttaatgaaaattataatggacctgggcatgagtatggtcaaaccccactttgctgctagagagttccaagaacctcattccaaacactttaccttctatatttaattttcctaatctataaaatgagcatttctacctagctgatttcttttattccctctagttttcagattatttgattcttatcaagggaacataaaatgtctattttcaaattatatatttgaatcctagagaattagcattttgagtttaaaatcaaccaagtatgaataacaactagcaaact

SEQ ID NO: 7543 - DNA, 155 bp, mus musculus
ggtttaaaaattgttcctttgctttaaatttagaggtacttcatctgaaaaggtgtctagaggttgaagaaaaacgtgttgagcacatcgtttgaacatataacatactgtttaagcttacttaaacaaatattctatatatgatattccgtcat

SEQ ID NO: 7544 - DNA, 720 bp, mus musculus
ccatattctgctctgtgctttcctctatcccaagatgtattgttccatagctaacttttcatttcattctatttttctatacatgttttactaagggaggagaccacccctcatattgtcttatgcccaatttctgcctccaaagaaagaagaagtaaaaactaaaaggcagaaatgaaatccgcaggcagacagcccggtgccacaccctgggcctagtagttaaagatcgacccctgacctaattggctatgttatctatagattacagacatggtatagaaaagcactgtgaaaacccctgtcctgttctgttccattttaattactggtgcatgcagcccgcagtcacgtaccccctgcttgttcaatcaatcatgaccctctcacacggaccccttagagttgtgggcccttaaaagggacaggaattgctcactcagggagctcggtttttgagccgtgagtcttgccgatgctcccggctgaataaagcccttccttctttaactctgtgtctgaggggttttgtctgcagctcatcctgctacattacctcttcacagaatgcttctatttcacagagggcttctgaatcccttctcatgtttgacttagtttcctttgtcctttcatggtacttgctctagtagtcatttcaaatgctgtttattcttctacatggcctggttcgtagatttaatatagatcaattaagca

SEQ ID NO: 7545 - DNA, 200 bp, mus musculus
ttttctttaagattttcagtttatccttgagtcttcactatcaaaagatgaatttttggtctcgatcagataacattggcttgctcaaatttcttcttatcttctccacactaaactatacttttacaaatttttacttttattattcctgtcaaagaaaatggtctcttcatccacatcagttttttatgtctttgccc

SEQ ID NO: 7546 - DNA, 412 bp, mus musculus
atgttggatacttctctaaatacaaaaaaagtattgtatatgtagctataatcattaatttttgcaaattattatttagtaaaattaagtaacaccaataaataatgttttgttctaaaatcttgatttctgcctaattattctgattgttcagaaaattttaaatggtaagtttagggcagtatgaaaaactaaggtgtacaatagcatattttaataaattcatccatgtaagtctgaatatatctcagtattgatggtaagtattgtagaattgcttcttttggaagatgtttaaggataatctaaataattcactaataatgcaattaatttattctcaaaagccactaaattgtgggctaaagaaccctcaatgatggtcgtaatcttttacaattctaagatcagg

SEQ ID NO: 7547 - DNA, 1954 bp, mus musculus
ctgtacaatcagggtggggggcgacaggctgcacatgtaaggggaagcacatgggttgaaacgtgccgccatcctttcttcccgtcgtggaaattgcccacagcatccccagagacctactcgtttccaagccaagtcggggttggttgaagggtggggtccaacacgggaaagtccaagaggaaagttgggagggttggggcagagagagacgcgaggtgaattggaagctaaacctcgtgcaggtgggcgatggggcggggagagcagagagctttattcctcattcgcttccgttcgctttagcaaaggcagaaggcgactaccgaggacagagtgttttcacgtgaccacagttcccctttgcttgaggtatcctgtgataaatggcccgaaagggggcctttcgccgtacgaaaggcacgtggctgctggagaaatcacggctcctgtgtttctgcgcatcctggaatttgagagtgtggcggtgagggtggtgctgctgggactgtaagaagatgggaagcagttagaaacccagatcgtttctacctttctttcactaggctggtctgtgtgtgactgggaagaagacggtattgagtacagggaaatccttgcactctaacgtagcgcaccaactggatacataagaatgaatcaagacgcccgaggcgttcgggaacaggcatgacccacccagtggcacaggctgcgggaacgggaattatttttcctgagctgagaagcagcctttgatgtgcgttttaggaagcaaagcccccaggctcgcgctctccagcgtcccgctttccctttccatcctcctccctagctgggaaaggctggagtaagacggggcggggtccggactccggcgcagtgacgtaagcagtgtttgggtgcttatgcaaataagtctgcgacggtttcttctggtcttgccgttttcccctccagatcttataggtagacccaatcttagtctgcaccatccttgcggttcactacttaagacgtatgggagaaatgaaggatttgctttatatgctgctttggggctcctcatcgcccatgctgtaaaagctattttctacctgtcaatgcctgattgcttttctgctgtgccagcaacaaagtgtttgttttgaggaattattatgtgcagacacagccccaacaagcccctcacccacccaacctcatttctgcaagatcattgctgaaacacagacctatttatgtcttaggcgcccagtactgggcttgacttgtacgttcttaataaatacttaatgatggactaaatcttctttgaacagtgttaggttttgaagggaaggcgagggttaaagacacacacacacacacacacacacacggaaagagggcggctcaacagcaaattcaggctttctgtccagcataaatcctacagaagtggaggaccagcctaatgccggagcccgctgccgcttacaggctggggccatttataggtacgggcagaaggggtctgagcagtatggcttgctgctccgcgggatattaataagatgcttccatgaagaggcggttctggctcttgttccggcgcgatgtcgttctgttgttcagggtgttccttggacctttgtccagcaagatatgatagggatgtctctttagttaggcctttgtccaactcgtggtcagttggttagacgggatgtttctcacagctcgaacccctgtgaaatgtttcgctttcaccaaggtctgcaaaatagcagggagcttacaacatggtgcagtttggactaacaaacagtatgtatttttttctctcatattaaattcaagatatttgaccatcaaaatcaggcgattttatttttatgtgttgttgccttttctatggaatcatcaatgatccatgtgtatttgttgtggtaaaacatatcccaacaaattt

SEQ ID NO: 7548 - DNA, 1954 bp, mus musculus; identical to SEQ ID NO: 7547

SEQ ID NO: 7549 - DNA, 341 bp, mus musculus
ccaagatgatttgctttctggaatgattgtttaacagataaaatgaatgtaaaacactaaagttaaggttattaatataaaagattaatcaccagagctaaagctaaaatttaagatggatttaaaaaatgggacaggcaacacagaaacatactcaaaaagacctaagttggagtatgggtccttctattggtaagacatcctcaggtaatatacataatttttaaagcctcagtttttttttagtaatgactatttcataatattgctgtgaaattatacatgtaggtaaagagttcctagtccaatgtttaacatatattaaatacaactatctttga

SEQ ID NO: 7550 - DNA, 209 bp, mus musculus
tatttgtactcacaagctggtgaggatttcctgattattgtaactagagtgcagatacttgtgaggaaatgacaggaaatgaggaaaggacagtagagaggggcagacagatcatacagaaccctgcggacagtactataaaactgaatcttatcctgaaggaatagtaagccatcaaacacttttaagccaaatagtggcatgatcat

SEQ ID NO: 7551 - DNA, 988 bp, mus musculus
gttctgtttaatacttatgagtagctatatatgatgtttaatgaacaaaaccttcatttgagtagctatatatgctgtttaatgaacaaacctttctcttcaatggaaaaaaaaggtatatagctttgtttctgtttcaaagatatttttattatataaaaatataatgggatatgggaaaaatttgtcccttgagcaattaccaattagcaagtactaaataatgatctaaataatttatataatatatttctctttttaataactttaagaagcctttgagaaagatcacaagttagacaacattgttcagggaaggtaaataacttgctccttgtcatggtgcataaaatatacagtcaataattgaacagaagaatctctgacttacactctatgctctgatccaattctaatagtggagctattctagagaaagtaagtgcagataataactaactctgcttcatttcctatggaaacacaccttactatgaaaataatttgatttggaggtttctttctattaggaaattggcacattgtaaattattcaatgttaactttgataaatttaaaaataaaaggtagtaggcttctggctatttctgcctatcagggtatggctgtgcctgcatcatattctaattttaaaaggccctaagtaaccacatagctattaaacagggtacattgagaaacgagtttagaattaagacagtactttaagggacagatgtgcttactttcagtgggagcaaggggttgaaacaataaaaggtgggtgggagccagctgtggacaacaagcgtttttacaagggcatgtttctcttttgtctctgtgtttttaattctcttaccacctaattctctgcaaacatattaataagtatttgatataaatttttatttgatactccaacttgtccttccattttttgagcagatttaattttaatataccctaatgcaataaagcctattta

SEQ ID NO: 7552 - DNA, 1309 bp, mus musculus
attttatgttaaatgacaataataataatattgcttcatagatgtcaaaatatttaatatttaatagtgttttatttaatgcaccctgtctgtatgatgtgaaatatgtgaaatccataaagttttgatacaaatagaaactttttttagtcttaaaacattcattaactaagtaatataataaaattaagaataatttacattcaagcaaacagtacaggcaaagaaagagttgcaaaacaaatctcagaaaacagctgattttctaattctacttgcatctcttttgtgtctgtgctcaaaaagcccatattattctgatgttcgtgcagattactttctgcccattctacatctttcttcctccactatacaacaaaatgaataggtgatggctctcagcacttgacactggtgggaaagattagcaggaatgttgactatgacatatcagatatattaagcccttgctggagggatgcagtgcagaaaaaaacttgtttgtcacagtaacccagatactctatgttttttttccaaaataaaatacaacaatttcagaagagtatattgaaatggaaactaattgccagtacaattgaattttaaattattccacaatatctttattgaattgtgtcacattagccagaatattgacccatgttatgttataaaaaggaaatagaaattttatgattctttttaaattgagagttagcataggcatgaaaattgattttaaaatgtcatttatttgacacagaagttgcatgttggccataagatttagtctacagcacattcttacaaccagagattttggtttgcttgtgtttttataagctgtagcaagctttaagatgtcaagggttgaaaaatgatatttttccaaatgcatgactgtttcagtgatactgatgttcttttaactgatctgtgagtaaattttgaaaataaattggtttctcataagttatatttttaataattaaggcaacaatccaggacttcttatagttccaaggttttgaacagcggctatatatctgctgacagaattttgtacttcagttaatcttgtgtttaagctagggtgagagaaggagtaaagaaggataggaatggttgaagggcagatttgagtaaaaaggttttgggatggttgaatatttcatattaatgctatctccatttttttagagttgtgggtcccccttgattttcatcattctgtcaatctgtatcattctgtcttatctttggataaaactccatttctaagcctcaattcaaggaaaacatattt

SEQ ID NO: 7553 - DNA, 518 bp, mus musculus
ccaccttattaattttcaatgtctaaataaacaaataagccttacaagttaaaggtacataatcaaatatgtgaaaataatgttgtttaaatacaatacagaaaacaattttgtaaactgttttgcttgtttacttttaaatatgtagtctaaaactatggaggagttaaataaattctactgttcatgatagttctttattatatttagtattctaaagggagatcctattcaaaagtaccatctcaggattagaagagtccttagatgacatgaaaatctcaggcagttgggtaggaataagaggaagatgaatcattgtgcacaagcaaaactattcttgcatgaaatttctgaaatctttgggggtgctttctatgagtagtgtcagagactgattctgcgtagtcattttgtattctgagttaaaagtaaattttattttgcttcttgacaattatataaaacaattttcaagcattacttacacttcagataactaaaatgccaccaaacaa

SEQ ID NO: 7554 - DNA, 1085 bp, mus musculus
agcactttcttttgtgtctctgtaaatgcattaattaatccattcaaaatgcattaattaatccattccacaatagctatcagatactgttctaggaactgaaaacactatagtaatcaaaacaaagtctctcatggaatgcacattttatcagaaagaacttaagcatcaagtaaatgaatatataaacatatcatatgtcaggtaatataagtgctatgaaaacgagtaaagtgagttagggtgttttgttgttagagtgagtagtggaagctctttcttttaggtcaagagatcagggaaagtgcttgtgataaggtattaatatttggtcagagagctgatgatgggaagagtcaagccatatgactatttctgggaggatattttagcaaagggaagagtatttgtaaagaccctgagataagtgtgtgattaattgattccagaaagagccagggccactttgtctgggatttactcgtaaatgaagggtgggaaaagctcaaagcaggacataatgataaacctgtgtccttatgcattggattctctccataaaagtgagatttaagttggctataggtgctcattgacaggtctggcttcgagagttagctggctatctcttcaagggaaagaaagaaatgtagctgatagtcttctctccacatcttacaaatcaattgccaatgattatgggttgtaataggaatttttttacaagaacaatacaatggaaatacaagatctgccatttaatcaaatccattttgtaatgcaacttactttctagttcttgttcaagtgtttattaaaatttaatacaactttcacttaacattatacaatatttattttttcttttttttttcctccatgtttcccagctcctctccaacctgaatctcaacatcaggtaacctatagcttagtgtaaatctttacatatgtttctccatgttacacaaatacaaacatacatataaaaaagtattaattttctgttttaagtcatttatttgtagaaagatagcattacagggcatctaatattttggtaagaatttttcttcattgacatt

SEQ ID NO: 7555 - DNA, 492 bp, mus musculus
actttcaattgtttttgaagagtagtagcttaatgttatcaaaaacctacgcatgaaaaaccagaacttaagcttccaaaatgtgtgaatacttggtgagattcttatcatcacacataggataaatgcttgaggggatggataccacattttttgtaatgtgattattactcactgcatgcctgtatcaaaacatttcaagtaccccataaatatatgtacctactatgtacccataaaacattaaaaatgaaaagattattaaaaatttaactatttaaaaagacgaaggaacgagaaaaagttccactgtaaaaacaatatagaaaaaattgtttgtgactcttagtatctaataccatgcagtatgcaaaatcgatacttcacacttaattattctcaggtctggagagatttgaaataatttagtctaattgccataaaaggtaactattgcatttgagtagtaagtctgaagattcagacaataac

SEQ ID NO: 7556 - DNA, 150 bp, mus musculus
tgggcaaaccacttgcttatcaaaataatttactcatcaaatgctcacttcgttgtgtccaccaatcctaaatatctctatcatggactccagccaatcctaaccaaatctctctatcaatcaacttcggcctaataccagatcccaaaa

SEQ ID NO: 7557 - DNA, 407 bp, mus musculus
ttttgcagtgttgtaatattataggatgcatgtctgaattattctaataataaacagaaatggatgacctgcttgcctttcaaacagtccttcataaatatcacttctctgaagtagatgtttcataaagttttgatagtttgaactctagcaagagtctgaggtacacataacatttgtctgtgtcttctgtttaataagatgatatataaaatgtttattgtttagtgttttacttatgtaaataattctgtactttaaaagttttatttgtaatcttttttttaatcctttatacaggtttgataacccagctgctgtaagcccaactcctacaaggcaactaacttttaactacctccttcctgtgaatgcttggttgttattaaatccttcagagctctgct

SEQ ID NO: 7558 - DNA, 269 bp, mus musculus
atctttagtgtcttgatctgtaaaatggtactaataagacccattttcaggattcttgtgaagtttaagtgaaaaaatgtacataaagtgcttagcatagtaccttgtaaattataagcacttaatagctaatatttatttttgtttgttattattatacattaaatattaatttgctggatttaaaacaccacaaaatataccctaggataatgctgaatataatttgatttttaaagagttcagaactacttcagactctgcctatt

SEQ ID NO: 7559 - DNA, 940 bp, mus musculus
acagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaata

SEQ ID NO: 7560 - DNA, 1174 bp, mus musculus
ttttttttttttcaattgttacgcattctgactttttgtagttgttgttgttttggtttgtttttttcaacttttattttagattcagtgagtacatgtgcaggcttattacctgggtatactgccagatgctgaggtttggagtatgaaagatcccgtcgtgcaagtattgaacagagtatccaacaggcattctgactttgatctatcagcattacactgaaattctagtataacagaagaaatctaccaatcctggtactaatccacaatatccttaccaaagctgtgacggttttaaaattaatgcttatgtcctagaatataataaacagaatgtatactgagcagcaaactttggcttaacaatcaaaaaaattaataataaatgcaaaacgtaaactatcagttaaggaagtacaagtaatcattcgcctggttaatgctggtctgatctaaatgtaaagagaaaaggaaaaatgatacactatacaaaagacacatgcccacatacaacagaagaaccttcttggaacctgatcacagggaaagaagtataacagttcaggccttatacattaaaaaaaaaaaaaaggggtgggggggctcagacctcatcaactgacttggaataggaactgctaggatcatctgaaaggaattaaaatttaaaatcattatacattatatcaggttaaaccatatgacactgccatttttgtggatgaaaaccaggagaatatcagcaatttcatagagctcaacctaataaaatggattgagcagaacattcaaaatgggcaacctaaaaagagcaaaatggagcccaggactcaagatctgacattaggtagactgaatgagtcagtttaactcaatgggagaaaaaaagcatttaacagtcagaaatgggttggtcaaacatcgtcttctaaggacgatcattagaagaggaaaagaaaatctggcctttctcattcaagcagtatttagaaggaagagttttctacgttcacaatgaggttacagtagtatttgtatcctaactgagggattaaaatgttgactacttaccagagttaagaggaggacacctgtgccagacactgtgtttagcaatttgcagtatacactctacatggatcctttcgcctaatcttcccaatgccctatg

SEQ ID NO: 7561 - DNA, 753 bp, mus musculus
aagcaatggagatgctagtatgagtagtgggtccagaaattaagctaaaggctggtcttaatacatgcatacaatatatgtgactcttggatttcaggtgctcactaccattgtgagtggaaatagtggctacagttaaaggcccagggccacagttggcagagtacaagtatgagatcatggatattattagaaattaaaactagagggttgagtaaatagggttccctaggtggatggcctcagactattcctatcaagtttttgcactgttcttggtagaactagccagggtaaacaagattgaacttatagtcattctctctcttcaaaaatatttagccatttgcccaactagctttctcccttccctttagaagaccatctcttattcctctgagatattcaaaaattttatttcctattaactttagtgtgacagttttcttgtgtagcatgtttagttttccacatctgtctaacttatatttgtaggcactaaacctcctttaattctttgaattgaatctagaactctcagttctcagcagataataagagcaagcaagcccactgagctctacaagatgaaaatttgaccattgagcaagaaatctctgtcattttttccagccaaataacttgatagcacttgatacactggtactagaaatatttctgttggtttagcaaatgcagaatgagaaaggaacaataatagtaccaagatttatggtttaccttcttgtgaac

SEQ ID NO: 7562 - DNA, 1549 bp, mus musculus
aatcctcttttaatcaatagaatatggcaaaagtgaaaggattttccagatatgattaaatctctaatctattgtctttaagttaatcaaatggagattatcctgcataggtctaacctatttggatgaatgaccttgaagaagcaagcaaccatgaattctacagttgcaaggaaataaattctgtcagaagcatcttggaagaatacctgagctccttaaatcagtgaagcttagccttaatttagccctgtgtaaccctcaacagagaaccctcttaagctgtgtctgaaatcttgattcatgaaaaacataagataataaatatatgctgttttatgccatttaacgtgtggtaatttattaaatagcagtaaaaaactaatacagggtctttcctgaagttgtagtcaaggcatcagctcagaccaaagacatctgaaatcttgaccaggttgatggactctcttccaaaacagcctacttaatgtgactattggctcaaggcctcagttccgtgccatgtgaacctctcccttgggcttcttgagtgtcctcagtacataaaagtaagtttctacctttccataactgcctcatttacactgtgacatggtagcatggtatcctccaaagtgagtgatgagggttggggaggagaaagaaaggttgaatatgtgcaacatagaactcacaattgctttataaactatcttggaagtaatgtcttatccttctaaagttaaatttgccagaaatgaatcactaagtctatcctacactaagggagggggtacaaagctccaattgtcaaggagaaatatcaaagaatccatggatatatcttaaaaactattgtaggaaaggttgatatttgagtctgtaaaataaaatgactatagacagattaaaagagaaaaggcatacgaatttattgcatgcacatgtgtgcacacaggagtcacaaaaaatatgaaactcaaagaagagccagatgactgaaattttagtttcatagagaaaggaaaagagggttgaagcatggtgacaggttatggaaaggggaggggaggaaaggcatggtgagcaaaggctttgttgtgatgcagatgaagcttcatgggtagcagtcctgaggaagaatagatgggagcccatagtaaaatgttctctgtcaaacttccaaaagtttcagacttttagtctccttttctgttaatcacttcctagattcatataaggcaaataagggtggggggtggggtcagataaagcctatttgcgtctgctgtttatttcactaatgtagatttcctttacagatgcaaatctcttccacaaaaggacagcttttcatagctattcctgtgtctgcaacccctctaaatagccatctcaaaatataccaaagaaacatattttgctgtggcatattttggtttccttcaccactaaactaatatttagattttggctctttaaatttcatacaggtcttggagtagtagccattttagcactatattttaattctaaaattagtaagatt

SEQ ID NO: 7563 - DNA, 406 bp, mus musculus
gactttgtccaggctcagagaggttggagaaagcactccaagaactgggaagagtaagtgcaaaaacaaaaaatgtcctttcctatagacttgattaactacacaatgcttgtaagaaaggcatccatgtgtggtgtttgctttcatttctgctttctgttgcaggttgggattgagtttcaacagcatctctgctgttgacaatggctctctggccaacacgcctcatctgagggagcttcacttggacaacaacaagcttaccagagtacctggtgggctggcagagcataagtacatccaggtaatgcaaagccactgcttatgtgaggaatatccaaaaagcaagacccccaccctgcttatgggatgctgggaagcaggaagctcttcttagaagtttttt

SEQ ID NO: 7564 - DNA, 406 bp, mus musculus; identical to SEQ ID NO: 7563

SEQ ID NO: 7565 - DNA, 406 bp, mus musculus; identical to SEQ ID NO: 7563

SEQ ID NO: 7566 - DNA, 254 bp, mus musculus
ggatggattgcattagccttatgcaattagtatgaatgtactagaagatgatggcatcactcgaactgaaatccaatttgtgaacataccgtctgactcctgatacttctgcgaaataatattaagtgaagaaagataaaatgctaagaggggagttctaaaattgtttggattagtggcattagatttctcttccagatcccttattcctatatctgtcctacaaattctaacacagggtgaaaggttggaga

SEQ ID NO: 7567 - DNA, 7665 bp, mus musculus
gagagtcaagactctttagagaagtatgcaaatcaaaaatttacctcctctttaaacctttttaattcttcaattaatctcaacaatgacccagtttttagaacactgaatatgcgtggccacctaatcacattatctcacttctcttcagcaaactttgaagtgggaaagatacatgtataaatgaaaacattgataaagcacagctgcctgtcacatttccagtcttctcgggaaaacaagtgatttacagcatgatgagatcaaatcttcctctacggcatgccattgcctatattttaaaactcagttaggggaactcatgcaatagcccaggctgatgacattaacgtcagatctttgagcaaatctagttaacgtaaaagcaagagagaaagatgatctcattttggaaacaacaataaaaatgatgctgttcagtaagaattgagaccatgagggtttaatgctgtatctttgagcttgtcttttattagccaactttccactataaaatacattaaaaattcatttatggagaatatagctcagaactgttataaagtggatgttttgttaaagaaaaaagatctgggtggggtggctggcaagatggccaaataggaacaactcccgtctgcagctcccagcaagatcaacacagaaggtgggtgatttctgcatttccaacttaggtacatggctcatctcattgggactggttagatagtggatgcagcccacggagggcgagccaaagcacagtggggcatcacctcacctaggaagcacaaggggtcagagaactgcctcccctaaccaaggaaagttgtgagggactgtgccatgaggaacggtgtgttccatccccagaaactaggtttttccatggtctttgcaacccacagaccaggagattccctcggtgcctgtatcactagggccctgggtttcaagcacaaaattgggtggcagtttgggcagacacgaagctgctccaggagttttttttgtaccccagtggcgcctggaatgccagtgagacagaaccgttctctcccatggaaaggggagtgaagccagagaaccaagtggtttagctcagtggatcacacccccatagagcccagcaagctaagatccagtggcttgaaatgctcgctgccagcacagcagtctgaagttgatctgggactgtccagcttgctgggaggaggggcatccgccattactgaagcttgagtaggcaatattcccctcacagtgtaaacaaagctcctgggaagtttgaactgggcagagcctgctacagcttggcaaagccgctgtagccagactgcctctctggattcttcctctctggacagggcatttctgaaagaaaggcagaagccccagtcaggggcttatagataatactcccatctccctgggacagagcacctgggggaaggggcggttgtgggcacagcttcagcagacttaaacgttcctgcctgccacccctgaagagagcagtggatctcccagcacagcattcaagctctgctaagggacagatggcctcctcaagtaggtccctgacccccatgcctcctgactgggagacacctcccaacaggtgtgaacagacaccttacacaagagagctctggctggcatctggcaggtgcccctctgggacaaagcttccagtggaaggaacacacagcaatctttgctgttctgcagcctccgctggtgatacccaggcaaacagggcctggagtggacctctaacagactccagcagacctgcagcagaggggcctgactcttagaaggaaaactaacaaacagaaaggaacagcaacaacatcaacaaaaaggatgtccacacaaaaaccccatactaaggtcaccagcttcaaagaccaaaggtagataaatccacaaagataaggaaaaaccagcgcaaaaaggctgaaaattccaaaaactagaacatctcttctcctccaaaagatcacaacttcttgccacctagggaacaaaactggacagagaatgagttcgatgaattgacagaagtaggcttcaaaaggtgggtaataacaaactcctccgagctaaaggagcatgttctaacccaatgcaaggaagctaagaatcttgaaaaaaggttagaggaattgttaactagaataacctgtttagagaagaacataaatgacctgatggagctgaataacacaacacaagaacttcatgaagcatacgcaagtatcgatagccaaattgatcaagcacaagaaaggatatcagagattgaagatcaacttaatgaaataaagcatgaagacaagattagagaaaaaagaatgaaaaggaatgaaaaaagcctccaagaaatattggactatgtgaaaagaccaaacctacatttgattagtgtacctgaaagtgacagggagaatagaaccaagttggaaaacactcttcaggatattatacaggagaacttcccccaacctagcaagacaggccaacattcaaattcaggaaatacagagatgaccacaaagatacttctcaaggagagcaaccccaagacacataattgtcaggttcaccaaggttgaaatgaaggaaaaaatgttaagggcagccagagaaaaaggtggagttacccacaaagggaagcccatcagactaacagtagatctctctggagaaaccctacaagccagaagagagtgggggccaatattcaacattcttaaagaaaagagtttttaacccagagtttcctatcagccacactaagcttcataagctaaggaggaataaaattctttatagaaaagcgaatgctgggagatttgtcaccaccagacctgccttacaagagctcctgaaggatgctctaaatatggaaaggaaaaaccagtaccagccactgcaaaaacataacaaattgtaaagacaatcaacactatgaagaaactgcatcaactaacaggcaaaataaccagctagcattataatgacctgatcaaattcacagataacaatattaaccttgaatgtaaatgggctaaatgccccaattaaaagacacagactagcaaattggataaagagtcaagacccatcagtgtgctgtattcaggagacccatctcacgtgcaaagacacatataggctcaaaaataaagggatggaggaatattcaccgagaaaatggaaagcaaaaaaaagcaggcgttgcaatcttagtctctgataaaacagactttaaaccaacaaggataaaaaaagacaaagaagaacattacataatggtaaagggatcaatgcaacaagtggtaactatcctaaatatatatgcacccaatagaggagcatccagattcataaagcaagttcttagagatatacaaagagatttagactcccctacaataatagtgggagtctttaacactccactgtcattagacagatcaacaagacagaaaattaacaaggatatccagggcttgaactcagctttggaccaagcagacctaatagacatctacagaactctccaccccaaatcaacagaatatacatttttctcagcagcacatctcacttattctaaaattgaccacataattggaagtaaaacactccttagcaaatgcaaaagaatggaaatcataacaaacagtctctcagacaacagtgcaatcaaattagaactcaagattaagaaacccactcaaaaccatgcaactatgtggatactgaactacctgcttctgaatgactactgagtaaataaagaaattaaggcagaaataaataagctctttgaaaccagtgagaacaaagacacaaataccagaatctctgggaaacagcaaaagcagcatttagagggaaatttatagcactaaaatgcccacaggagaaagcaggaaagatctaaaattgacaacctaacatcacaattaaaagaactagagaagcaagagcaaacaaattcaagagctggcagaagagaagaaataattaagatcagagcagaactgaaggagacagagacatgaaaaacctttcaaaaaatcaatgaatccaggagctggtttttttaaaagattaacaaaatagaccactagccaaactaataaagaagaaaagtgagacgaatcaaataggcacaataaaaaatgataaatggactatcaccactgatcccacagaaatactaattaccatcagagaatactataaacacctctatggaaataaaatctagaaaatctagaagaaatggagaaattcctggacacatgcaccctcccaagactaaaccaggaaaacagtcaaatccctgaatagaacaataacaagttctgaaattgaggcagtagtagcctaccaaccagaaaaacaaaacaaaacaaaaaaaaacaaaaaacccaagaccagacagattcacagctgaattctaccagaggtataaagagaagctggtaacgtgccttctgaaactattccaaacaatagaaaaagagggactcctccctaactcatttaatgaggccagcatcatcctgatagcaaaacctggcagagacacaacaaaaaaagaaaattgcaggccaatatccctgatgaacattgatgcgaaaatcctcaataaaagaatggcaaaccaaatccagcagcacatcaaaaagcttatccaccatgatcaagttggcttcatctctggaatgcaagactggttcgacatacagaaagaaataaatgtaatccatcaaataaacagaagcaatgacaagaaccacatgattatctcaatagatgcagaaaaggcctttgataaaattcaacaacccttcatgctaaaaccgcttaataaactacgtattgatggaacgtatctcaaaataataagagctatttatgacaaacccatagtcaatatcatactcacaaggggtttattgggaggtcacccatcataagttgtggagcatctgtattgttcagtgccagagactgctccaagctttcctcccttaaactataaaattattataattctatgtaaaaggtgaaaaactaaaaatcaaaaacatttggcaatttgcctagagtagtaagtggcagaatggaaattaactgaatttgggactccctaaatccttaagtaaccattcatatagaaagcatgaaggtctaaaacagaagaataaaaagtaaaaatcaattcatctctctcagtatgacaatcatcatttttagtaaacattttaagcatcagaatcaccactcattgtccatctgtacatttttttcttcttcaaaaatatttttggtttgtgttgtagctgctgcctcactaagtacagtatatttatttcagatcttagaaaactctttttttttctggaataatcaacaacgtgaaaattcttatttaaaatagaattaaagcactctagaagcaagggacacaacaattagtctctatagcaactggatattatacaaggaaaacggtgagcatgaaggagaatttgggaagaggtaagaacaattcatgtgaattgtgaagagtcctacaagaaagccagattgttccctggggtctctttgagggcagggagagagaatgaaaatacagataatgaggatgactcttggcaggtaaatgtttgtaaaagtaatgtcattgtttataaaagtaatgtcataatggaaaggctgcagaggtgaggggttaaatccaggaagggaggtgaatggaaacttgaaatttggaaattttgaatagtttgatcttagcacaaaccatttacaataactttcaatataaaaattgaaacatgatatataagtatatgactatttttcagcatatgctatgcattataatttggaagaaggcctagatctctatgtaatagtagaatctcgcctataactatgtctaacatgagaggcagaaggtttaataaaatatttttaaattgccattagtcctgccttcactcatttagtttcaatgaatgacatttctagtttaaaaaaatagcatatgaaaatttcctccaatgaaataccatatttagtccataatataagataaaatttaaaagatttatgaaacccaattttggcaatgatgcagggaaatgagtactcacatacatcataaattgtcggtaggagtatctttcagcttagcaacacttaaatggtgtatggtttttaactcagcactttcataccagagaaatatttgcacttatgtagtacaaggatccttaaaagaggaaagagagaggcagaagagtgagagtctgagaagaatatgtgactgtgcaagtagatgatgggatcaccgttcactttgaagtatggggcaaggaatgcaggcattctctagaagctggaaaagacaaggaaaggaaaactcccctagagcctccagagggcacagctcattctttattatttcagcccagtgagatctatgttcaatttctgacctcaatattctaagaaaataaatttgtgctgttttaagccttacatttgtggtaatttgttatagcagaaataggaatgttgtgatttttagtgtgcaagagatgtgatgtaatctaattgccaatatatggttggctgctttcctcaaagcatgttaccccatttggggttcagtttcactttctgttcctggaagatcagacctgcactggaagcaatagttaggccagtgctggtgagagggagcccaagctgttgagtcaacgaatagcctctgtctctaccataatgagaacaatattcatgaacctattttgctagcattaagatggctgaggacagaatccagctgacatcagctagtgaagtcattctctccacttggttgcttagtgcctcttctacaatggcattaagaagtagtatagtgatgctaatactttctgttcatttccataagtccatacacatttttcccctccttgaacttctgatttcactcattataggctcttcaacagggagctaagttatttattgctcatgagtttatgtatacccttacttaaggctgcttctctctccacattaagtgaatgaccagatgtactttccaatactctcccagttgataggattttcctccatcactatcttccaggaccatccttgcctggaactttgttgcagaaaaacaaaattccatcttacaaacatattttaagttggccctttcatgagctcagtttgggccttttcttcctctcgcagctgatagctcatgaagccacaggaatgagtcgaaagagtggtgtcatacagttggcataaatacgtgggtcatctttttgtgaagattactgtaatctctagcatgttcaattccaatccttcatgtataatagccatcttatgataaattgctgattagcctacctcaccttgtatcttggttggtcttatagtagtcagtacatgaaggttacttgagtttccatagtcagacatttttttttttatcatggcattgtagcatgtcatgagctgcttttcaaatgatacataagttcttttctgcagatggcaaggcctagttccataatctcagaggtctgtgctgtgattctccta

SEQ ID NO: 7568 - DNA, 356 bp, mus musculus
aaatatttgtctatccatttaagtgacatactgttttgtttaaagtgaggttgatttaaggactcttcaaagtaaaaagggacatttgttgataaaagagaatgactgtcacacaactttgtgtagacattcttgggagatcgcatttatcacacatgatgttcaaatgtactggaaggctgagcctttcacctctactgagaaataggcatttgggaacttagtctctctggctgccatccattgcctgctcacgctaacaaaggcagaaccaatcacatgaaaatacagcagagtgcacctagctgccagcctactaacaggaggtgcctctctttgagtcattgcttccagcc

SEQ ID NO: 7569 - DNA, 1015 bp, mus musculus
aatccaggaatggctaactctaaaacaagtataaaatgggatatagtgaaaaaatcattagattggaggttaggattttgattccagtcttaactctgtcaccaacctattgattgacacttggcaaatcacttcaagttctcagagcctcagtttcgtctaattggactagcccattgattgctaaggacgtttctgacactcagatcctttgacttcaagtcctgagggcaaaaagaaaaaaaggctaggattccacatgtattgaagaatttttaaaatttatttttagccccagtctttattttcaatttggttttctatcttgtttctcattcctcagttacagttctgtcatttcccttttccctgaagatatttacgaagctgcctttgcatcactttaaaactgtaaatatgcccttgaaacatgcaaagaggcttttgtgtacttacaaattgaggttattatcgtacaagtaagtcacttgagtgcactgcattcttcagcttgctccattgagagctttattaggttatattgtcctatctcagaagataagactttcccactttaaagggtgggctatctgatgaaacagggtgccgaatgctccagagtataagcaaaaggattttggtgctgcccaaaagacagacacacttctctaatacaagtaggtacttcacttaaaggggcacagtcaaggacaaatgttctaaaattaaaccaaccagctgcagacgcccacatgtcaattatgctatcttctagtccagccttctctttccatgaaaccagaactcccactcgctgcaaccctggaaacttcacatactttccaagtggccacctatccatggaagcagaaagcccgtttcagaacatactaggatacatgtcctcatctgacagaatgtatgctctttgggtttttcaactctggtaccaaaatgtcaacttaggcgatgccagaaattggtttcacgagtcaattgaagtataaccttcctc

SEQ ID NO: 7570 - DNA, 1154 bp, mus musculus
taatatacattataggtaatatggagagactatagatagacagatagatagatagatagatagatagatagatagatagatagacacctatatatagtatatgtatttgtggaatatcttattcattcagtactggatagcacaggtctagacctcacagggggtaataccacaaggggaataatgtgtgcaaagtgcagagtaagtgcatgtaaatagcttgcactagcagaaaaaagcactgcaaggagccaaaagaagaatataaatcaatcgtgatcctggtagaataaagttgagatgctctggcatatttgcaagtaatgatactagtgaaagagctaaacagaaggcaaaaatagagaccacaggttataagaaaaagttatgcacagtcaagagttggaaagcaacttaacttaaaaaaaataaaaaccatctaccctggcagtgtataaggcatactaggcttgctgctaatacgaagtagccagggatatttgtctttctatcactggtgccaggcacagggtaagttctcaatatatatttgttcacaatggaggaagagtgatcggttagatagctatgtggcctacttaaaaataccacactttgccaacgtcacatgtggttcaagaaaatctgtttctgagttgtttttgtgggtgtggttcacagacaatattggtgacacatcaggaaagatggcaagcagaacgagaactagtgctacaaaaagtgatctcactgtaacagcatgggtgggcctggaagtcagttctcatgcaaccccattagttctagaaagttctcatatgactaagaaaaagctgacaggaatcaaacagatttcatcattaagcaaacagaaaacatcaagtaagtaagggaaaatgtcgaatgaggttaggaggaaacaattttagatacttttatagcctccggcctctttcattccctttctcaatcagctctcctcctatcccaacccatgaccctctcctacccttaccccaggaacactaacagagcagggatgtttctgtataatccattcaagaaattgcacaagatcacctaagaagaggctgctatagtctgaatgtttgtgttcctccaaaattcatgtgttgaaacctaacccccaaggt

SEQ ID NO: 7571 - DNA, 1020 bp, mus musculus
tacatatcctttaagctggttatttacctctttttaaaaggaaactgtaaggtcttccagggcagggagtatgtctgtaaagccttctagagctgggctccttgcttcctgatctcactctctcactgtctgtaggctcttgggcaggttatttaatttcttagtgtctcaatttcctcctctataaaacagagataatagtatttagcccagagggttgtggtgaagtgtgaatcatttctccatgtaaaacacataggacaggctgggcatggtggctcacgcctgtaatcccagcactttaggaggcctaggcgggtggatcacctgaggtcaggagttcaagaccagcctgggcaacatggagaaaccccatctctactgaaaatacaaaaattagctgtgcgtgatggcgcacacctgtaatcccagttactcgggagactgaggcaggagaatcacttgaacccgggagcggaggttgcggtgagccgagatcgtgccattgcacttaagcctgggttacaagagcgaaactctgtctcaaaacaaaacacacataggacagagctcagcacagagtagacattaaggattatatcctttgcttggcacaataccttgcacagggcaggcacgcaacagatgtctctggaatgaaggaatgaatgagtgaatgactgggttaagcatgttgccaccaggtggcagaagagcctcactatcaaggcagaacccaaacacgagactcatgagaactccctcctgaagtccagatacacattgaaaaaaaataaaaaaagcactgaaccccatttaggccttgaagtgaagttcctcttctctcttgcccttcctttctctcccatctctgctcactctctgctgtaatgaaccatttctttctttcccacttaatacatattagtcagtttgggctgccacagcaaaatactacagactcagtagtttaaacaacagatatttaatgcatcacagttctggaggttggaagtccat

SEQ ID NO: 7572 - DNA, 1485 bp, mus musculus
agttaatgatgatagagagcttcttacacccagttggacactggacttaaaagctctctaaagtctcttccaaatctaagattttattgttctgggtggatcattgaatgtggcaaatacatgtcagagtttttttactttgtgttcaaagtagatttctgaaactctttgtgacacccgtgttctcttctttatgagactgctaatttttgagattaacttttaatatctgccttccaagcatgagtcttacaagaacttatgcttattgcctttccttgaaactatgtagttttgtagatcaagttttgaaatgttacttagttcactggcctgcctgcccgcccgccctccctccctctctctctctctctctctctttctttcttgacacagtctcactctatagtctaagctggagtgcagtgatgcaatcttgcctcaccgtagcctccacctcctcagttcaagtgattcttctgcctcagcctctgagtagctaggattataggtgtatgacaccacacctggctaatttttgtatttttagtagagatggggtttcaccatgttggccaggctggtcctgaactcctgacctcaggtgatcctcccaccttggcctcccaaagttctgggattacaggtgtgagccacagtgcctggccagttcattgggtttctgagggcactagaaattacttgaagtcccttccatggcttgggtgggagtagagactctcatccctgactctgtctaagttagagtagctccatttctatctctgtgatatcttgaatttccaagtaagcatttgtttgccaaaaaaacttttaaaaatcaccactgttttactggatgactttttaagctataatacttttttttttcctagttggaaggatgttttgtctagagggatttttgattaagctggaagcaatatgagggttttgtttgtttgtttgtttgtttttgtgccatgcagtgtctactctcagagtctatcagcccctttatgtcacccaggctttgactcagggccttccacatcatggtaggacaggcctcatgcctctcttcttgaagctttcagtccagcagaaggttgtgattcttccatccaagattgtagagattgttaatttataggagtcagaaattattagagctactcaaggttcctttaagcctaaaggggcttggaagtttttttttttgaacaagagacattaacaggtcagttctcaggctcagacagagaaaacatggtagtgagcctgagtgggcagacaggctgattcttaatccactaattgctgatccccttaagtttcaatgaaaggcaaagtaacaaaggcaattagcttagttgtaaagaagctccttctgggaaaaagaaagggaaaaaagaataaagggatacatttctgagggcaggctgggaattgtcttttcaagatttttagagacatagcctcagc

SEQ ID NO: 7573 - DNA, 830 bp, mus musculus
atcctaattactttattataataaaacttttgttttaaggcagttagtgaaattttaagcatataaatgccttacacacaataaaaataggttaggcttgctaccaataatttcaacctgaaaaccaaacatttcacttagccctcattgtacagtatgttcatttagtgaggctgcttggaagttatttttaaactcagccatttaaatcatcatgtctagcatactgtctagaagacgcaatgtttcattatcaaaaagaaacattatgtactgtggcatatgagtcattaaaggaacagcagatatgttgtcacttccaaataataaggcttgttaccattattgattatatgtctttatagaacctcttatctgagaatctcaaataacatgataattgaactatataaaattccaataatgcagggattctaacggatttttgtattcacagttcatgcttttatttacttaacaaaaatgtagtgagcatctactatgtgctagatagagtcctcagccctgggaattcaaaaataaagaagaccacgacaaagccttatgcaaatcaactagtatttacacaaatctaattagaaactgttttaatgtctggtttactttaacctccagagtaatctctgtacactaaaaaccctccctctcttgtagaattaaaaatagaagctgttgggatgcggatttcaaaataaaaaagcaaagatgatttctgaaagccacgtcatttgtaagaaaccaagagaccattcaaaatcttgctatattctgcttaaatatatttttggtttaaggtaaaaatgggagaa

SEQ ID NO: 7574 - DNA, 7385 bp, mus musculus
ggagtaaataatataacttttaataaagtattgaatagtactgaacatgtatttcagatagtacaaatttgttaatcagaagaaatcatgaataattaatgtgcttccaacagttcaatggcctagagaaacaaatagattctccctagataatccatatgtctcattgatttattgaaccctgaaatatttcaaagtattgaactgaaaatacttcaaagatagtagggaaatcaagcaagacaattttcaattttcaaatcatttttaacaataaaatttgtatcaaagccaatggatgcttctcagaataagagtaccagctcaaacacctacctctgttatgatcacaatatgtgactttttttttttttttttttttttttgagatggagtcttgctctgtcactcaggctggagtgcagtggcacaatctcggctcactgcagcctccacctctcggattcaagcgattctcctgccttagcctcctgagtagctggggttacagttgcctgccaccacgcccagctaatttttgtatttttagtagagatggggtttcaccatgttggtaaggctggtctcaaactcctgacctcgtgatctgcccgccttggcctcccaaagtgctgggattacaggcatgagccaccgcacccagccaattcttttattatactttaagttccgaaatacatgtggagaacatgcaggtttgttacataggtatacacgtgccacggtggtttgctgcacccatcaacccgtcatctacattaggtatttctcctaatgctatccctcccctagttccctactccctgacaggcccagtgtgtgatgttcccctccctgtgtccatgtgttctcattgttcagttcccacttatgagtgagagtatatggtgtttggttttctgttcttgtgttagtttgctgagaatgatggtttcctgcttcatccatgtccctgcaaaggacatgaactcatcctttttatggctgcatagtattacatggtgtatatgtgccacattttctttatccagtctatcattgatgggcatttgggttggttccaagtctttgctattgtgaacagtgtcgcagtaaacacacgtgtgcatgtgtctttatagtagaatgatttatactcctttgggtatgtacccagtaatgggattgttgggtcaaatggtatttctggttctagatccttgaggaatcaccatactgtcttccacaatggttgaactcatttcactcccaccaacagtataaaagcattcctatttctccgtatcctctccagcatctgttgttccctgactttttaatgatcaccattctaactggcatgagataatatctcactgtggttttgatttgcatttctctagtgaccagtgattatagctttttttcatgtttgttggctgcatacatgtcttatttagggaagtgtctgttcatatccttcacctactttttgatgagattatttgtttttttttttcttgaaaatttgtttatgttctttgtagtttctggatattagctgtttgtcagatggagagattgcaaaaattttctcccattctgtaggttgcctgttcactctcatgatagtttattttgctgtgcagaagctctttagtttaattagatcccatttgtcaattttggcttttgttgctgttgcttttggtgttttagtcatgaagtctttgcccatgcctgtgtcctgaatggtattgcctaggttttcttctagggtttttatggttttaggtcttacatttaagtttttaatccatcttcagttaatttttgtataaggtgtaaggaagggggtgcagtttcagttttctgcatatggctagccagttttcccagcagtatttattaaatagggaatcctttccccattgcttgtttttgtcaggcttgtcagagatcagatggttgtagatgtgtggtatgatttctgaggactctgttctgttccattgctctgtatatctgtttttgtaacaatatcatgctgttttggttactatagccttgtagtatagtttgaagtcaggtagcatgatgtccccagttttgatctttttgcttaggattatcttggatatatgggctcttttttggttccatatgaaatttaaagcactgttttttctaattctgtgaagaaagtcaatgataccttgatggggatagcattgtatctataaattgctttgggtagtatggacgttttcactatattgattcttcctatccatgagcatggaatgtttttccatttgtttgtgttctctcttatttccttgagcagtggtttgtagttctccttgaagaggtccttcacatcccttgtaagttgtattcctaggtattttattctctttgtagcaattgtgaatgggagttcacttatgatttgcctctctgtttgtctattattgatgtataggaatgcttgtgattttcgcacattgattttgtatcctgagactttgctgaagttgcttatcagcttaagaagattttgaactgagacgatggggttttctaaatatacagtcatatcatctgcaaacagaggcatttgacttcctctcttcctatttgaataccctttatttctttgtcttgcctgattgccctggccagaacttccaatactatgttgaataggagtggtgagagagggcatccttctcttgtgcccattttctaagggaatgcttccagtttttgcccattcagtatgatatgggctgtgggtttgtcataaatagctcttattattttgagataagttccgtcaatacctagcttattgagtttttagatgaagggctgttgaattttgttgaaggccttttctgcatctattaagacaattgtggtttttgtcattggttctgtttatgtcatggataatgtttattgatttgtatatatattgaaccaaccttgcatcccagggatgaagccaacttgatcgtggtagataagctttttgatgtgttgctggattcggtttgccagtgttttattgaggatttttgcattgatgttcatcagggatattggcctgaaattttctttttttgttgtttctctgccaggttttggtatcaggatgatgctggtctcataaaatgagttagggtggagtccctctttttctattgtttggaatagtttcagaaggaatggtaccagctcctctttgcaccactggtagaattcggctgcgaatccgtttggtcctggacttttttttggttggtaggctattcattcctgcctcaatttcagaacttgttgttggtctattcagggattcgacttcttcctggtttaggcttgggaggaagtatgtgtccagcaatttatccatttcttctagattttctagtttatttatgtagaggtgtttatagtatgctctgatggtagtttgtatttccttgggatcagtggtgatatctcctttatcattttttattgcgtctatttgattattctctcttttcttctttattagtctggctagtggtctattttgttgatcttttcagaaaaccagctcctggattcattgatttttcgaagggtatttcgtgtctctgtctccttcagttctgctctgattttagttatttcttgtcctctgctacctttttaatttgtttgctcttgcttctctagttcttttaattgtgatgttagggtattgattttagatctttcccgttttctgctgtgggcatttagtgctataaatgtccctctaaacagtgctttagctatgtcccagagattctggtacattgtgtctttgttctcaatggtttcaaataacttatttatttctgccttcatttcattatttacccagtagtcattcaggagcaggttgttcagtttccatgtagttgtgtggttttgagtgagtttcttaatcctgagttccaatttgattgcactgtggtctgagagactgtttgttatgatttccgttcttttgcatttgctgaggagtgttttacttccaattatatggtcaattttagaataagtgtgatgtggtgctgagaagaatttatattctgttgatttgggatggacagttttgtagatgtctattaggtctgcttgttctacagctgagtgcaagtcccgaatatccttgttaattttccgtctcattgatctgtctaatattgacagtggggtgttaaagtctcccactattattgtgtgggagtctaagtctctttgtaggtctctaagaacttgctttatgaatctgggtgctcctctattgagtgcatatatatttagaatagttagctctttttgttgcattgatccttttaccattatgtaatgcccgtctttgtctctcttgatctttgttggtttaaagtctgttttatcagagactaggattgcaacccctgcttttttttttgctttccatttgcttggtaaatattcccccatccctttattttgagcctatgtgtgtctttgcacatgagatgggtctcctgaatacagcacaccaatgggtcttgactctttttccaatttgtcagtctgtatcttttaattgggtcatttagcccatttacatttaaggttaatattgttatgtgtgaatttgatcctgtcattatgatgctagctggttattttgcccattagttgatgtagtttcttcatagtgtcaatggtctttacaatttggtatgtttttgcagtggctggaccggttgttcctttccatgtttagtgcttccttcaggagctcttataaggcagaactggtggtgacaaaatctctcagcatttgcttatctgtaaaggattttatttctccttcacttttaaagctcagtttggctggatatgaaattctgggttgaaaattattctctttaagaatgttgaatattggctcccctactctctcctggcttgcaaggtttctgcagacagatacgttgttagtcttatcagattccctttgtgggtaacctaacctttctctctggctgcccttaacattttttccttcatttcaaccttggtgaatcggacaattatgtgtcttggggttgttcttctcatgaaggagtaccttcatggtgttctcagtatttcctgaatttgaatgttggcctgtcttgctaggttggggaagttctcctggataatatcctgaagagtattttccagcttggttccactctccccgtcacttccaggtacaccaaccaaacgtaggtttggtcttttcacatagtcccatgtttcttggtggctttgtttgttccttttcattatttgttctctaatcttgtcttcatgcttgatttcattaagttgatcttcaatctctgatatcctttcttctgcttgatcaatttggctattgatacttgtgtatgcttcacaaagttcttgtgctgtgtttttcagctccatcaggtcgtttatgttcttctctaaactggttattctagttagcaattcatttagaacatgctcctttagctcggaggaatttgttattacccaccttctgaagcctacttctgtcaattcgtcaaactcattctccatccagttttgttcccttgctggcgaggagttatgatcctttggagaagaagaggcattctgatttttggaattttcagcctttttgcagtggtatctccccatcttcatggatttatctacctttggacttctgatagggttttggtgtggatgtcatttctgttgatgttgatactattcctttctgtttgttagttttccttctaacagtcaggcccctctgctgcaggtctactggagtttgctggaggtccactccagaccctgtttgcctgggtatcagcggcagaggctgcagaacagcaaagactgctgcctgatccttcctctggaagcttcatctcagaggggcaccctccagatgccagtcagagctctcctgtgtgaggtgtctgtcgactcctgctgggaggtatctctcagtcaggaggcatgggtgtcagggacccacttaaggaggcagtctgtcccttagcagagctcaatcaatgtgccgggagatctgctgctctcttcagcgctggcaggcaggaacatttatgtctgctgaagctgtgcccacagctgccccttcctccaggtgctctgtcccaggaagatgaagttttatctataaggccctgactggggctgctgcctttctttcagagatgccctgccagagaggaggaatctagagagacagtgtggctacagcagctttaccaatctgcagtaggctgtgcacagttggaacttcctgtagctttgttttgctgtgaggggaaaaccgcctattcaagcctcagtcatagcggacgccccttccccaaccaagctggagcatcccaggttgacttcagactgctgtgctggcagtgagaatttcaagccagtggatcttagcttgctgggctctgtgggggtgggatccactgagctagaccacttggctccctggcttcagccccctttccaggggagtgaacagttctgtctcgctggtgttccagggccactggggtatgaaagaaaactcctgcagctaactcggtgtctgcccaaatggccgcccaattttatgcttgaaacccagggcccttgtggcataggcactggaggaatctcctggtctgcaggttgcgaagaccatgggaaaagcgtagtatctgggccagaatgcaccgttcctcactgcacagttcctcatggcttcccttggctaggggagggagtcccccgaccccttgcacttccaggtgaggtgacacctcacactgcttctactcgccctccatgggctgcacccactgtctaaccgtcccaatgagacaaaccgggtacctcagttagaaatgcagaaatcacccaccttctgcattgatcttactgggagctgcagaccagagctattcctattcgtccatcttgccagccaccttcatgacatcttctttggttcccagtagaacacaaaccaatttaaaatctataaaatgattaacattatcaatactctttccagagattatcacctctgagctataccaatcgttgtgagtaaatgtctaaatttcagtttattttattcctttgaggctcaacgtacactggaaagcctctcatacataatttttgagctctgcttttcttacacatatttttaaatggcatggtaatctaggatccttctgaagaatcagtcaatgatctgatactttttaaactcacattcttggtgatgttatggt

SEQ ID NO: 7575 - DNA, 900 bp, mus musculus
tttctttctctttttttttaatcatgccacattatttttaattacatacaaagatctaacatgtcgcccagggaccatttcacccactgctctgtttggccgccagtcttttgtctctctcttcaacaatggtgaggtgggtaccctttcctcaggaaaaagaaattcacagtttgttgcccttgccaataacaaaaatgttggaaagacgagtggcaaacctgttgctgttggcatctttcatgtgaaccacgtcaaaagatccacggtgcctctctctgtggtgatcacaccaattcttcccaggttagcacttccagtcaccatacacaggttaccagtgtcaaacttggtgaaatcagtaatcttgccagtctccaaatcaatctgaatgatatcattcaccttgataaggggatcaggatagtggatggtgcgagcatcatgagtcacaagacgagagattccttttgtgcccacaaagatttttctcactttgcacaacttgtacttggcctcctcaggtgtaatatgatgtacagcaaagcgacccttggtgtcacagatcagatggaaattctctcccgtcttgtcaatgctgatgacatccatgaacccagcagggtaggttatatcagtttggaccttgccatcgatcttaatgaactgctgaatgcaaatcttctttacttcatctcctgtcagggcatacttaagtctgttccttaggaagatgatgagggagagacacactctcaacttgtgggaccggtggatggacgaggatcaaacacactggtcaacttatccagcatccaatgctttggagctgctacccacttcagatgcttcttgggatcacaagtcatggctgcattaagcaaggaaagaggaccccca

SEQ ID NO: 7576 - DNA, 378 bp, mus musculus
cattgagaaacgtaggaagaaaaggtcttctgcaggagtagttgaagatatggggtaacgtgttcaaaataatttttgtttcttagataaagcacttcaagaaaagttgctaacaaataatatatgtaaaatacttggcatctggtatttcttccaaaacaagcatggtatgttgtggatcttctaaagtgtttaaaatgtaatttctttccaggggtgaagtgcagaatatgctggaaggagttggaggtaggttttaggagatacttgtatttaaagaaaattgttttaagccatataatttgtataataacaaatgttaataatggactataagactgttatttaatgccttgttctcacatagaagattctgca

SEQ ID NO: 7577 - DNA, 193 bp, mus musculus
ggtatgttgtggatcttctaaagtgtttaaaatgtaatttctttccaggggtgaagtgcagaatatgctggaaggagttggaggtaggttttaggagatacttgtatttaaagaaaattgttttaagccatataatttgtataataacaaatgttaataatggactataagactgttatttaatgccttgttc

SEQ ID NO: 7578 - DNA, 413 bp, mus musculus
taacatctttcaccttcacatccagcagaaaagcacaagccttttctccaacagcacctacattttaaagcccagagatgcagtacaattggtatagcttcgaactgcacccatcctgaataaaccaaccatcatggccactgggatgcaaaatgttgctaacccagggaaaggaaagggaaacaatgaatgtccagtgctcttgttcatgaaatattgttcaagagttcccccaaaggacagagggagaggataaaagcaaattaaactgatcttcaagaaatgttaggtgagaaagagttcactattcctgtagatgttgacttatagcagtcacgtgacttcaacagaaagttttattttctatctttcttgttttctccaatgccactttttcttggttcccttgttct

SEQ ID NO: 7579 - DNA, 1000 bp, mus musculus
tagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttgtgagtgtgtttagcctttcttttttggaaatatttgtaaaaagggccaccatccctaacaagttaagtcgtaaagtttggcattaagggagtatagaaagcaactagaccttggaacttttctttgccttggtattgtcctttatattaatgtggtgccttttcttcaagtaagccaaatgatatacatacatttagttggttcttagagcatcctcct

SEQ ID NO: 7580 - DNA, 5401 bp, mus musculus
aggatgaatgaaatgaacctgagtccagtggggatggagcagctgacttcatcctctgtgagcaatgccttgccagtctcaggaagtcacctgggattggctgcctcacccactcacagtgccatccctgccccaggtgagtggtaagggagacctactgcatttcaacacttaactctgttatcaattctaaatggagtctagaagagatcagagcccctttaagggtagaaggtagaagggagaaggtaagcaggcctgaatggtggttcaacatgtgataggtaatggaaaataaggtttttgtagaggtagagtattagaattctagtggatagtagcagcaattttttctgatagtcctcttctgagttggtagctttttgtccagagctgtaattaacttggcattttatttagggctgcccattcatctggttcacacttcagtacccgttccctgggttaatagaagagaatcagttaaaattactctaataactattcccagagagcatggggaattgggctttatattccaccaggtttgaaattaaatggcaataactgcaagtgtaccaggtctagaattaatgtggaaagaagtgtggtacttttacctggggcttttacatggaacgcctcatgagcctccatacacagcaaaatcgtataggaaaaattcattcttcctatccttttttttttgaaatggagtctcactctgtcatccaggctggagtgcaggggcacgatctcggctcactgcaacctccgcctcccgggttcaagtgattctcctgcttcagcctcctgagtagctaggattataggcatgcacccctacacctggctcattttcttttttttcttttttgagatggagtttcgctcttgtcgaccaaggtggagtgcaatggcacgatctcggctcactgcaacctccgcccgcctcccgggttcaagcaattctcctgcctcagcatcccgagtagctgagactacaggcacacgccaccatgctcaactaattttttgtatttttagtagaaacggggtttcaccatattagccaggctggtctcgaactcctgccctcaggtgatccgccctcctcggcctcccagagtgctgggattttaggtgtgagccaccgcgccagccgtcactgtacttttaaaaccttttttctgcctagcttcattttcttattctattgaaatagaatataaatggaataaatattctattgattattacaatgataagctgtcagttctttaggatcaatgacattgttatgtattggactttctttgtcacagtaggagttagtataaataaatctatatattgtttaaatagttctctaaagagaattacttgcttaattaataaaatgcagcagttaaataagattcattgaaactagggtctcttcacatttgtttaagtgtccacaaaagaaatcttaaaaaattattagtggttaacccacttgattgtttgtaggcattccctttagtggacactcttgttaaggtggaaaagcctgttaaaaaatattgccagccaggcacagtggctcacgcctataatcccagcattttgagaggccaaggcaggaggatcacttgagcccaggagttcaagatcagcctaggtaacataaggagaccccatctctacaaagaaaaaaaaaaaaattagcagcgcatggtggcacacacccgtagtcccagctacgtaggagctacataggaggctgagaagggatggccacttgagccaggaaagctcaggttgcctgagccatggtcatgctactacgctccaacctgggcaacatagcaaaaccttgtctcaaaaaaaaaaaatattgcccctggcaaaaatatgcaaatcagcactgaccaagttggtgggtatttattatgatacttagcccagtaaaagtcacttcactttgcaagtacatataactcaaagtagatataatctcacgtttaaagcttttattaatcactaagtgtagcatatatacaaaagattgtatgaaggtgtacatgtacagttttacatctaactaaactacgttgttttccaggtagaaatgaaatattctcaccatataaaatggtaaatacaataaagtttaaaaataccaaaaaaatttcatactatcactacctagggactactcctatgaacattttatgtttccattgtttttttctctatataatttgttttcttgtatttaaactcggtttttaattctaaattaaatattttggctgggcatggtggcaatccccgcactttgggaggctgaggtgggcagatcacttgaggccaggagttcgagaccagcctggccaacatggtgaaaccctgtctctagcaaaaatacaaaaattagctgggtgtggtggtgtgtgcctgtaatcccagctactcaggaggctgaggtaggagaattgcttgaacccaggaggccgagattgcagtgagctgagatcacaccactgcactccagcctgggcaacaaagcaagactccgtctcaaatcaatcgataaattaattaattaaatatttttgtatttaagcgcaatacagacaattggagtatcaacttgccggtttagaactaacttaaaaactatctttgggactaagactactttctttaggcttatttgtggatatttgcacattatctaaggatgaaaagggctagtaggtgagatttttgcccatgtgtaaaaacctttctaagagtttagccagtggttgtagtgagaatttttaattacctattttcttttaactgagaaaaaaaattttgttttgtaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggtaagtgttacagttacttgagatgttagagaaaaagaacggcgccagcttttaaacttttatcctgaagatatgaataacacttttttctgtttgtcactattagatattaatctctaggcaggaaaagtatctttgtttatatttatgtacttttcctcttagaatgtggcacataacacattagtaatacagtttgactaagctgaatttcttaattgcacataatttttcttctttctcctccagtatctctttcatttggtgtttataattctacagctataatttcagtcaagcactatagtgtcttgttatagtgtcatgttttttaagttcattgaatttttattctgttataggagtattatatgcttattgcggaaaatttagcaaataagggaaggaaccactcagtcccatcatccatctttttggtgtacttccttcctgccatttgttttggtgtataggtttttaccaattttcataattaagaccacggtttcttctcttgctctcttttttcttttcttttttttttttttcttttaatggagacggagtctcaactattttgcccaggctggactggaactcctggactccagtgattctctcacctcagactcttgagtagcttggaatacaggcacatgcctgccttgagaccataccatatttcatttcttttttataaataacttttttaaaaaaagagatggggttttggcatgttgccgaggctggtctcgaactcctgcgctgaagccatccgcccacgtcagcatcccaaagtgccgggattacaggcatgagccactgtgccctgcccaagaccatactttctatacgattgtctgtctttacttttttcactttatctttttctctgctgttacatgggtattttcctttgctgctacgtggttttcataattatcctttttaatgatgcattactttctactgaatgggtatttgatggtttattatctttattgttggacagtttggtttttccagtttttattaccattgtaactaatgctcttatgaacgtctttatgtataatatttacaaaatggatttagagaagagtaccttaagtggaatttcttgtgcaagagggtattaacatttttgaggctcctaatatatatgcttcacaaagaagttttagcagtttacattccctctggcagtttagtaagtatcatttcaccatatcctcccaagcacaagtgttaatttttttttgttttaataaaacaggtacaattgtgacttgtattaaatagtttgtgttatgatagtttaattatattaaattatatttaattaagttttatttttcacatggaagatctgtttttaaatcattttaccttttaataattaggagagcaaattttacaccttaggactcaggaattgcaaccatatgtatattaaaagcagtgttttcgttagtgattcccagttagcttcaaaggaacatagttaacttttttaggattttcgagttttacaggaaaaactcaattacggtatatgtatgttgctatttataaaatagtgtgtatcgattaaattaaagaagcaggagattatttgaacttagttatgtttgtaaggaaatagcgtctagtgcttggaattctttaataatgtactaaaagtctctgatatctcatcttttccttttctcaggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctaga

SEQ ID NO: 7581 - DNA, 1268 bp, mus musculus
ccactgctaattttcattgactcgggcctttttctcttgcagttctgaatcagccaggggcccccaaaacacagatttttatgaatggcgcctgctccccatctttattgccaacgctgtcagcgccgatgcccttccctctcccagttgttcccgactacaggtgagccaccctttacaagccccatcttagagctaccactgctcttagcttctaaaattagcttttcacagaaatgaattaaggaaaatatagatgtttatttttcattttaaggtgaagtttcacgattacacattcctatttatttttgtccaaaatggaaataacttttaaattaaaaatttttaaagtacataaaatttacatatgcatatgtatgtgtgtatatatgtgtgtatgtataaaatataaagaaaatttaaaatttcttgggataccatctagagatagccaattaaacacttagggtcatgcactctataaagttgtacatcacacatacatatagtgtacataaacacatacactcattgatacaaacatccacatatacacaatatacatatactcatagaatgtacatcttgccatgccagtaaatacagatctgtattttaatagttgtgtagcatttggtggtatggacttaccattgtattcatcccctatttaacattagcattcttttgtttttgcctataaagtctttttgttaaaattgtaaacccctgacatgtgttcgtatcattcagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctt

SEQ ID NO: 7582 - DNA, 408 bp, mus musculus
tgcctttcttgggccaggaccacgtgtgtagagatttgatggccctggtgtcagatgatggggtctgtctctctcctttcctggcaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgagggtatgatgacatttggagtcacatgctcctgcatttcatttccatacatgaata

SEQ ID NO: 7583 - DNA, 702 bp, mus musculus
ctcagagctcatgtgagtttgtactatgtcatctaaagccacagatgtgatggactggggacctcaaggagagaacacccagagaaacctgcctgttgatttgggatgatttgaaggaagtcgctttcctctgcaaaagcagccacatcttcccagcagcaggcaggattccccagggaaacagagacctaatttatacatctggcagacaagatgttagtggaagtacttaaccttgattcccttgcctcccttccctggaacgtcaggagtgatggaagctgccctcccaagatccagagctcatacccccaaatgatgtgggtctcacagccatccggggccactgctcagggagaatcactcagcctgacactctgctccagtcacagatgaaccctcattccgagagtcagaaacagagacccagcaaaccagggacctggtccctgccctcagcaagtctaggatctatttgaggacacagttcacatctgcacatgaaaaccaatttggaatatttataaggctgcccagtatgctgtgtaatcaaacagtgcatgctgagtactgataaagacaccccagtcttagagcaggaagaagtcttataaatttgctagtccagggtctctgaacagtggctcatgggccgaatttgacctgtagatgtgtgtgtttgagttataccatgtttttttt

SEQ ID NO: 7584 - DNA, 268 bp, mus musculus
ttagctccataagcaaacaggtcatcttgctcaaagaagtttcccagtgtatactgagcaggtcacctgtcctacaaaatgcaccatgaagaaaagtgttctgtagtcacagatgtttaagaaatgctgtgaactgcacccccatcccagagactcttagtgcacagtgatattttcaagctcagtaaagtccaatagcaaagaagcctacttaaatataggtagtccagcatttcctagtcattaaggcatgacctccatttctggc

SEQ ID NO: 7585 - DNA, 607 bp, mus musculus
tggagttgtttgttactgcaacacaactgagccgatactgactgatacatctccgtttcacaggtgaggaaacaaagtgtggaagagatcaccaaggttacccaaagtcaaacacagagtagaggcacagacaagactcaaagacaggtctgccctttgctgcaaccctccattctgaacaaacccagccaagccccttactgctaaccacttcaattaaagccaatgtcaaggcctcctggtttctaaatgaacagccctgatcatgttcgttaaaggccctgtctgcacagactgctcattttatccgaagccgccaacaagataaatggccctgtaacttattgttctgctgcaaagcacctcacggcaagcggcggcacagatgccaggaataaatcacatctgatcttccgagagccaggcagagcgcccacgaggagtgtcggaggcaggggaggttggcacagccctggaccttgggggttggagcagccctggaccttggggggattcactaaggagcagagagctgcaggggtctttattagggccccggagctctggagtatacattgttcttttttatcggcccagcacctatttc

SEQ ID NO: 7586 - DNA, 679 bp, mus musculus
tcattctagaaaggagacactgataagagatggtatctgtatgcttacgtcataatgggctcaaacaaatgattcagtctgtagtttcctaagccttttgttctgacctaagagcctgctatgaagccccatggggtggaatcctccttctcttgccctgaagagctctactctagaggggcaggtccaagttcacagatcccgttattgccatatacctggttttctccactccacacaaatgtactaaaagtatcctctgctcatcctcatagacgttgttttggaagatgatacctttttgctcagctgtcacctatatagcctcaggaggatggggattcgtctaacaaattattgcccagtcttcagaggaacaaagtgaaacctgcagatcgcaagctcagagctgtattcacactttttaaggggattccaggactgttgcaagtttgggggcttgtgtcaattgaggcgatttaattaaatggctgtgatgcatttactatggcttcagtgtcaatgtttgtagtaaattttactataactccaagttgaatggagttgtccacagagctatgaccttggcatcatcccagggacatcctcaaatacatggcacattcattagcaccctttggagagatcctctgagtctgtggagttgtcacacagtcat

SEQ ID NO: 7587 - DNA, 561 bp, mus musculus
aagcgtctatttctcagatacagacccatcttagacccttcacccatgtttttattactgagtatgtggtgattaatcctttcagagccagttctaacttccgtgtacaaccggagcttccaaatgggttttggccatggtgagaagcccttactgaacatttctgtgaatggaataattgaatagacataattacaagactctgtgccgtgtgaaattgtaaatagcactgacaatgtaatttgcattcatttatgatacagtaactcattacggctccgattttcatccccttcattaacaagctcatctgtttccctgatggaagccccttttgtgttagatacagctctttgcccagagagatgcccacggtgtggactggcgctgagaagtgcacttggtgttgctgacagcaggacacatggcagagtggtgtcccccagagcatatgtacaccccagccaaagaaatgtgtgtgtgacttctgggctgtttagcttttttaaaaaatatgtacattttgcttgcttggattgcagggaattattatattaaata

SEQ ID NO: 7588 - DNA, 907 bp, mus musculus
ggaaaaagaggagaacccaagtctcctggatcaagccacacctgaaaggaaccctacccctaaacatttcagttatttcagacagtacatgaccttcacgcttaagctagcttgaattggatttttatgacttatatccaagagaactttgatgaatctttttgccttgcttccctccctctcaacacttgtgctgtaacttttgtgtacaaccaatattacagcaaagaatgctgccaacaacagcaactcaggtatcagttctaattgtgtgtgggcccatttgctcacttgggtcagccacgtgtcagtgataagcaactccaggccattagttgttctaatattaatgaaatatctgatgccacccactccatacatcatgggccacaccagcttgtaaagcacccagtggcagagggtgtttctctttgttctgcagaattgaccaccatcttcctgaaagtccccaatgggaaagaaaatttctctaaggtataaagaaatcataataatagccatgatctggagttcaaacaaacttcataagaagataattgttgggaagtgaaggcaggagattcgcttgagcccaggagtttgagaccagtctggccaacatagtgagaccccatctctacaaagatggtttttaaaagatgattaaattatgagaataaccttgagaaactggttatgaataggtatagtttgacctgtatctggaagaaagtttgtttctgccccaagaatatgttgtaatctttcccctgatgaaaggaagtatagcagtgtggtgaagagctgagatcggaaatcagaagagacctgggttggcctgccacttactagcagtgagttcttgaaaaagtcactcagccccaagctacttaacctcttagagact

SEQ ID NO: 7589 - DNA, 665 bp, mus musculus
attccaaggcctcatcaacacagacacaggttactgctcattgttgaatattcttggcccatatccttaacttgtgggtgcttctctgtcccagatgccagtcctcactttgtaggtggttccatgccccaggatcccccaccaaaaccctggagccatccctgagatgtgtttctttgtctttatcttctgcgtactattatgaggagagaagggtcctttgaacaaagttggcttaaagccagtttcttttctctcttccaggagcagcagtttattcaatgaggttgtgcagatgaactttgaaatagccagtttcagcagcctttcagggactcagcccatcacgtggcaggtggagtacccacggaaggggaccacagacatcgccgtgtccgagatctttgtcagccagaaggacctggtgggcatcgttcccttggctatggtgagtcctgagttaccttggatgctcctgcattcagccacctgactgcatcctgtgtccttcctatctgtcatgggatgtttgctacaatgattttatggagtgtttactttcaaagtttctcgtctttcctcaccctggaagttgttacttttcatgagcctggcctttctcaactttagtcatgaagtttagtccagcaagtcacaatcattgc

SEQ ID NO: 7590 - DNA, 105 bp, mus musculus
ccttcagtgtatgtggggtgtggcttcttcgccaaggaagagctgcctgagtctgtctcagacccacaaagtgttccatagagtgggtgtgggcagcagccctgc

SEQ ID NO: 7591 - DNA, 33 bp, mus musculus
ctgagtctgtctcagacccacaaagtgttccat

SEQ ID NO: 7592 - DNA, 666 bp, mus musculus
ccctgctgtctgggtgtggacggcagccccaccctgctgtctgggtgtgagtgacaggccggccctgctgtctgggtgtgagtgacagccccgccctgctgtctgggtgtgagtgacaggccggccctcctgtctgggtgtgagtggcagccccgccctgctgtctggtgtgagtgacaggcccgccctgctgtctggtgtgagtgacaggccggccctgctgtctgggtgtgagtgacagccccgccctgctgtctgggtgtgagtgacaggccggccctgctgtctgggtgtgagtgacaggcccgccctgctgtctgagtgtgagtgacaggcccgccctgctgtctggtgtgagtgacagccccgccctgctgtctgggtgtgagtgacaggcccgccctgctgtctgggtgtgagtgacaggccggccctcctgtctgggtgtgagtggcagccccgccctgctgtctgggtgtgagtgacaggcctgccctcctgtctgggtgtgagtgacaggctggccctcctgtctgggtgtgagtgacaggcccgccctgctgtctgggtgtgagtgacaggcccgccctgctgtctgggtgtgacaggcccgccctgctgtctgggtgtgagtgacagccccgccctgctgtctgggtgtgagtg

SEQ ID NO: 7593 - DNA, 690 bp, mus musculus
ctgctgtctgggtgtggacggcagccccaccctgctgtctgggtgtgagtgacaggccggccctgctgtctgggtgtgagtgacagccccgccctgctgtctgggtgtgagtgacaggccggccctcctgtctgggtgtgagtggcagccccgccctgctgtctggtgtgagtgacaggcccgccctgctgtctggtgtgagtgacaggccggccctgctgtctgggtgtgagtgacagccccgccctgctgtctgggtgtgagtgacaggccggccctgctgtctgggtgtgagtgacaggcccgccctgctgtctgagtgtgagtgacaggcccgccctgctgtctggtgtgagtgacagccccgccctgctgtctgggtgtgagtgacaggcccgccctgctgtctgggtgtgagtgacaggccggccctcctgtctgggtgtgagtggcagccccgccctgctgtctgggtgtgagtgacaggcctgccctcctgtctgggtgtgagtgacaggctggccctcctgtctgggtgtgagtgacaggcccgccctgctgtctgggtgtgagtgacaggcccgccctgctgtctgggtgtgacaggcccgccctgctgtctgggtgtgagtgacagccccgccctgctgtctgggtgtgagtgacagccccgccctgctgtctcggtgt

SEQ ID NO: 7594 - DNA, 596 bp, mus musculus
gctgtctgggtgtgagtgacaggccggccctcctgtctgggtgtgagtggcagccccgccctgctgtctggtgtgagtgacaggcccgccctgctgtctggtgtgagtgacaggccggccctgctgtctgggtgtgagtgacagccccgccctgctgtctgggtgtgagtgacaggccggccctgctgtctgggtgtgagtgacaggcccgccctgctgtctgagtgtgagtgacaggcccgccctgctgtctggtgtgagtgacagccccgccctgctgtctgggtgtgagtgacaggcccgccctgctgtctgggtgtgagtgacaggccggccctcctgtctgggtgtgagtggcagccccgccctgctgtctgggtgtgagtgacaggcctgccctcctgtctgggtgtgagtgacaggctggccctcctgtctgggtgtgagtgacaggcccgccctgctgtctgggtgtgagtgacaggcccgccctgctgtctgggtgtgacaggcccgccctgctgtctgggtgtgagtgacagccccgccctgctgtctgggtgtgagtgacagccccgccctgctgtctcggtgtg

SEQ ID NO: 7595 - DNA, 264 bp, mus musculus
cgttacaaaggcagaaaggaaagaaagttctagaaagctcctgggaggttcaaatggtttcacagaacagggagagatgaacacttgctcagagaatgtgacatgttccagagagcaagtgctgcgtgaactgaacccctggcctgtggctgctctggtaggagagggagatggaactggctgctgaggggtctcgtgagggcgcctgcctgcctgcaagtggggggatatgcagccacagcagctctttccattttcttctaa

SEQ ID NO: 7596 - DNA, 261 bp, mus musculus
tggatgaatccagaggacattatgctaagtgaaataagctattcacaaaaagacaaatattgtaaggattttacttatatgaggtactcagagtagtcaaaatcataaaggcaaagtagaatggtggtttcctgggcctgaggggaagggacatgcagcgttattacttaatgaatatagagtttcagttttacaagatgaaaagagctatgaatatggatggtggtgttggttgtgcaatattattaatgtatttaatag

SEQ ID NO: 7597 - DNA, 4598 bp, mus musculus
taatatacttatttcactaattatgttttgtaaagggtttataagaagaccacaaagtgctgtgtgttattccaatgcaatttcttgctgacatgaataccactaatgcagttgcctgacctccaagtgctgaagcattgatattcttctcaagcctaatttgagtaaatacctaaaggaagctggttaaaccagatagcctctgaaagtctctcctggcaaaaatttaatatagtgtctaataaaaatgaaagccacttgtgagttgtgagaaatataaacaaatcaactttttagagaaatatttaaattgagtgtttcacctagtgatttaactcatgcttatctagagtaaaaggacttttttatgcaatgcagtgaacactggtagatggcactttcaaaacattaaagaaggctgtcataaaacgatataaaaagaattacagctggcaaacttaaaaaaaacaaagattggtaaatacagctcaaatatgggaggactagaaagcaggtcaccagcttccgaaaagcagtgtgtggtcagtattttcttccagggatgtggggtccagcttcttactcaagctgtcagcagggcaggtgggcagatgtggggggactcaagagccaaagacagcacattccccaggctccccatttttgggcaagcctcaccagactgaaggagatcttgctgagtcttcttctgagtcctaaacaactaatcacactaaacgtactctgtttatgcacaggcttcaaattaactcattataaaaagttgaggaaattctgaagtaacactcaacctattttattgcttgttgtacgcttaaataaaaaatgtctgggttggccgggcgtggtggtgcatgcctgtaatcccagcactttgggaggccgaagcgagtggattacctgaggtcaggagttcaagaccagcctggccaacatggtgaaaccccgtctctactaaaaatacaaaaattagctgggcgtggtggcatgtgcctgtaatcccagctgcttgggagaccgaggcaggagactcacttgaaaccctggaggcggaggttgcagtgagctgagatcacgccactgcagtccagcctggcaacagagcaagaatctgtttcaaaaaacaaacaaacaaacaaaaaaactgggaatttttcctttcaacatttgtatgtagttaattcagcaaatgtttattaagcacatactacatgctggctgctgctctaggggccgagggtaaaacaaaataacaaaatagttgaaaacctcaccctctcagggcttataggtggagggtgagcatttacaataaaatatgtaggtaaaatatgtagtatgcctggggagttaagtgctacagaagaaaaaatgtcagaggagcatggggagctctgtggtggtgttggtggggcctgttactgaaataggaatgatcaggaagatcgttgataagcgatctttgcacagagagttgaggggagccatgcaggcatcgggagaccttccaggtagtgggaattataactgtggagtccctgaggtggggtcacacttgggggactcctggccgagtaagaccactgttcctggagcaggaggagtcagggcgagagggactggatgaaggcagagaaccatgtccgtcggggtgagaagtttggtttttactctgagtgaaatgggaagccacgggaaggtttgttgcagaggtggggcatgagccgatgcatgttttgaaaggaccactccagcctcgatgttagaaatggactgtaggagatttagagccacaggcagggggatagtcaggtggctgttgcagtgacccaggtgaaagacgatggcagaggtgctgattaggggacctaagagctggcctcataacaggattgctgtcagctctccagcaaaccacgataaaattgtcttaaatggatactgaagttttctcagtgttatgtaagggtgaacaaaagcattatctagtagacagaataatggcccccacagacattcgtgttctaataacccctggaacctgtgaagaggtcaccttacgtggaagaggaggctctgcaggtgtggttatgcccaggctctcgaaagggaaagaccatcctgggtaatccgggcaagcccagtgttatcacgggggtccctgtgaggggcagacagaggcatcggagccagaggagggtgtgtgatgatggaagcagaggctcgagcaaggaacgtgggcagcttctagaagctggaaaaggcaagcaacgtctcccctccaccctccagaaaaacacagccttgcccacgctttcattaagacctattttttgacctccacaactataagataaaattgtgttaagccactaggtttctgataatttgctacagcaacaataggaaactatatatataggactgggaatatgtagaaatagaaatatactcacatgtgttcttagaaaactttgctagttgtattcacctgtagcaatattgtaagtctgtgcttgcttttggttcagactccctggccacccttccccatccaattgcactctcctagtctgtcctttataggaattctggagccattatttcaaatgataagcactttggaatcaatataatagagggaagaggttgagagtgactgcgtgtccagagagggaggctgctttgaggagatggcatgtgtgctgctactgaaagatgagcaggaccagcaggggcagaccaagtccaggacaaaggtcctggggtgagaattagcctggtctgttgaagagtatctactctttgcttcagtcttgtgagcaaaggacacagtggtagtagatgaagccaaagacatcagcgaagtccggctcatatagggtcttgtgggtgatagaggcgtttggacattgtcactgtggcgaaaagccatcagaaggtttggaaaaatagagtgacaggagcttactgacattttacacattgactgctgggtggggaatggttttcaagaagggaaagaatgaaagtggacttttcagcagtgtagttacgagcattcagagtaacctaaactagtgtggtagcaatggaaatgtagagatgtagacagatttcagatatatatggaaggtagaattgataggacttgctgatatggggcttgagggaagagagaaccatcaggaatacatctggtagtttggttcgagccactggctctaatataaggaagactggaggagttcaaagaaatgagtcaatgaataatgtgcttacgaaatcattaaacatttaggggttgaataatgttggctgtcagtcctggatatttgaaaatactgtgtgatgaatagcctcattgtagataatcagaatatgtgaaaacgcctattgttaaattggaaggagatttaaagatttgttttagaccataacttatttttaataaggacaactccaaatcacccctaaaaataaatgtgtgacttttgcacaaaaaatcccagagaagagtatttatattctgattcatctttttactacatttacaatcaggaaagtcataatctccaattttagcttcatagctaaaaagtacttctgttatttgtataaagggaaaaatgaataattttttaagttttctttttttctttttcttttttttgagatggagtctcactctgtcttccagactggagtgcagtggcgcgatctctgctcactgcaacctccatctactgggttcaagcgattctcctgcctcagtctcctgaatagttgggactacaggcgcctgccaccatgcctggctaattttttgtatttttagtagagacggggtgtcaccatgttagccaggatggtctcgatctcctgacctcgtgatccgcccacctcagcctcccaaagtgctggaattacaggcgtgagccactgcgcctggctgcggattcctttttaaatttacacataccagtttgattttcctcccaattaacctttgtagaactcggtaacttgattattttaggttaatgtttcaattccaagtttaaccctgaagaattctgatagatagatacagagaatttattaacatctgaatttattaacatttgaaaatatggtcactagatttcaaacgtttatcatatataaaatattttaaatggcagattaaatatctccctgtgattgaaacacagtgacatgtttcaaaataatatttaattatctttttaaaaatcattaattttggaaatctatgactgggatgaaaaatatgttttcaggctcatagtaaatcagtattaaacaagttgcctccctcattccctctctgtctctttctctctcctctcgtgaacacactccgtggcagatggtgcgtgagcagtacactacagccacagaaggcatctgcatagagaggccagagaatcagtatgtctacaaaattggcatttatggctggagaaagcgctgtctctacttgtttgttcttcttttactcatcatcctcgttgtgaatttagctcttacaatttggattcttaaagtgatgtggt

SEQ ID NO: 7598 - DNA, 281 bp, mus musculus
ggtccaaatgtgtcttttctggctttacacagaatattctaggatatatattataatctttgcttttgttgctctcagcccttctattatatttacccataatagtctattatgacctggaaatgttaaacaattttgcaagtttactaagattctgtaccaatgagtcttcaactcaagtagataaaaataatttacactatgttgaggaaaaagactcataaatctaagagtagcatgtcaagcactgtgatagaagtatatgggaatggagaagggtg

SEQ ID NO: 7599 - DNA, 588 bp, mus musculus
gcaggcactggtggggaggatggggaaagggagctaggtttcttgtttgtctctccagaatgcagaacaacgatccatgggtgagagttacagggaatgagtttcagctcaagagaaagaagaactttgaaagttacaatggccagtggaatgggtgttctcatgaagcagtgggttcctccacactagatgtgctcacacacctggctgtccacttgccagaggacatcatagtagatcggcatccagttacatgccctttaaagtcttttttgcctccaaaagtaattgactggttgattgattaaccgcagaagatgtcccgaagaagggtaacttagatttagaatgaaataaaccccaggatttagtacagtggagaggggcagggccagccctcagctgaagaacagtgttgggatgtgatggagaagatgtgttaggggcaacgactggaagagagcaaatgtttatgtccagagcaaaattctgttgtcagaaatggggctttgtatgatgatggatgtgttcacttatccattcactccacaaatattaattttctggtatatttatataatggagtac

SEQ ID NO: 7600 - DNA, 638 bp, mus musculus
ggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaa

SEQ ID NO: 7601 - DNA, 638 bp, mus musculus; identical to SEQ ID NO: 7600

SEQ ID NO: 7602 - DNA, 1105 bp, mus musculus
cccactttcttaattgaccgagtggggttgcacaagtgaatccatacaaaaatggttaatatctttatactccctcttagaattgatcatatgcaaaataattcatacagaactctgtgtttcaaagctggtggaaaagatttgcactctgttcatttcgggtgggaagataaggcacctcattcagaatggatgctccactagcaggtagctcatgtcttggaaatcacgctgcaggctcggccctccaacaagccacatagaattatttaccctaaggtacttggagttttaaaataaattgatccaattaagtcacacaaatagaatttctcaaatccatctagcctgcagccacatttctctggctctctgtgccaaataggatcctggcattactgcttcctatttctctccttcccttttgctccctacagcagtaattttgtgggaagtggcctagtatctttagcatctgagggccgctgccacttctcagagcaagagagatcctctcagggtattcctctgggctgctcatggtggaggtcatgtcgccccgaaggagagaccatggaggatgttccccagaagcaacagcgggaggtggtgttcccggtctctcctcgtctatctacaatgcagcatttgactatatccttcccattttataccttgtgtcccgggcagctcactttggaggcttattgagaacttgagttggtgcacgtcattttgcttgaagcagatgtggcggtcacgcaatgcctttcttcccaggtaccagccagagcagcctaacctggtataccagatggccagtacttccgacgagttagatccagcagaccaaaatgaattggcaagcaccaatgattcccagctgggctttttaccagaggcagagatgttctctttgaaaaccatactctcacccaaaaacatggagccttccaaaatctctgggctaattgtgaacatttcaaccagcctcataggtaagagctagcccttccctggggccttgcttgttggcattgcatggtttctaggcagtggagctggagttgggggaaggtgccagagaagatgagcatctgtcttg

SEQ ID NO: 7603 - DNA, 583 bp, mus musculus
ccctatttctctcctactatcttggtttgatgggctccatgtgagctactcatggaaattcttgaaactagaaagaaaactgattactaagatttataaggttgaaatgatttattcatccctgaaggaaagagacaattcatcacatttcaaaagactggacaatcaagctctgactatatttatatgacatcataaagctgttttcttgaagaatgactaagccgcctgcttaaaaatgagacgacttattctgggcagacattttgaacacgagtattttagaagccagtgtatttttttggccactgaagaccttttcagtggaaaagaaaactcaagagtgtaataattttgactgaatgttgcatatcttttaataaatttatgtggaaaaatgtttattaaacatctagtataggttaagtgttgagctagatgcatcatgttccctgccaactaggggctcacagaggttcacagttgggtagggaaagaaataagtaaataaataattataacaaagtgttaattgctcaaaataaagtcaacccctacctaaaacaagaagttcaaaaatctt

SEQ ID NO: 7604 - DNA, 181 bp, mus musculus
atttaggtattaaaaactataatcaaaggcaaagtgattatcataaaaatcagaataatggtttgttataagtagggagagggttagaatgggaaacatggagtactcctgggatacgtggtaataatttatttctttagctatttagtggttgcaaggatgttcacttcataatagttta

SEQ ID NO: 7605 - DNA, 807 bp, mus musculus
caaaaacagttctatgaggtaggtagtacaattatcatgctaatttttcagatgaggaaaatgaagtacaatgaggtgatatgacttgagcaagttccccagctagtaaaaggcacagagacacttgactctaaggagtccaccattgtcctctacgggatgcaccgtactgcttacacagagaagcctacatgcaataggccttcctttcctctttccattctatttacttgcttcttctttttttttttttttttttttttttttagatggagtctcactctgttgcccaggctggactgcagtggtgtgatcttggctcactacagcctccgcctcccggattcaagcgattctcctgcctcagcctcctgggtagctgggactacaggcacgcgccaccatgcccagctaatttttgtatttttagtagagaccggttttcaccatgttggccaggatggtttcgatctcctgatgggtttgaaagttatgcatgttagaattatgcctaagataagcattaacaagattctgagatggcattctttgagtaaagcataaactttagaacatgtcttctcctttagcaggactggggccttgtttctttttgccctggtttttgtctacctaggttgggctctggacactgaggggtcatggtagtcctcagtcttccctgactcaccgctgggtggcagtacaccacacttcctttattcctgctcttttatgcgtgcgtgtagaagtgggagctctgctttagggaccactctccaattctcaatctcctcttttgctttt

SEQ ID NO: 7606 - DNA, 1449 bp, mus musculus
gaaaggcaacctgggagcggtagttctcctgggcgcctagcattgtcgcccacgctgcagtagcggcttctgcggctccaagccagcgggtcctgtgaaggcgagcagacgcggagaaaggacgcgggagtgagagagggtgagtcagccactgtctaaacgataacgggaggcggttctgcggggtagggttgaattcagtaaatgggctcgtgctgctgtctcttcggagacgctgctatcttagcgtcagcgagggaaggttgaggaggagccagagccgggtcctgcagcgtttctcgccatcagcgcccgtcgccatctccaccatgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggctgctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgatccatactcgggggacctttacaaagtgccgtcacctttga

SEQ ID NO: 7607 - DNA, 1170 bp, mus musculus
ctggaactagatgaaaatcgcttacaatgccaagatgatccgaaacgctttttcaaagggcaggaggagacttgctgtttactgagtgctcactgagagccagcccatgtcctaatttgagtctagggataaaactggaagacagatcgactccttagccggttctttccatgaaaacgttgataatgaatttaaaaagcacgccctcaagtttaacctctcctgtagttggtaacccatctgcattcttttgaacgtcacaaggaagaaacggtgcccggcgcagcttgccctggagcgtagctggagtgcggctgagttttcgctccgctgaagccggttactgtccagtgggatttcgctcaagcctcagcacccccaggaggggaggcgcctgcagcgcgggccgccagcgtttggagggaggcgggtgcgggctgcaccgggagacggcgagagcgagagacaggggcgctgggaggcgtctcccgggacccgcgtctgctcccgtcgccagcgcggtggccagcctagcccagcccagcccgggctttcctcgccgctctccgcgcgcccggccccgggggaggccgctcctttccgcgcggccgcccggtgcccgtgaccacccggcggccgctttcggttccgcgccttataaggcctgacaggggggtcacgtgtgtcccgggccacccgccgggaggaggggcggcgggggggaggggcgggtagcggggaggaaaaggggagggcgccgggggcggaggaaggagcgaggggcggattctgcgcccgtgggaggctgcggcggtggcggggagcggaccgctcggagccgcgcaggggagcgggaccgtggagaaggaggaggcggcggaggaggaagggaccggcgcgggggcgggagagcgcggcggaagccggagacggcgggtgggccggtggctggccccgggcggggagccggggcggcggcggcggcggccgagagggaccgcggcgagggaagcgcatccaggagccccggcgcagcggcggcggcggggacccgggtctgcgcgcccgggcggccggcgggcgcgggctggcgcgatggagcctcagcacgtgcgccccgcgcccggcgcccgcagcccagcgtgggaggaaccggtgggtaccgcgccc

SEQ ID NO: 7608 - DNA, 1438 bp, mus musculus
gagagccagcccatgtcctaatttgagtctagggataaaactggaagacagatcgactccttagccggttctttccatgaaaacgttgataatgaatttaaaaagcacgccctcaagtttaacctctcctgtagttggtaacccatctgcattcttttgaacgtcacaaggaagaaacggtgcccggcgcagcttgccctggagcgtagctggagtgcggctgagttttcgctccgctgaagccggttactgtccagtgggatttcgctcaagcctcagcacccccaggaggggaggcgcctgcagcgcgggccgccagcgtttggagggaggcgggtgcgggctgcaccgggagacggcgagagcgagagacaggggcgctgggaggcgtctcccgggacccgcgtctgctcccgtcgccagcgcggtggccagcctagcccagcccagcccgggctttcctcgccgctctccgcgcgcccggccccgggggaggccgctcctttccgcgcggccgcccggtgcccgtgaccacccggcggccgctttcggttccgcgccttataaggcctgacaggggggtcacgtgtgtcccgggccacccgccgggaggaggggcggcgggggggaggggcgggtagcggggaggaaaaggggagggcgccgggggcggaggaaggagcgaggggcggattctgcgcccgtgggaggctgcggcggtggcggggagcggaccgctcggagccgcgcaggggagcgggaccgtggagaaggaggaggcggcggaggaggaagggaccggcgcgggggcgggagagcgcggcggaagccggagacggcgggtgggccggtggctggccccgggcggggagccggggcggcggcggcggcggccgagagggaccgcggcgagggaagcgcatccaggagccccggcgcagcggcggcggcggggacccgggtctgcgcgcccgggcggccggcgggcgcgggctggcgcgatggagcctcagcacgtgcgccccgcgcccggcgcccgcagcccagcgtgggaggaaccggtgggtaccgcgcccgcgcccaccccctcccgcttctcctttgctccccccgcccgggccgggttccgttcaggaaatggcccgggatgaggtccccagctgcttcccagccgggttagcgcttcctccgccgcccgggctcctcctcgcgcgccgcctggagcgcctttgtccggctgatcgaggctctccccgaggaaccgctggcaaaccgctggcgacggccctgcgaggaccgtttcccggcttcaccgactcctcaacttttcacttgctttgagaccgtggaatgtaggcgggggagaggagaagccaggctgcgcggtcagcgtggggagtctgaggagcccggttttccctgtcgagaccgcgccctg

SEQ ID NO: 7609 - DNA, 1441 bp, mus musculus
tgcattcttttgaacgtcacaaggaagaaacggtgcccggcgcagcttgccctggagcgtagctggagtgcggctgagttttcgctccgctgaagccggttactgtccagtgggatttcgctcaagcctcagcacccccaggaggggaggcgcctgcagcgcgggccgccagcgtttggagggaggcgggtgcgggctgcaccgggagacggcgagagcgagagacaggggcgctgggaggcgtctcccgggacccgcgtctgctcccgtcgccagcgcggtggccagcctagcccagcccagcccgggctttcctcgccgctctccgcgcgcccggccccgggggaggccgctcctttccgcgcggccgcccggtgcccgtgaccacccggcggccgctttcggttccgcgccttataaggcctgacaggggggtcacgtgtgtcccgggccacccgccgggaggaggggcggcgggggggaggggcgggtagcggggaggaaaaggggagggcgccgggggcggaggaaggagcgaggggcggattctgcgcccgtgggaggctgcggcggtggcggggagcggaccgctcggagccgcgcaggggagcgggaccgtggagaaggaggaggcggcggaggaggaagggaccggcgcgggggcgggagagcgcggcggaagccggagacggcgggtgggccggtggctggccccgggcggggagccggggcggcggcggcggcggccgagagggaccgcggcgagggaagcgcatccaggagccccggcgcagcggcggcggcggggacccgggtctgcgcgcccgggcggccggcgggcgcgggctggcgcgatggagcctcagcacgtgcgccccgcgcccggcgcccgcagcccagcgtgggaggaaccggtgggtaccgcgcccgcgcccaccccctcccgcttctcctttgctccccccgcccgggccgggttccgttcaggaaatggcccgggatgaggtccccagctgcttcccagccgggttagcgcttcctccgccgcccgggctcctcctcgcgcgccgcctggagcgcctttgtccggctgatcgaggctctccccgaggaaccgctggcaaaccgctggcgacggccctgcgaggaccgtttcccggcttcaccgactcctcaacttttcacttgctttgagaccgtggaatgtaggcgggggagaggagaagccaggctgcgcggtcagcgtggggagtctgaggagcccggttttccctgtcgagaccgcgccctggtcgtcacctgggcgcgcaggttcccggggacacgcgcctggagaggctgagcgcggcgcggagcccagaaccacgcctccgactcctgccagccgctaaagcttgggcgtctggagggtgcaacgggttttgccggggacgaagcagaa

SEQ ID NO: 7610 - DNA, 1378 bp, mus musculus
acaggggcgctgggaggcgtctcccgggacccgcgtctgctcccgtcgccagcgcggtggccagcctagcccagcccagcccgggctttcctcgccgctctccgcgcgcccggccccgggggaggccgctcctttccgcgcggccgcccggtgcccgtgaccacccggcggccgctttcggttccgcgccttataaggcctgacaggggggtcacgtgtgtcccgggccacccgccgggaggaggggcggcgggggggaggggcgggtagcggggaggaaaaggggagggcgccgggggcggaggaaggagcgaggggcggattctgcgcccgtgggaggctgcggcggtggcggggagcggaccgctcggagccgcgcaggggagcgggaccgtggagaaggaggaggcggcggaggaggaagggaccggcgcgggggcgggagagcgcggcggaagccggagacggcgggtgggccggtggctggccccgggcggggagccggggcggcggcggcggcggccgagagggaccgcggcgagggaagcgcatccaggagccccggcgcagcggcggcggcggggacccgggtctgcgcgcccgggcggccggcgggcgcgggctggcgcgatggagcctcagcacgtgcgccccgcgcccggcgcccgcagcccagcgtgggaggaaccggtgggtaccgcgcccgcgcccaccccctcccgcttctcctttgctccccccgcccgggccgggttccgttcaggaaatggcccgggatgaggtccccagctgcttcccagccgggttagcgcttcctccgccgcccgggctcctcctcgcgcgccgcctggagcgcctttgtccggctgatcgaggctctccccgaggaaccgctggcaaaccgctggcgacggccctgcgaggaccgtttcccggcttcaccgactcctcaacttttcacttgctttgagaccgtggaatgtaggcgggggagaggagaagccaggctgcgcggtcagcgtggggagtctgaggagcccggttttccctgtcgagaccgcgccctggtcgtcacctgggcgcgcaggttcccggggacacgcgcctggagaggctgagcgcggcgcggagcccagaaccacgcctccgactcctgccagccgctaaagcttgggcgtctggagggtgcaacgggttttgccggggacgaagcagaaagctgacttcgctttcgcctgggatttcgctgcacacgcaacgcggaggttgagtaattttaggaaccaagagtagtgtgtgtgcgtgtcttaagtgtgcgaggataaggaggaagagaccagggggctttggatttgttccctcaaactccctcaacttc

SEQ ID NO: 7611 - DNA, 1112 bp, mus musculus
ggggatcgctctttctgaacgaaaagttctcagagcggagctgaacctcccggaaaatgctcttctcttccgtgtgcgccggatgggggtgggggtgggccagaaactgaacgccgccgtcaggagagctgaggggacccgacggccctggcggaggcgggagaggtacggtcctcggagtggggctgggggtggggaaaccgacgaggggcagcccccgactgtcttggtggcagaggggacttttattcagctggaaccgcgcggcgaggcccaagtgtctctggagagattcggggttcaggaggtggcgggtgcacccaagggtgctgggaggaagctccaggttcccattcttccccagggatcggcgttgcccctgctgtccagaagtgagagggggtgtgcgggcatcgccactacggggtgggctgcagaggtttcctgcctcccccaccctcctgtccatcctagggacccagaccgtaagggagtggaagagatgttgctccaaaccctgtcaccccatcctctctacccgcgctggtcctatccgaggctgggtgcgcaggggtccgaggcgggcgggggtccgttacctctgcgtcccaccgtggccgccgctccggcgggaaccgagcggaggagccgggtggacccctgcctggagggcgcctgccccgggcgacccttacctcgcgggggtagctagggaaacggaagatggcggcggcggccgggcacggggttccgggctccgctcgggcagagcccacccgctgaccaacgccgccgcccccgccgggcggtgctgtgtccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaaggtagggcggaggaggcgggcctgagggccgcgtggaaagcgggaggtggagagggcgcgggggcgctggaacgcgccgggcga

SEQ ID NO: 7612 - DNA, 1112 bp, mus musculus; identical to SEQ ID NO: 7611

SEQ ID NO: 7613 - DNA, 1111 bp, mus musculus
ggtcctcggagtggggctgggggtggggaaaccgacgaggggcagcccccgactgtcttggtggcagaggggacttttattcagctggaaccgcgcggcgaggcccaagtgtctctggagagattcggggttcaggaggtggcgggtgcacccaagggtgctgggaggaagctccaggttcccattcttccccagggatcggcgttgcccctgctgtccagaagtgagagggggtgtgcgggcatcgccactacggggtgggctgcagaggtttcctgcctcccccaccctcctgtccatcctagggacccagaccgtaagggagtggaagagatgttgctccaaaccctgtcaccccatcctctctacccgcgctggtcctatccgaggctgggtgcgcaggggtccgaggcgggcgggggtccgttacctctgcgtcccaccgtggccgccgctccggcgggaaccgagcggaggagccgggtggacccctgcctggagggcgcctgccccgggcgacccttacctcgcgggggtagctagggaaacggaagatggcggcggcggccgggcacggggttccgggctccgctcgggcagagcccacccgctgaccaacgccgccgcccccgccgggcggtgctgtgtccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaaggtagggcggaggaggcgggcctgagggccgcgtggaaagcgggaggtggagagggcgcgggggcgctggaacgcgccgggcgatcccgggaaggcggggaaggcggggaaggcggggaaggcggggaaggcggggaaggcggggaaggcggggaaggcggggaaggcggggatggtgagacggtgaggcggggcggggcctggggcgcgggcggggcggggaggggtggggcggggcccgggggcgctgga

SEQ ID NO: 7614 - DNA, 1111 bp, mus musculus; identical to SEQ ID NO: 7613

SEQ ID NO: 7615 - DNA, 830 bp, mus musculus
tcagtaggtcaaaactggtcaaatatggaatgcttcatatggttcaatctaatatgtcatcatttaaccagttttttgcagaagtaaatatgggttgttttaggacaatgcactaatctcagctttttcatagtggatttgatggtttttaagtaaagaatggaactggtatgcttttgaaatcagtgtggcttaataaaatcctcatgtgtattttagcaccctcatcataactccatacagtatactttttgttccccttttcattttccatttattcctggtttctttgtatgtctatgctgtcctctctactattttcctcttcctctgttttgaactttttcctttctctgaataacctaagtggaatttcaggtggtctcatctagccactcaggtgctaaacactaaatgattttatgcctgcctttatttcccaaagacaaaaagtcacttatgtacaaaagtgaaagtggtgctgatgcaggaaagccaaaatggagtcctaacacttgtcatatctcttccccctctttaccttcttgagtttttggatttgcattcagacatactgttgtagagaatttcacaggtatttactgagaataagatatttttgaaacaacgctaatacagattcagacaaattgggttttgaggatgaatgtgaaagaagctttgtgtgttttttgttggcccatgaatactgcaacctttcattttatgggaatggctggaagaaacttggtcaggcttacagcctaggattgttcaacaatcataaaccaaacagtataaacaaatgggaaccatctcaatgacttttt

SEQ ID NO: 7616 - DNA, 830 bp, mus musculus; identical to SEQ ID NO: 7615

SEQ ID NO: 7617 - DNA, 680 bp, mus musculus
tatgcttttgaaatcagtgtggcttaataaaatcctcatgtgtattttagcaccctcatcataactccatacagtatactttttgttccccttttcattttccatttattcctggtttctttgtatgtctatgctgtcctctctactattttcctcttcctctgttttgaactttttcctttctctgaataacctaagtggaatttcaggtggtctcatctagccactcaggtgctaaacactaaatgattttatgcctgcctttatttcccaaagacaaaaagtcacttatgtacaaaagtgaaagtggtgctgatgcaggaaagccaaaatggagtcctaacacttgtcatatctcttccccctctttaccttcttgagtttttggatttgcattcagacatactgttgtagagaatttcacaggtatttactgagaataagatatttttgaaacaacgctaatacagattcagacaaattgggttttgaggatgaatgtgaaagaagctttgtgtgttttttgttggcccatgaatactgcaacctttcattttatgggaatggctggaagaaacttggtcaggcttacagcctaggattgttcaacaatcataaaccaaacagtataaacaaatgggaaccatctcaatgactttttctgcctttgggtcatctcg

SEQ ID NO: 7618 - DNA, 680 bp, mus musculus; identical to SEQ ID NO: 7617

SEQ ID NO: 7619 - DNA, 115 bp, mus musculus
tcaaatcaacaaagtttctaatagagaagtagaagaaatatcttttgagatgtaagtagcttggtctgtcttctaaagtaatacatacctgttaaacttgaggtatttttttcat

SEQ ID NO: 7620 - DNA, 814 bp, mus musculus
agcatggaaattaggttttatttattatataaagaagcagtttgcttaaggaagatgattcctgtttggatgtaatttatagatttgttagaaatagaactgcttgaactaacagtggtttttcccatagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacaggtaacctaggaaccccatgtagaatttcagctttattcgcagctgcccttgagaacattgtttaattggttgagagttgctagctcttcctgtgaaattgactatgttttggataccataaaacatgaatgtatctgaatgccagcataaggtgatgtggcagatggaatctaggaatcattggcattttagatgtatgaatgacaacgctgtaagcccagtaaacactgacgaactgattgtggactttggcaagtctgtctgaactttggattcttgatctatgaattgaaagactaaaccttgtgtccaacatccccccgccaactcttagcattctgtgattcttacactaaagagtgactgatggctgtagttggcattagtagtagggattagccacttcataagggattgactagaaaaattccttgctctgagtgaagcaaggaggaaaaaaggaagaaaataaataaaacttctccccaaaaggttgtaaccatggatttgtagtttaattcacatcaagactg

SEQ ID NO: 7621 - DNA, 629 bp, mus musculus
acccctcaaaaatgaaaacaaagaaaatatttactgaattacgaatcaattttaaaggttgtgatagtgacctcataacttctaccagttcaacctcataactttaatcagttctttgtttttaaaaagtaaattgagtcacagtgaaatattggaggttaaaagccaaaagcagttttagcataactagagaaatgcagggaatctatcaagaaatgagaactagcaagagacatttaaattatgcaacttgctttttaaaaagttgaagtaatctgttcataaacaaggtaatttggtttcaattttagcagcctaaatatttactagaatgtgctaaccagattttgctattttcttcctctgaatcttccttgttctttattcatgtatttcttcattcagcaactatgagctgagaatatgatgtgcgaacagccttgtgctgtgagcagaagaggtacaataaaataaaagcctgagaatcctgctcctattccctgagttggatttatctaatttctaacattataagaaactaataccaatatatgaaggacttaaataagtactaagaaaataaaaaccttttaggatctcagatttctcttgtttcatttataaatgta

SEQ ID NO: 7622 - DNA, 782 bp, mus musculus
tcaatcgtcatatattttaatttaattttcttattctgtgatcatatttagcagacccagagtgcttctcgttttcatttctgaaggatgtgtatgttttctaggaaatttttatctcctgtttattgcctgttttaacttatctcaaatatttatagtctttattaggattttttattactaatattttaaaacaacccaaataatgtttgagtcactctttgcttatgagcctatatatagattaacctcatgactaagtcaacatggatggtttccagaactaagtggctctttcttaccctgggaatcttccagctgattactgatcctctgtgttgtctttaacagaacttcatccatgataagttgtccaatgtcagactttttgtttgctgcaaattaagaataaggggacaggttatatttacccaggagagaaggagtaaaactccactggatatcttttgaggaactggccctatttccatttttgtttagtgatatctcagtgctgtgccttaaactttgttaatttggattaactggggagaatataagtttgaactccaaaacatattaaaacaaatgctttttttttgcatttaagagcatctagactgaaacttgggatattttgctaaatgttgtccaaggaattttcagttggctagataagaatagtggtatataaatgttgccactaagggtttttagtatttaaaaataccatttgctttcgttgtgtgccacaacctctcccactttccacccccaggcct

SEQ ID NO: 7623 - DNA, 601 bp, mus musculus
tctttatatcatcttccctgtctatgtgtctgtgtttaaatttccttttattataagaacactcatcatattgaattagggcccactctaatgacctcatcttaacttcattagctctataaagacctaatctgcaaataaggtcacatttcaacctaaaacaattaccaggaagggaaaatacattggtaagcatttcacaatatttctgttatcccatcacattaaatctgtacattaggatggagcaagaatgctgttagtactctggggatgattgcctttgatggctttaaatgtaattgaaagttgtcttagcattttcttatactgtcactgacactctaaggtaataactctattagtgaagatttggactggggtgtaactggaaggggcaaaccctttgctacatgaggttcctgatcttttaaaaagtaagaaaagggggccaagagatgaagccgatgttatatttttcccaggtaaacttgacactacgtcaacccctgctacatcttagtaggagagctgaagggagagtatttgagccaatgaataggcagcagtgagtagagctgatggtggaggattaggcaag

SEQ ID NO: 7624 - DNA, 233 bp, mus musculus
atttcattatccttgttggttttcctccaaggtcttatagcattcttttcttttttttcctatttactttcacaaagagaggatttttgtttagggaatcctgtgtattgtcatgattgtgaggcttgtacatttagagggcgattgttacatcctctggaatcagatactcctctgaaagaacttcattatagattttaacatttcatattattgaacatccatcttcacca

SEQ ID NO: 7625 - DNA, 698 bp, mus musculus
catcagacgggcttttggttaaacaaagagaaaattttttaattaaaaaattgtaattagaggatctactgaggaacattctgtggaactcatatacatgttttaagtgaagcagccagatgcaaaacagctatatgctgtatgattccacttatattctgttctggaaaaaagtccagagaagataaccatagggttcagggatttggggtgagatgagggaaatcccacaaaggagcagcaaaagggaatttttagggagtgatggagctgttctgtatcatgattatagtaatggttgtaaagctctatcagatttcagaacacatggaaatataaattgctaacaacatttttctgtatgaaaatatacaaataatttataaaatttctaattagcattctcacaaagactagggaaggtagcacttttttaaagaagaaaccagaagcttctgggaagaagaaacattcagaaaacaggagccaaatataaatttctctaaatattactgttgaattgtttttttaaaaaacaactaagaagccctccgtttccctctgtgtgtgtgcgtgcatgtgtgcatgcatgtgtatatgtatgttggtgggagaaggacattttgagaaagaagtcttttaggtgacttattatagtggttgtgggagaagtttaaaatgtacataggaaaataaag

SEQ ID NO: 7626 - DNA, 745 bp, mus musculus
cactctgagtgatatcagtagtgctaagtactagggtttgtagtttgtagtgtagtttatataagatgaagtatgaactttggaactttaattttctgattttatggatgatgttttttctctctgcagcatgctaagaagggaattgtatatcatcaccattatgatactattactgtggagttggtttacttctcttgattcaaatctctctttaagaatgtgtaaaatacttatggccatcacagggctatttgtgctcttaaattaccaaataatatatgtttcaaaaatcatggctcatgtaacaatacctttgttttcactaaggaaaatgtatgttttatggaaccctccttaatttcaaaattagaatgcccataacattctattacattatatacagaatagagcctagtaaaaaatactgtgagaagcttgtacttctccaaaacagagacttcttgaatccgcatattttgtgatctaatctttaggatacgaatatatttcttgcgcactaaatcttcattcattctatcaatgaatgttcactttctttctcattttgagagctaaatgtaaggtgtaaaggaaataaataagttggggaattattataggagagaataagattggcagaataagtcacttattgcattagtggcatctgcctaaaatcattcaccacttcaaataccacaaaccacaaaccatagtacctagcactgctgatatcactcag

SEQ ID NO: 7627 - DNA, 13653 bp, mus musculus
caatatgatattaaattcgaatatgagatacaataaaaccatttttagttttttaagattgttacattaggtgtcaaaacaataccagcaaaattttaaaataaagagcaatgtagatcaaacatgataaattgccttccaaaagagaatgctaaaaaaatagaaaataaattcactatgaaaataaaatgcacatttaaacagaaaagattgtctgcatagcccaactttatgagatctctgtaatttcacatatcatgacttatagatggcatatgatatttgacataggaagaatttgaaatgaagaatccaatctagaatgtaatattgtaagaaaacataagcaaactgcttgctgagccaaggtattttatttcctaataattaaaataaaaattatactacgattttgtattttcaaaaaatttgcatggatacatagtaggtatatatgtttatgggtttcatgagtttatttgatacaggaatacaatgtataataatcaaatcagagtaaatggggaatacagcacctcaagcatttatcctttgtgttacaaacaatctaattatactcctttagttatttttaaatgtacaataaattattgttgaccatagataccctattttgctatcaaacactagatcttagtcattctatctaattataattttgtacctgttaaccattctccccaccttcaccaactacccttcccagcctctagtaaccatcattctactctttatctccatgagtgtaattgttttaatttttagattctatacataagtgagaacatgcaaaatttgtcttcctgtgcctagcttatttcacttaacataatgacctccagttccatccatgtggtttcaaatgacagaatctgttttttatggatggatagtattcatcacgcatgtgcaccacatgttctttgtccatatgtctgttgatggatatttacattgcttccaaatcagctattgtgaatagtgctgcaataaacatgggagtgcagatatctctttgatatactgattccctttcttttgggtatgttacccaccagtgagattgctggatcatgtgatagttctatttttagtttttgaggaacctccaaattgttctccatagttgttgtactagtttacattcccaccaacactgtatgatggttctcattttccacatcctcacccacatttgttactgcctatcttttggataaaagccattttaactagggtgagatgatatctcattgtggttttgatttgcatttctctaatgattaatgatattcagcaccttttcacatgcatctttgccatttatatgcttctttgagaaatatctgttcatatcttttgccaatttaaataattataaattattatatttttacatactgagcttttaaagcttcttatatactctggctattaatcccttgtcagataggtactttgcaaatatttcctttcattctgtgtttgctttgttgttgtttcctttgctgtgcagaagctttttaacttgatgtgatcctatttgtccatatttgcttttgttgccggtgcttgtgaggtattactcaagaaaactttgcccagtccaaggttctggagagtttctccagttttattttagtagtgtcatagtttgaggtcttaaatgtaagtattcaatccatttaatttgatttttgaaaaaggcgagacacagtctattttcatccttttgcatatggataaacagctttcccagcaagattaattgaagagactgtcctttccccaatgtacgttcatggcatcttcactgaaaattagtttactgtagatttatggatttatttctgggttctcaattctgtttcaatggtctatgtgtctctttttatgccaataccatgatgttttcgttattatagctctgtagtataacttgaagtcaggtaacgtgatgtctacagctttgttctttttgcttaggatcgatttggctattctatcttttgtgcttctatgtaaatattaagatttttttatattactgtgaagaatgtaattggtatttttacagggattgcattgaatctgcagactgcttttggtggaatgaacttattaacaacactgattcttccaattcatgaacatggaatatctttccaattttttgtccccttcaattttttgtttcaatgttttctagttttcattgtagagctctttcacttcattgcttaagtttattcctagtattttagtttatttgtagctatataaatgaaaaaaattgatttatttttcagattgtttgctgttggcatatagaaatgttattcattttggtaaattgatttttcatcctgcagctttactgaatgtttatcagttctaatagtttttttacggcatgcttaggttttcccaaatataaggataacttgacttctccttttccaatttggaagccatttatttctttctcttgtctgactgctctagctagaactttcattactacgttgaataacagtggcaaaagtgggcattcttgccaagttccaagtcttagaggaaaggctttcagttttcccctttcaatatgacactacctgtgggtctgttgtatatggtttttattgtgttatgttccttctctattcgtttttttgaggatttttatcatgaacttctgttaaattttatcaaacgatttttcagcaccaattgaaatgatcacatggtttttttagtccttcattctgttgacataatgtatcacattgatttgcatatgtgagccatccttgcatctgtggaataaatcctacttggttaagatgaatgatctttttattgtgtttttgaattcaagttggtagtgttttgttagagatttttgcatcaatgttcatcaaggacattggcctgtagttttcttgtcctgatgtgtctttgtttggtttcattatcagggtaatagtggtttcatagaataagtttgaaagtattccctcctcctctattttcagaatagttttgagtaggattggtttcaattatttaaatatctggtaaaatttagcagtgaagtaattggattcctggctttactttgctggaaaactttttattatgactttaatcaatttggtgtttctgaaagaagaaggattggtggaggcttctatttggccatctttgtctcttcttcctgtgacttagtattttaattagcaaatgtagataaattagaataaagtaaaatttactttttggtcaaatgtttaaaaaggtcaatttaaattagtggacaatttaaatcataaagcttttgaaggcatgtaatttatataaaatataaaaacaaataatttcttttgatcagtaaattgttatttacttaaattctaagaatatttattttatatttatttatttaactaatattcattgataacttataatagctaaatatattgaatgaatgattaagtagatgtttgaaatatgaaaatgcttgcattttgttgagtagttgatgaggattaacctctgtgattagttaaatatgtttgtattttttgatcggtatcaccatttacttctaggcaggttgttttattccttagatactctttttgattacataagataaagaatagcaatatatatttcaaaaggctgataaaaatatcaaataaaagatgtaatgtttctaggcaagtgcgtggcttatggtagtagattaattaatgcaattatctttaacattactatttattcaaaactgtgtgagaatccttgaaaacactaccatcctaatctttaaatatggcaaatataaaataatttgtcttgaatattgtatatagtgtttagttaaacatgaattaaatgaacacacaaatacattatagacaatatattaagccataaaaaatgccagtcaacataagaatctatatgtagcatttgcacactggaattatgtttcttcaaatatgtttatgagttagtagagttactttatcaaaaatgggtttaaaaaacatgagattatgtcatatgatttaatatcaatgtttgcatttcaatagtgacatggttaagctaaaatatcttagcttatgaatacaaatgacagaacatctagtattaaacattcccatttgttgtcaagatattgtattattatcattttcaaaacctccgataatttatttcccagctatttcatgtttctttgttcttcacctctgatttatgattacagtaaactatgcttatctttctatctttgatactatagtacataataatttgaaaataatatttttcacagattcacttgtatagagacaaggttcaatagggctcatttatataaaatgcacatttgcttctgttgattaataaccaagtgtagactatatttttcatcataccactttcatttgcatttgtaactgagatttcataagatagtcaataaatacaatttacttaaaataatacttcaaagcagattcttagatgtgagtataatagttcatattatatttcttctgtctagataagtagtcttatctctcgtcttaaatttaaaaaaaaaaaaaaccatattgacatgcacaggaaaattattccaaatacattcatcatctaaaatgttttaaaacctaattgtaagatatttgaagatctcagatgcagttttcttagtcaatttttcacttacattaacttttaaaatgggaatttgataggtttcttaaagcatactgctgctttgctgatgtcaagaagttctaaatcttctactctttgagaaaaataatgttaaacacaatttttattcaaccaacttctttaaaattgtgctctgcaagaaagagctccagaaatattacatacaatttctctttctttttaattcacatatgtagataactttcaattttattatatgttaaatttttaaaaaacattttcaaatgtgagaacttgacacattaaaaatagaatcaatgtgataaataaaactacctgctttatctcacattccataatgaaaacttttggtttcatgtattaagcactgtgacaaattctgccagacagagtatgtaaagagaaaagaggagttgaaggagcaagttagtttttcatcttagtgtgtcttctcatgcacattacatttactacatatgaggattagtcttctgcttcataaactgggaattataatgattgtctctactcattcatagggataccataaagatgcattaatgcataccaaaacgttttgtaagtcgagagttaacgtaaatacaagatgttattgtttctaaggtattgctcagaaaagaaatagtacaaagtggattctactataaacctaattatattggtgatttctaatggcttaatatgatgacattttaaaaaatctatttgatatcagtgttttctatcaccaggatcttaatgaccaagaaaggagaggtttattaatccaaacttgttgatctttctgttttcaatgacctacgaataagcagaattttatcctgcatcctattatgttctaagccctttgggtctaatgttataattgtgtttgtaaaccagctggtcacaatgattaaaatgatgttgaaatgaagtctggccttaggaacattttcacactaattccggctgtcaaagcacaatctttggtaccaagcaggacatgcccctgttcctatggtgaataattataaaccatattagaatagcatagaaaataatataattttagaatataaattgaaatatgatagtaaatagactacttaatagcaaattaaccatttatattagaagtaaaataggtgctaaagatattttattacttaatttatttaaaatatattcattgataatttataatagctcaatggactattaaattaagtgtcatgtaggcattctcctctaatttaatgaagaaaccgaatatcatattgacaatgagacaaaacatcagataatggtacttttaatatatataggagcaaataggagaaacttctacataaagagataaaagtcaaaaaagtcatctcagaaaaaaaattacttgacttttaaaaataaggagcaattaacacaatgaagggaaaggtcagagggaaaatatactagaaggaacaagggtctgaaacagttggcatatttaaagaaatgttacttcatatgtttaatttttataatcatttcatcccgttctgttaaattaaagtaaattagacttagtgcttctagacataatatacataaggccaccattcatactttcaaaacaggtaaacattctttattttataatttgtctgagctcacagaaagtgtattttgttgagagtagtcaaaacaaaaagtatgtaatcacataatgagttaaagtggttacttttatgtcaactcaatctatttttttcttttagtggtaaatacacggtccttttaaattcccctactgtttcatacaaaacaaaattatactaaataaaggaaattattttagtggtatagtttacagtcatcaatctttttcttctgtattatttcatatgtatgtttttcctttttgcttttatttgttttgcaccttgagattttattagcaggttatttttagaatattatgtgctgttgaatgatgtcatgtattatctttactttttttttttctttgtttttgagaaggagtcttgctctgtcacccaggctggagtgcagtggtgcgatctcgactcactgcaagctccgcctcctgggttcacgccattctcctacatcagcctcccgagtagctgggactacgggtgcccaccaccactcccggctaatttttttttttttttttttttggtatttttagtagacacggggtttcaccatgttagccaggatggtctcaatctcccaactttgggatccaccctcctcagcctcccaaagttctgggattacaggcatgagcaccgtgccgggccttatgtttacttttttttttttaacttgagaagaatttttttctttctaaagttcagaaacaattagattcaataataactcatttcagtttgtgtgtatcaacacagacaagaatttaggattttatggctctttgaaatatacctttctggtaacagacttttagagaacattctatttagtgaccatagaggcatttgtcagctctttgttacttccatataatacattgaatttttatttgaatataataaataaagagatggacttgcatttattgtttttattcatcaaaaatggaattcattttgttcttaaagtatctatagacattttggagacatgaaggatttagaaatttggaagctttgaagtagatagctatagtaaagttcccactatcaatcattttgtcataaattatcccaatcgaaggttagaggagagaatatacaagccagagtttgtggcagaaaatttaagtttgtggttatagacatagttataagatatttatatcagaatccttttgctttaccacaattttatttaggcaaatcttactgaattacattttacatatattacaataggtaatttaaaaattgtatgggttcattgatgtcacagagatgatgaataaggcagctccaaaatttgtttcctacactgaagcaactttctacatggcataaaatgaccaaatcaatttttggaactatagaaagtaatcagatacttataggaaacagggtagtacctattaacaatgaggttactaaacgttaataagaaagcattgatatgcatatgcactaaacaacacagcccaaaatatattacgcaaatattgacagaattgaagggagaaataggcaggtatataatagtagttaaaaatggtaacacatatctttcattaatgaatagaacatctaggtggaaaataaataaagcaaaatcgagagcttgaaaactattgtaaataaactagacctaacaataacatataaaacactttagccaacaacagaagaatacacatttttaaagtgcatatggaattacagctgtgtaggccagatattaagttacaataaaagttgtcaataaatttaaaaattgatattatactaagtataatctcagaccacaatggaagaaatctggaagttaaaaacaaaaagaaaacaggaaaatgcacaaatgttgtgtaaaccacacactactaaataatcaatgggtaaaaacatttataaaaataagtagaaaatacacaaagacaaaaaacatagcataccaaaacttatgggatgcaatgaaaccaatgttcaatgagaaatttagagctgtcaatgcctacattagaaaaaaaatctaaaatcaataacataattttacattttgtagaactagacaatgtatagcaaactaaaatcattgctgagaaataataaggatcaaagaagagagaaaagaaatagattatttttaaaaaataagtttgggagaattaatacaactaggagttgttctttaaaaagattaataaaattggcaaagctttagctaaatattaagaaaatagaaaaaagatagaaataactaaaagcagacatgaaagtggagatactacttccaagcttacaaaaaggattacaaaagtactataaacaattatatgtcaacaaattaaataactaagatcaatttgataaatttagaaacacaattgttacctatcagaatcaagaaaaaattaaaaaaactcaacaccttaaaaaagtaaaggagttgaatctgcaattgtacacatccgaacaaacgaaatgtccagggacagatggcttcactttaaatgctaccaaatatttaaagataaattaacaatacctctcaaaatcttcaaaagttctataaaaatggaccactttccaactcattttatgatgtcagcattaccctgattccaaagccagaaaactaaatcacaagataaaataattacagaccaatatcccttatgaatataaatttttaaaatctcaataaaacatgaaaaaataaacctaacagaatatcttttaaaagtatagagcatgacaaaagtagaatttagcccaggaatgcatgggcagttcaatataagaaaataatcactgagatgcatcccatcagtaaaaaaatattaaaaaacacacatgaaaatctaaataagcagaataggcacctgtcaatattcaaccctcttccatgataaaaacacttagaaaactagaaatagaagagaacttcaacataatgaagggcttttactaaaaagcggagctaacatcatgctcaatggtcaagggctgatagcttcttcctaaatataggaaaaagacaaaaataatcccttacaactttgctaatcagccttgtattggaagttgtaaccagaaccatttattaaaaaaaaaaaagctatccaaactgcaaaaggaaatgtaaaactatattcacaggtgacttgctcttatatataggatatcccacagaatccacaaagaaagatgtcagagctgataaaacaaattcatcagtgttgcaaagcatgatattaacatgcaaaaagtggttgcatttgaacgtgtccacaaagaatataattgaaaaggaaattcagcgaacatttctatttacaaaagcattcaaaagtttaaaacaactagcattaaatgtcgccaagatttgtaagacttaaaattaaatgaacaaacaaaaaacctggccaggggtggtgggtcacgcctgtaatcccagcactttgggagattgaggcgggtggatcacctgaggtcaggaattcgagaccagcctggccaacatggtaaaaccccatctctactaaaaatacaaaattagcctggtgtggtagaatgcacttgtagtcccagctactcaggaggcggaggcaggagaatctcttgaatctgggaagcagaggttgcattgaacaaagatcatggcactgcaccagaacaagaatccttttcaaaaaagaaaacctattaacttgtcatttagcattaggtatatctcctaaagctatccctcaccagcatggcacatgtatacatatgtaactaacctgcacattgtgcacatgtaccctaaaacttaaagtataataataataaaatttaaaaaaaaactataagacattgctagaataaattaacaaacagaacaaatggaatgtatcccaattttatggattagaagttgtaatattgttatgatagcaagaaatccagagcaaccaacaaatttaacataattcctaccaacattcaaatactaatttttttgcagaaatagaaaagccgactttcaaatttatatggaattataatgggcaaaagcagtgttggaaaataaaaggcaacattagagatctcacttttcccagtttcagaacttactacaaatgctctgaaaacaacattatgaggctgacataaggataggcataaaaactaatgggagagaattcaaaattcaaaaataaacctatatgtccatagccaattgacttctttttaaagagtcccaagaaaacttaataggggagaatattctgttcaatgaataatgtttagataactgaattttcacatatagaagaataaagatttaaccatatttcacacaatatacaaaaatcaatgcaaaatgtatcaatgacctaaatataagagatgaaagtataaaaccattggaagaaaatatatgacatacatggataaattttcatgacctagatttaggcaactagattttagatatgacaccagaagcatgagaaacaacaacaaaaaatggataaaataaaacatttacaaacaatatatgtgataaggttagattttcagaatataaacagagttagtacaaattaacaacaaaaagtactccaaacaactcaaataatgggaggagaaattagctatttctccaaagaatatatcaatttcccaaaaacacatgaaaaatgctccatcaatgtcatttgtcaacaggaaaactcacatcaaagccacaatgaaatacaactgttcattaactagaatgtctagaattttttccaaaatagaaaataacaaatggtgagagtgtgcaaaaattgtaagcctcacctatcgctggtgggaatgtaaaatgaagcagctacagcagaaaaaagttaagtctaagaagataaacatagcattagcatttgtctcagcaaattcacacatagataaatacatgaaagaacaaaaaataggccaggtccagtggctcacaccagtaattccagctttgggaggccaaggcgggaggctctcatgggcacaggagttcaagaccagactgggcaatatggcaggactccatctctataaaataaaataaaagttagccaggcttggtggtactcatctgtagtcccagctactcaggaggctgaggtgggagaatcacataagcttgggaaattgaggctgcaatgagccatgaacatgacactacactccagcctaggtaacagaccaagacccagtctcaaaaaaattatatatatatgtatatacacataatgtttatatatatatatgtatatataaacattaaaccaaaaagtatacttgtaggtgaatgttcatcgcagcattagttaccatagtcagaagatagaaacaacttaagtgtccatcaaaagctgaatggttaagtgaatttttatgtatatacaataaaacatgaagaagtcataaaaagaatgaagttttaatacatgctacataatgaatgaaccttgaataaaacagtctctattcacaaataacataatcctatagagaaatctcaaatgattcacaccaaaattgctagagctaataaatgaatgaagcagagttgcaggatgcaacaccaaacaccaaaatcatttatgcttttaaacaccagcagtaaacaatctggaaaggaactcagaaagcaattccatttacaacagtatctaaacatctaaaattactaaatttaaatttaacaaagcaggtgaaagacttgtgcgttgaaagcaacaaaatattgccaaaagaaattaaagaaaacctaaataaacaaaaagacaactcatgttcatggatttaatgactcattgttaagatggcaatgatataccaagccaccttgagatagaaattgttgcataattagcaacagatgatggttacacagcattacgaatgtataaaacggtactaaatattcactttaaaatgggtaatgatatgtattaatatgtaaatttcaactcagtttaaaagaagatgaaataaaaaatttgcattggatcattcagttacatatctcctaaaatttatgaagtttaagagtgttgcagaagcacaaaattaactaaagcactgatatatagaatgcataactcatggtaaaatgtaaggtattctgacatagcccctcttcatttttaacattttcagggctatgtgtgatgcttgataacccttgtttgatcttttctttcttataaatgcttttctctaagtgaaagcttttagagcattaaaaatgtatgctctatttataattaatattttgttgatacagatgaaaagagttacatatcatcttacatagtatttatgaattgtacaattttatgtctgataatcacatactgaacaatattgggtaaaaattttggatttcaatgtatcatattaatttcacaaatgcagagatttattagaggaagataaatgtttatatctgaactagtaatgagtgatgagatgctatgaacttctgggaaaaaatatacttgaatacagttattccataaggcacagtcacctacaggtaactgttttggttgtttgtttgtttgtttgtttctaatggtttgcttctgttcttacattgatggttgatagcaaattggtagccactatgttctgtgtcccccccaaatttatatgttgaaacctagttaccaaagtgatggtattagaagatgaggcctttgggaggtcattcaattatgaaggctcattagcagccttatgaaagatgcctcagagagtaaccttacctctcccaccatgtgaaaacacaaggaaaagagatcatctacaaatcacaaagcgagtcctcatcaggtattaaatctgccagtgacttcatcttggaatttctagccttgagaattgtgagaaatacttttctgttgcttataattctcttcatttgtggtattttattatagtagcctaaatgaactctgttaagaaaaagctagaaagacataataataatatggtttcaatgatacaaagactataaaattatgctcccctactccagtttgatataagatataaactggtccgatcatgacaacagaagagaaattattaataaaaatgttcaaaaaaacttggtccagatttttcattgcctcagttaatcttgagatgccaaacttttgactaccttttcagtaaattaccataaaaatgtact

SEQ ID NO: 7628 - DNA, 938 bp, mus musculus
gtaaaaatatttattattataataaacccaaggtatggggaaatgaatataccatgggtgatagatatgatctagcctaccacgttttgatccaaaccccacttacaacctcattccataatgttcactgtgatccatggacaataggtacattctggaatatcaacgagttggtattattttagaatcagtgtccaaagattacaatgtcattgaatctaatgtaatatataactctgaaagagttgataaaagcagcagtattacctatggatggtcagagaatttctattcttccatctgctctatgtgactaagagtcccaccagtggataattttattgtccatattatgctttatgtggaaatacaatgaaatgatgacactattatttaaattttttccacataataatccaagtaaatatatctactttacatagggactacatttttatagtttgcaatcaatgagtaggttttcaaaattttagtattaaaatataattctggttagatgagttatttactgctaaaaaaacctaaatttaagaagcatactggtcaatagagatgagcataatccttctccaaaaagcagataaattatacaaatgaaaatatttttatttcaaaataatcatgttgttttatttttagtggctacaaaattcagaaacaagtttggtaaatctagaaaagaccaaaacttgttactaaaatggcccaggagaatttattcaaaagtatttttgcctactaaatatattttatgatattagtactgttattttaaataattttgctactcagacacattttctctagtagaacacaagtataaatatattgaggattctctagagtaattgcaattagtgctcaataggggtttaattaacaacaaagaaaacatatattaatgatgcaggctgttt

SEQ ID NO: 7629 - DNA, 212 bp, mus musculus
attagtataagtagctttagagaaagctttgaactataggaaacatttgttctctccttatgaagttcagcaggcatccttttggccctgaagtcaggtgggaatgtctgccccgcttcaggagaagtgcagctggaattcatgtggtggttaatgttgggcaccaccaatttaattagtttaaccacttgagtcctgctgaatgaacctag

SEQ ID NO: 7630 - DNA, 866 bp, mus musculus
atattaaagtatcccttatgctgaagtgatacatataagagtaaattagaatattttgtgatctgcacagattatctcctgttgatagaaaatacagttcaaataaatttattttacataatcaaagatatacatacttattaccattaaaaatcttttagttaagcggaactccttctactcagaatagcacaatatctcattttctattctgttgagcagatcttggatttagaaattaaattttaaagtgtgcctaatgcatcagagtcccaattctgcctgtttctcagacacacttatcatcagggtgcttcagattttttatgtctaaatatagctttaaatacattattatctgcagaaacacttatttttatttagtagaaattattgaaaaataaagataaataataatgcttttctgactactgatcttaaaattatttttgtgggcactattgtaaggaattctttcatgatatacagttaatgtgatgattttaaacagagaaaagtatttcacatcattcttcccatcttttcacaaacaagagacagccaaacttaagggaagtgtctttgatgttgttgttcacatgctttcctccaggttcttaggaatgtcacttaacttttagtgttcagtgtcataccatccctggaacttgctgagcttggcagccttggcaagaatccttgacagcttgtcaagcccaaggcaaatgcatgtgatcttccctcccagtaattaataattaattaatgttcactaatctttaatgaatggtggttttgaataatctagtctggaaaaaaaaagaaaaacaaagaatttttattgcaaaaggaacttttgctcagga

SEQ ID NO: 7631 - DNA, 4865 bp, mus musculus
actatacctccagtggacataaatggaccataaaatactataactgggcatgtatctccaaagagacatttggtatgtaaggcaagaatagctcctggtgatggtaggtgtatttaaatctcagtgtttccaactgaaaggagcctatttttctgagagaatgtggccaggtcccagaatctcaaaagaccatacaccaccactaagagaaagcagaatgatgtataattgcatatcgctttcagcattttattcaaaattaatgtatattctttttttttgttttgttttctaagtaggcttttatcctttattttattttattttattattattatactttaagttttagggtacatgtgcacaacgtgcaggtttgttacatatgtatacatgtgacatgttggtgtgctgcacccattaactcgtcacagcattagctatatctcctaatgctatccctccccccctccccccacccacaacagtccctggtgtgtgatgttccccttcctgtgtccatgtgttctcattgttcaattcccacctatgagtgagaacatgcagtgtttggttttttgtccttctgatagtttgctgagaatgatggtttccagtttcattcatgtccctacaaaggacatgaacgcatcctttttcatggctgcatagtattccatggtgtatatgtgccacattttcttaatccagtctatcattgttggacatttaggttggttccaagtctttcctattgtgaatagtgctgctataaacatacatgtgcatgtgtctttatagcagcatgatttataatcctttgggtatatacccagtaatgggatggctgggtcaaatggtatttctagttctagatccctgaggaatcaccacactgacttcctcaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttttggctgcataaatgtcttcttttgagaagtgtctgttgatatccttcgcccactttttgatggggttgtttgattttttcttgtcaatttgtttaaattctttgtagattctggatattagccctttgtcagatgagtaggttgcaaaaattttctcccattctgtaggttgcccattcactctgatggtagtttcttttgctgtgcagaagctcttcagtttaattagattccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgagttaatttttgtataaggtgtaagggagggatccagtttcagctttctacatatggctaggcagttttcccagcaccatttattaaatagggaatcccttccccattgcttgtttttgtcaggtttgtcaaagatcagatagttgtagataagtggcattatttctgaggactccgttctgttccattggtctatatctgtgttttggtaccagtaccatgctgttttcattactgtagccttgtagtatagtttgaagtcaggtagcgtgatgcctccagctttgttcttttggcttaggattgacttggcgatgtggactcttttttggttccatatgaacttgaaagtagttttttccaattctgtgaagaaagtcattggcagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacatcccttgtaagttggattcctacatattttattctctttgaagcaaatgtgaatgggagtcctctcatgatttggctctctgtttgttattggtgtataagaatgcttgtgatttttgcacattggttttgtatcctgagactttgctgaagttgcttatcagcttgaggagattttgggctgagatgacggggttttctagatatacaatcatgtcatctgcaaacagggacaatttgacttcctcttttcccacaaagggaagcccatcagactaacagctgatctctcagctgaaactctacaagccagaagagagtggggaccaatattcaacattcttaaagaaaagaattttcaaaccagaacttcatatccagccaaactaagcttcataagtgaagaagaactaaaatactttacagacaagcaaatgctgagagattttgtcaccaccaggcctgccctaaaagagctcctgaaggaagcactaaacatggaaaggaacaactggtaccagccactgcaaaaacatgccaaattgtaaagaccatcaaggctaggaagaaactgcatcaactgaggagaaaaataacccgctaacatcataatgacaggatcaaattcacacataacaatattaactttaaatgtaaatgggctaaatgctccaactaaaagacacagactggcaaattggataaacagtcaagacccatcagtgtgctgtattcaggaaacccatctcaagtgcagagacacacagaggctcaaaataaagggatggaggaagatctaccaagcaaatggaaaacaaaaaaaggcaggggttgcaatcctagtctctgataaaacagactttaagccaacaaagatcaaaagagacaaagaaggccattacataatggtaaagggatcaattcaacaagaagagctaactaccctaaatatatatgcacccagtacaggagcacccagattcataaagcaagtccttagtgacctacaaagagacttagactcccacacaataataatgggagactttaacaccccaatgtcaacattagacagatcaacgagacggaaagttaacaaggatacccaggaattgaactcagctctgcaccaagcggacctaatagacatctacagaactctccaccccaaaccaacagaatatacattattttcagcaccacaccacacctactccaaaattgaccacgtagttggaagtaaagcactcctcagcaaatgtaaaagaacagaaattataacaaactgtctctcagaccacagtgtaatcaaactagaactcaggattaagaaactcactcaaaaccactcaactacatggaaactgaacaacctgttcctgaatgactactgggtaaataatgaaatgaaggcagaaataaagatgttctttgaaaccaacgagaacaaagacacaacacaccagaatctctgggacacatttaaagcaatgtgtagagggaaatttatagcactaaatgcccacaggaaaaagcaggaaatatctaaaattgacaccctaacaacacaattaagagaactagaaaagcaagatcaaacacattcaaaagctagcagaagacaagaaataactaagatcagagaagaactgaaggaaatagagacacaaagaacccttcaaaaaattaatgaatccaggagctggttttttgaaaagatcaacaaaattgatagactgctagcaagactaataaagaagaaaagagagaagaatcaaatagacacaataaaaaatgataaagaggatatcaccaccgatcccacagaaatacaaactactgtcagagaatactataaacacctctacgcaaataaactagaacatctagaagaagtggataaattcctcgacacatacatcctcccaagactaaaccaggaagaagttgaatctctgaatagaccaataacaggctctgaaattggggcaataaacaatagcttaccaaccaaaaaaagtccaggaccagatggattcacagccgaattctaccagaggtacaaaaaggagctagtaccaatccttctgaaactattccaatcaatagaaaaagaaggaatcctccctaactcattatatgagaccagcatcatcctgataccaaagcctggcagagatacaaccaaaaaagagaattttagaccaataaccttgatgaacatcaatgcaaaaatcctcaataaaatactggcaaaccgaatccagcagcacatcaaaaagcttatccaccaggatcaagcgggcttcatccctgggatgcaaggctggttcaatatatgcaaatcaataaatgtaatccagcatataaacagaaccaaagacgaaaaccacatgattatctcaatagatgcagaaaaggcctttgacaaaattcaacaacacttcatgctaaaaactctcaataaattaggtattgatgggacgtatctcaaaataataagagctatctatgacaaacccacagccaatatcatactgaatgggcaaaaactggaagcactccctttgaaaacgggcacaagacagggatgccctctctcaccactcctattcaacatagtgttggaaattctggctagggcaatcaggcaggagaaggaaataaagggtattcaattaggaaaaatgtatattctttgaaacggaaactgtcaggacaatttcctctctggatggtatgaaattcaaataccaagaggcctaataccgattcctacttaggaagttatttgacccaagaattttgcttaaagatgatcctgactt

SEQ ID NO: 7632 - DNA, 2837 bp, mus musculus
ggtccagctttggaaatacagattctatattatgtcttttcttggtctaagtatgtctttcagaaagagaaagaaagatccaaagaaggaagaatagaatgaaatggaacaaggaaaaagaaagattagaatacatgtgaaacctctacaatttttaccatatagagcaggaaagaaacataatctaaaccatatttttccatcatactcttaataaacacacctctgcatgttattttgaagttctatgtctttactctccagattttttaaaaaagtaaaccactttggccatgtaccagataaaatgtattttaaaaactttacggaactatggcctcaagaaaaaaaaaatatgttagctactgaagtacataattttgaaaaattgcaaaatgtgcgtaatggacacagaatagagtgatgtcaccaaaaattggtgtctgctactttttagtcagaagacaaagtttaaggggaagaatatatccgaaattcattgaagtaacagggcaaggataacatcatgaaccatttccaaagaattaaaagaccaattttcattttttgttatgaaaatattgcatgttatgcttcataattaagtcacatgtgaggccataccaggagtcaaagataattcaggaagttgattagaaaatgtacctttcagccatcttgctttcagcttatctgaacctgacacttgcagccgtttgccacgcatattgaggcagtgaaatgatttttattaaaaggcagttagtgttgtcagtttgtttccaaaacttggtcttggctaaaagaaacattccttccaaatatccactacccaattccatagggtttgtgtttgctctgtttgagtattcagttgccagttttcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccgtcccccgaccccaccacagtccccagagtgtgatattccccttcctgtgtccatgtgatctcattgttcaattcccacctatgagtgagaatatgcggtgcttggttttttgttcttgcgatagtttactgagaatgatggtttccaatttaatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcattccttacaccttatacaaaaatcaattcaagatggattaaagatttaaatgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaccaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacagttgccagttttcaatggtaaaattcttatggaagagttgttgtttttttttttttttctacagaaggcaaagaaaatatcacacaaatagaattctagtaaaatctgcagaaatcctgctaaattgcagcattattttctcgattaaaatatcttctaaaagtttttaaatgtttaaacaatttttagtcataagtactgctgtttaggatggcaaattcaattcatgactgcactcccagagcgtctttgtttttctagaaattcccttattctttccactttttcctctaacttgaatatacatatgatgtttcctggtttgcaaacattttgaaggatgtagtttcctcattcgcataacaattacatagaattaatagaaaacggaatctgtttttcagcaaagaggaatgtagggtatgcattggtctttccttatccactaacgcaatcctattatattcaaattcagtatagatttgagtaactaattcataaaatataatttcttatccactacctcctattgaattatcaaacaatggtttttaaaagatatctaataaattaatgttctttcaagcaaatttggaaaataaatgttaatattttgtatatatgatttcttagtaatcattgctgtcattcagaaattctttgtgttacttgtcaatcagtcagaaaattgaaaaaatgccgtgatgttgaagcaagacgtgaataaaaattgcttttcactttaaccaaaacaataaagcaact

SEQ ID NO: 7633 - DNA, 691 bp, mus musculus
gagagtaaaaagtaaaaactactttgagaaataaattttttagtaactatatacagatatttaaaaactggcattggtgggaaacaaattggtgtgatatgcagcatcaagacaatctttgcaagaagttccctgaaaaaagaagtgagcccaaatagcatggatctcagactagggtatcagctgaagagaaatgctatctagaccaaaattataacaatttccttagataaatttggctacagtcagatcaatttctagtgatgagctattactagtctcgaagggaaccctacctgtaaatttgtattgtttgttagatatatccttccataaatgtgtaagctcttatttcctttatttttcaaataatccttctattgtcttaccaaaatctccaattaattatttagtgaataactgagtaaatgaatgaataacaagtactcagctagctttatttttttttcattctcttttctcattaacaatagaacctggtgatgcagcctatacaagaagttaaaaaaatttgaatttgacagtgggatagcttcaattttatgtctttttttcttttgtaaataaaaagcttttttcatggagaaaaactttctcttaaataataccacacaaaagaataattgactccttcctctttataacactgtatgtcaaatttatcacaaca

SEQ ID NO: 7634 - DNA, 420 bp, mus musculus
gaattaatgaagatttaaggaatgatctgaaatattgctcaatagtgctaagtgaaataaagtgaatacagagatcctcttttaggttttgctctgcaaaaacatcttttccttttgaccgtatgactcctgcatcctctgaactaccaaccaaatggtctcaataagttcaacttagacatgaatatgagctcagtgttagccatcaaaaccttttccatagataaatggttgatcataggtaagcacattatcaaaggaggaccaaagttcagttggagtgatttctaccaacatttagagttacgatcttcctccttttgagattgtgactactctttcttaagctttaggtggtcatactttctgttaagcagagacagtctacctaaaaataaagcaaatattaagaatagcaga

SEQ ID NO: 7635 - DNA, 1522 bp, mus musculus
aaatatgaagtatgaatgtttgtgacatgaaaaaaataggtcatgaaatgatcccatagattatttcccaaaatgatgtttgatatcaataggacctaaataaactttcaagagttattatttaaggataagataaaataagtcttgaagataatatgagaaaaactttatttttataatggatgaaaaaattctagtctaaatattataaagatatgactatttattattattaagagcaaacaataaatcactttttataaaagtcccaggttcaataatcaataatattacatgcctatctagtaggttagttctatatctgcaaataaaagtgaagaaaagatcaagtaggtgaaataattggagaaaaagtcatatactcaaaacctcgatgtcagatcttctgaaactttgccttacattacatgtaataccatgtgactatagagaaaataaagccacaaaactggatttgtttcagttaatttattataggtatttttagatgtaatggtaagagatattagagtcttactgaattaaaataaagcttccttttgttaaaccattgataaatcattaatcagggtttaagaagtgaaagaaagctggtttgcttgtccagttctaaatagtgaagaagacaaatgcaagagagtttatttaaaatttaaaactttatcaatacccttctttgattagaagtaatacatataaaacctgaaactcatggtcatagtggatcacacttgtgatagttattccctagccaggactttagccatgttatttgcatttagcctttgctaacagctctgcttatattcttgtcagagttattatactgccttctgcaaagaaaggcaatatctatattcccaaccctctaaacataataaaggagcaaacacttctgcacaaagcctctctgagctatttaatttactttttgacaaaaagagaatgacactgagtactgtacaaagaacaaaagcaatttttataccatgaaatgcaaatgttaatttaacattactaaaaataacattactataaattcaagaaaattatcctatatatttttatagacctagtgtggtctaaacacttgacatcttaataagagtactttgaatttcttaagaaaaacattaacttttttttattttaaatggaaaatagtcaaagagaaaatcaatcaaaattaaaccaggagtaaaggttactcttcaatctccctgataacttttttatcattatatattcccatttattcttctaattttaggaaagacatgaacatctttattaaaaggagatttttaaaaataatactacaaactaaaaggtaaaaaatagttataggaagttcctgaaatcactgcattgccaggtggtttggaatgatcactccaatattacatgtactatattagttgctaaactgaaaattgttaatggtgacaataatatattttaataacatatttaaaatacataccagcagaaagcaaagcta

SEQ ID NO: 7636 - DNA, 185 bp, mus musculus
atttacaataatttacttatacattcatcagtgagaaacttgaatacccaagaggcaaaacctctcacagtcccacattcctatctttattataaaatatatcattttatactaaagttaagatttatgtatctgtctccctagctcagcacttaagctcgtttaaggcagaggttttaggaccc

SEQ ID NO: 7637 - DNA, 601 bp, mus musculus
gattacagggttagcatctcaaagttgtgttggaaaacctgcttatttgggagatagacattaagtaaaatgttgccacataaaagagaagtgtacaattaaaagcaagacagtatggtctaggatgaaatgagaaattacattaggaatagacttccttacaaagacaaaagagaagaaaactggctaaaaactcaaaatgaataaactgagagaaggatgctcaagaaaagaaaaattctgattgtcaaaaatttacagtgtgaaagtccaaaagaaactgtcctatttgctgtcataagtggctactggaagggcagttgcaacctcacagtagaactggtgaaactgttgtctacttttgatgggaaacagggagcaaactatatatactatggcagggactatggagcacactgctgagagctatctgtgtcccacacctcagattaaagcagcaacagaggagtcctgaaggctaacaatgatacaacccaagtctccaaggaaagacctcactgggaataaattggccattcatctttgtttttcagtgcctaggataatgccagacacaatactgactcagcaattttattca

SEQ ID NO: 7638 - DNA, 258 bp, mus musculus
actattcttacaaagacctgttggatttctgttgtcagcaaatgtccaactcattaatattgcacttctgtcttcaggaggcagctgcttcttcatgaacttccttggaatttggctgcaacacagcactctattctaggactcaactgtctccactgaaaacattttcttttgcagtgtggctccctgatgggtctccttgtgtttcatttctgctttgtatgacatctactgcaaatagctgtttatgctctattt

SEQ ID NO: 7639 - DNA, 955 bp, mus musculus
ttttggtaaaattataattgttatggaaaatacttgtaaattaaccttgagtcatgaaggaaacaggacagaaatactcacctgtacctcttgaccctggttctcatgtcaatattcctctgtggaagagggcctccctatttcctagcccagcagctttgtgcttaaggactatttcttctcagagctctgtgattcctattgtattaagtgcttaagtcttagtgctagtgtggctttttttttttttctgtcagcaagtgaaattggatatacaagtcatattccctcaaggctagctgctacttagtactatgcctaggattgcagctatctgctatcagtaagcagggctctcgttttggttactgggtccatcatggcaaatcatgcagccagctgaacagttattcagccaagcagcaaataacattggatgcctctcccatgaaaggtactgtcctagctcctgggatacagtgctgagcagataacttcttgctttcctatagtatataatctaatggagaagacagaaaataaataggccaacaaaaatgactgtagtttttgaatgtgctatgaaagtaaatgagcaaggtatgatgaggggtgtgtttagagaggatagtcatggaaggtcctcagattggaaagaatctgtgatctaggatccatcagaagtttagtgtgactggagacaagggcaggagatgagatttgaggtgtggattttttggaaaatcttcaaagaaacatttgagttgttttgaagcatgagtatatgatttttgaaagcagggaggaaggtgagggccaatccagcagtaggagtggtaggggcaaaggaagcattggtacaatattgaaatacccctagcttagggcatagttatgtagatgttgatgatggtgttgctggcccgcaagagggagtggtggtgttacaagttag

SEQ ID NO: 7640 - DNA, 955 bp, mus musculus; identical to SEQ ID NO: 7639

SEQ ID NO: 7641 - DNA, 955 bp, mus musculus; identical to SEQ ID NO: 7639

SEQ ID NO: 7642 - DNA, 955 bp, mus musculus; identical to SEQ ID NO: 7639

SEQ ID NO: 7643 - DNA, 955 bp, mus musculus; identical to SEQ ID NO: 7639

SEQ ID NO: 7644 - DNA, 472 bp, mus musculus
aagtcgcttaagataaattcatggttcttctactatatctcctaacatgcctaaaaataaggaaattttgggggatgaatttaaattcagtggcttttaaacatgtcctcaagaagcagaacaggtccagcgtacagtactctgcaaagagtcttgagattattcaaccagtatgtctaggtgtcatatttattttaatttccacatcattttacctctcgtagggtgctaacttgctctgtaatgtattttagtgatttggattcctctttgtagattgcaaacttttttttggagggaaattgtcttcatttttaaaactaatttaatgaatagtacactgctctaaatataagtgcttagtaaatattggttaaaataaatgaatataacttttaacaatttatgttttagaaaaaatcatttgcaaaaatctaaaaggaaagtgtatattgttggtgtacatctgaag

SEQ ID NO: 7645 - DNA, 369 bp, mus musculus
aaagattttgtgtaggagctggatagtgccaataataaagcacaaaatatgcatctcttaattccattactaaatttagattaagaaatttgcaaaagttaaaatgtaactgcaatattggcatttgaagttcttttttcaaactactgaggttgaataacactttgacggacattttcatagggcttaaagcaaaactactaataaaatttaaatgcagtattgagatcaaatgcctactgtctggctttcaacaccttactgagaattagtaaccaacaaaaaaatatgttaggcctaatcaaagaattgagtgtatgtgcagccactcgtttaattcctacaacaacccttatgaaaattggaatt

SEQ ID NO: 7646 - DNA, 538 bp, mus musculus
aatattaacagaaaatgttagaaaacatgtaggatcattccaaatattgatgacaacatctgcagcatgatatgcaattgccatgcatgccaggtgagttggtgctgtgtccatgtggggtccaatatcactgctgagtctacagcagctggtacacagggtgagcaaaaagtcttcttctctgaaacacttgcacaacctcatttgggccttgatctgactgggatctttaaagccagttctctagtcttgcaaaaggattctgtaagcacaaagatttcctttccacaatgttcacttctgttctaatcatccagagtcagcttctgttgcctgaaacttttaataccgactgatatcctttagttcttaaatttctttagttcttaaattaggttaaattctttagttcttaaattaggttttctactacctttcatatacaccaaatcttcttctagtcttattttcctttggaacaattattagagttgatatgtactagtaattataaacttatttctttaaaatgtgtctc

SEQ ID NO: 7647 - DNA, 384 bp, mus musculus
tgaatgtgcttcagggcacaggaatgaagacccttaacccaggaaaggagaaagctgccaagccctacatgagaactaccctaagtaagatggcaaaatacctcccagatgtgaaggagacaataaggacaatttactgaatatgaggaggaataattttcagtgttctcctggtaatattgcactgattattgtttatgagagtggaagggacgtagtgagaagagggaaggtagctttttgtttgttttgtttttgtttgcttaagaatatataaacactaataggggaaattattctcagtgacatgtcaaaccatgtcaccaaatatgtcagccacaaaattgctaggtgggaagtaacccagttggaagtttcatccat

SEQ ID NO: 7648 - DNA, 1170 bp, mus musculus
gtgatttctgtactaaatatatatatgtagttttaatgcatgtagtatgcctgatagattactaagagctggataaacagaggttaatgaaatagacttaatttatgattcatggaacttatagtctaatgtgagaaatatacacagaagtaaataattaagcacaggaataaatatgtaaatgtaacagatggtaccatactctgatgctatgaaagaaacagtgcagagatttacaaatgtgggggggaggagattatttaggtaggatggtcagaaaaggatttctttggagaagaaatcgaagatgagcattagaagacaggagaaaccaatgatgggacagaaaaagaaaaatatatttaaagaagatggcatggaatataaaatactacaggcagaagggagaatgctatatagaaaaactgagtggcacttagtgtgataaaatcttagtaaggagtattatagaagacaaagaaaggagggaagtgaaataggccagcttaaccatgtaagaatttctgtctgcagtaagatagtttgcattttatttattacaaactcggaatttttgaagcatcacatacctggatataatattgtttcatttattttttaaaaaatggctccttttcctttgtgagaactagctcagagaagttaatacaggaagctgaagacatgaggtaaagcaatggcctagtattcggaagataataaaataacccatgtgatgacaaaggagaaagaaaataaagaaatacacataaaattttatgaaataatggacttagaaataaaagatgaggaagagatcacaaataatagcaagagctcacaactgagcaagtggcagcatgtaatttaaagacatgctgtgaaaatgaagatgaggtaactgagagaatagtgagacagaagaaaagggacaataataaaccatagatagagaaggaggatgagtgaaaggctttgagcaggctgttgctcctgaagtcaagagaagagggtatcttcagaaatatggatggcccttctgtagcagtcacatcagaggttaaataaggtaagtgcagtaaggctccaccacacctgacaacatgaaaatgattggcatccatgtaaataagaattactgtggcagtatggagtagactgcaaactgtc

SEQ ID NO: 7649 - DNA, 546 bp, mus musculus
ctcattttgaactgggactctctgttcttctctttctgccaatctgtttccatgtcgttcttttagctgtatatctgtttacgtgtaatttatttgtttacggtgtaatattacaaatatgcaatataaaaatagaaagaaagttataataaacctgtaaaggctcatcacccagaataattaactatcagtaatgtggagctctagctttttccaccctttttatgtgtttgttaggtttttgtggctgaaatattttagagcaaatccctttcatcctgccattaacccttctcaatcagtttacatttttgaaaaaaacaactgttttatcacatagcagcaatactatcatcacccataacaaaattcaaaatattttattggtgtcacttaatatccatttcattttatttccaaattgttggaaaatattctttcacatgttcatttgtttgcaccagcatttacattgttcactcctttgtgatgttaatttaaaattctactcataatattcctatgaataggaattaaatgttactt

SEQ ID NO: 7650 - DNA, 1070 bp, mus musculus
tctaaacattatatttttgcctttaaaatcggcattcctttaattgccttgtagctattttctatgcgaaatctggtgggatagagcatttccactgaggagatcagattttaccagaagcaccatttcccagcactcttttctggtagaagctgggttcctggtggaaatgatgctgcttttaggatgatctgaagtactctggagagataccttctgctcagttaccattcaagctggaacctgctatgacagttgtcaacagtgccctttctgatgtcgcccagttgtgttccatttagaataagtacttaaagagacacctgctcggaaagccagaatagagaagctgcatgattctggcaaacatatgtagacaataatatccctttcctaccttgggcaataacttaataaagcctttaagacaacagaatcttaagtagtcatcctttttgttgttgatgagaaggagggatatggataccagcatcaaaactttctttatgtgcctacagctgtgatctgggcactaccacgttatcctgctgctatgactctccagccatatgctgccgtttatagtacagcctatgattcaggctgcaatgcttgtgaaattggcataaaggctgtcatcaccgtactctaaacaccctgcaagccagatttttcttcttcctttgaaaattagacgagatcccccaaatgtcaagcatatagatggtatatattctaaacatataaaggtgtaccattcaaaaagagcaaaatattatttattaattatcacagagggagaagtataaagataatctattaacagaatgagaaataaaatgacccaacccaaacctattaaaggtctctggtaagtaaggaaaagcatttaaagatgacagactaagtctttggatcactggggtgcagagcagtggtctgcttttcaacattagtgtttaaatggaaaacaaaaatctaaaattagtttcaaatttcagaagcctgattttatgattttatctttaccctcaggaattatacaatgaaaaaatgataataaaggtggt

SEQ ID NO: 7651 - DNA, 1070 bp, mus musculus
accacctttattatcattttttcattgtataattcctgagggtaaagataaaatcataaaatcaggcttctgaaatttgaaactaattttagatttttgttttccatttaaacactaatgttgaaaagcagaccactgctctgcaccccagtgatccaaagacttagtctgtcatctttaaatgcttttccttacttaccagagacctttaataggtttgggttgggtcattttatttctcattctgttaatagattatctttatacttctccctctgtgataattaataaataatattttgctctttttgaatggtacacctttatatgtttagaatatataccatctatatgcttgacatttgggggatctcgtctaattttcaaaggaagaagaaaaatctggcttgcagggtgtttagagtacggtgatgacagcctttatgccaatttcacaagcattgcagcctgaatcataggctgtactataaacggcagcatatggctggagagtcatagcagcaggataacgtggtagtgcccagatcacagctgtaggcacataaagaaagttttgatgctggtatccatatccctccttctcatcaacaacaaaaaggatgactacttaagattctgttgtcttaaaggctttattaagttattgcccaaggtaggaaagggatattattgtctacatatgtttgccagaatcatgcagcttctctattctggctttccgagcaggtgtctctttaagtacttattctaaatggaacacaactgggcgacatcagaaagggcactgttgacaactgtcatagcaggttccagcttgaatggtaactgagcagaaggtatctctccagagtacttcagatcatcctaaaagcagcatcatttccaccaggaacccagcttctaccagaaaagagtgctgggaaatggtgcttctggtaaaatctgatctcctcagtggaaatgctctatcccaccagatttcgcatagaaaatagctacaaggcaattaaaggaatgccgattttaaaggcaaaaatataatgtttaga

SEQ ID NO: 7652 - DNA, 1792 bp, mus musculus
tgctttcctttctttttaaatctttattccagcccctgtgcctgaatggttcagaagcaaccaccaggcatctctgcacaaatttgccagctaagatcagtataggccctcctccaacttatctgcaatgcactgggagaatatatcttcatatctatttagaaacatgcatataagttattttaatactatttatacaattttagcattttcctagagtaggttttccactttcatcacccacagctacaaaattattcagttattttctacagttttacaaatataccatattacgggctgcttaatatcttccttgtttaagactttaacagtatcagccgggcgtggtggctcacgcttgtaatcccagctctttgggaggcgggcagatcatgagctcaggagttcgagaccagcctggccaatatggtgaaaccctgtctctactaaaaatacaaaaattagttgggcgtggtggtgcgcgcctgtagtcccagctactcgggagactgaggcagaagaatcgcttgaatccaggaggcagagcttgcagtgagccgagatcatgccactgcactccagcctgggcaacagagtgagactctgtctcaaaacaagcaaacaaaaaaaaaaactttaacagtattttgtaaatgccagtgtggtggcttacacctttaatcccagcactttgtgaggccgaggcggatggatcacttgagttcaggagtttgagagctgcctagacaacatagcgagaccccatctctacaaaaaatacaaaaaatatccaggcgtggtgacgccttggcactagagcaagaccctgtctaaaacataaataagtacataaataaaaataaaattcatcaaccgcgtgttgaattctcaagattccccttaaacctgagaactggagagagccatttcagttatatagtaaaattaaatttgtttatcatggattattataatggacgtatattgataaaatgtctaggtgagaattttacagttgtaattggaggtccatttaaaggttaaaatgaaatagagagttatggatgcacagctttccatattgtgtttggcaaaggaaattgattctcggaatgatatgctaccctttttgtccactatgtgtagtgcatatggatgatggaatcactttcatgagtacagttcttatttagaacacacattccgtaatatccctagaaaataaaaaagatttatgtgttcaaaaggagtttcttgatatgagacaagcagactgactttcaattacaaacacttagaattctgaaccttgcatttttattgcgagaactcagttattttccaaagcttggtttgagagctattttcaggcagcagctttttcttgaagtcccttactgataagtatagtaagcagaaatatttcaattactctaattaaaaagcagtattcaacatgttgactgaaggtggagtttatgttgttcaccagacaatgagaaattgggaagggactattttagatagatcattgatgtgagaaagttaaattcacctgttaatttgtcaataaactagaacagcagggtttcctttgttaaaatataagataatatattggaaacgcataattcttagacatgaactcaaagacatgcaggcaggtttacttttagctcatggcatatgcaaagataggcatcaatttgtggtgaggatatgaggaagtttttatctgtacatttgtttaaagagtcatgtttagagaagcattttttaatagatactc

SEQ ID NO: 7653 - DNA, 131 bp, mus musculus
agaggtaaaattataacctacctattattcctagaaatttaaagcaatatttttgtgagagttaaataattttcagggtgatttttgtatacatatttttattataatattgacctaatgggaaacaaaac

SEQ ID NO: 7654 - DNA, 871 bp, mus musculus
ggaacataatttggatattgtagtgaagaaggaatctttgaagaggtgacattttagcagagactttaatgatgagagacatttgagctgagaactgaatattgggaaggaataagtcacctaaaaatttcgttcaataaagttgtaagtagaggtcaaggtcaagggcaagatcaaatatgctgaaactaagaaaaggttagtgtactttaagaacaagcagatgcccagtacacacaaaagacaatgaaagagaggaaatataatatgatgtgatgtctgagaggaaggagaaggtaggtcatgtatatgttcttgtagacaccctagcagcatggagtttggagtgaaaaacactggcgatgatggtttctcaatggctccactttcctcagccactaggtattatgataaaactcatcaatcagaagtaacacagggagaagagcagattagatccatgatgatatttgtaggttaacaacaaagaaaatgagttgttttgaatatattgaattttaagtgcaactgaggcaattagctggagatcttctaaggagaaattacatactttgtaggtctgtatcacaaggaatgaagtatgaaattttggaattgtaagcaaatacccaaggaatgaggtctgagggtgacactttcagggatccaattgtaaggaatatcaaaagaaatgaagtgttaactgtcgaaggaggtaaaaaaaaataactagagtgtgcagagtgaagaaatactgaaaacaaatacattttaaaaaatataaaaggtgttaaaagctaaagaaattttaaattagataaggcaaatattatttgccaattttggtaatggaaagaggatcaggagtgag

SEQ ID NO: 7655 - DNA, 484 bp, mus musculus
ttatattgtttttcctaattttacgtggccaagtgacttctaaagtctgaaagcaggcatactttcatatataaatcattataaacaaaacaaaagaaaatctgttatttcactcaaaatttataattactattctattaaagactgttttctagactgttttctatgtacgcaccaaaaaacacaaaaaagatactattatgtatatattgatgtatgtattttatttacttaacaagaaatctctgtatctttccatataaacatattagctatattgttcatcattatgtggacagatcataatttatattacaaaatttctcaaggagacctacggtgttttctagattttgctattacgaataacactgcatttaacaagcataaagacatatatttgtcaagttgtgtgattatttttctgaataaaaaaggattagaggaattcataggtaattagtttatacattccaaatattgc

SEQ ID NO: 7656 - DNA, 1084 bp, mus musculus
ttttgttataaaagatatatacatatacacatacacatatatatggaaaaagttaatgcagcagtcttgttttattctattcttgcctataggtaatcgtgattacatgcaaactctgagaacaaaacaacttgaatttttttttgtagctactgagtgatgatgttctttctatacatcccaagcgttctgtacatctatgcatcccaagtgcatcaagatggaccaggttgtcagcatgttcagagtaaacatgaagatttatgatgtgcatctaatgcctggtttggggtctgcaccatgttggagtccaagactcaagtgggctttcctgggtaaagattgctcccacataatctacaatttgcaggtggagaaaatgatgcatctattatgtgatacccataaagtgaaggcaagaaagtctgtgtttgtgaccattcccctttgcctattgcgtgtctttttcctgtaatccttcactatatgctttgctgcaataactgttaactattgtatataactttatgtttagttacatgagtccttccagtgaattagtgagcttgtgcagtcattgctctacaaaatagcacatttcataataattttatgaattggtttatgataatcagtgatgtactttcaaaaaagatatactttatagaattataattttgcttcttttaatacaattaaaaactcatatgaggtatttagtctagtcaaattcatagagacaggaagtagaataatgattgccagggactggaggaggttggaatgagtagctgtgtaatgggtacatagtttcagttttgcaagatgaaaaatattctgtggatggatggtggtgttggtagcacaactatgtgactatacctaatgccactgaactatacacttaaaaatggtgaaaatggtaaatttcatatatattttcccataacatttaatgtaatttattaaaacaataaataataatgttttactagcataatgtttaaaatcagttgcaatcactcagtaaatgtctttatatctttgtgtttcattttattatcaaagacagactagctaaggt

SEQ ID NO: 7657 - DNA, 572 bp, mus musculus
gcaacatttaccagctgtgtgatacttgtcaagttctttaacttatctttgacacagtttcctcatctacaaaattaagataatctcccaggattgttgcaagaattaaacaagttattaggcatgagtttctaaacaaggtctaccacatataagtcaggatagcagggcttatgcaaaagacaatagttttaatttcaaaattctcattccatcaaattctgtttaaaagtcctctttaaaggacttttaaaatgcttagtttcctaaatcctttaatcattaatttagtgttggtaaatggaagtggacattaagttaaggataagggttgaagaaaagggaaagaaacaggaactaagaatatgaattgtcgagtagaaaatctctgttaaatgtagtacttttaatttgcaaacactatccctgggttgctatgagttgctaaatatcaattgagaaatgagatactcaagtgtatgttcccactttaaaaggaaaagcttctaagggaatggaaagagagtaatcaatcagtcaatcaatcaattaaaaacacattacttagaatc

SEQ ID NO: 7658 - DNA, 1149 bp, mus musculus
atagggggcatcagagtaactcaagggcttttcaaattgtacccactctcatccagattttgctaaattccctcaaggcaagaaatatctgctcacatttagttgaaggagtacactggaatatccagaggaatcacattgcaccctaccccaacagaaatggttaaatgccatcttggaaaagtgtgtatccttctggtgttgagaataatttccccgaagtgagtcactcctgatgcaatttgttggcatcctgctggtgtgctggtggggaaagctggcttggtagcaactttggttcttaagccatcttaaattttttaaattgccgacaaaatcattatgagtgtaagggaaaaaaaagtgtccccttaagatccagagagtaatatgtaacataattccattacagacctatgtattacaaatatataaatgcaattttctaagcaccaagtagtgattaaaaaaaaacccacacacaatgtaacagagattaaatttcaacaacatcctggagccacatgaaagctattgtacattagatttattagttttactccaccttgatgagagagtatcacctactacttttgaaataacaagattgactaatttgcctagttcatagagctttagataaggtggcagagagtagacattggttctaagaagatgtactttattatattgtcttttagaagttaaattgaagacatccaggagaatctggggtgtataaagtgctagggaacaggctccaggagaaacctccaccatcaaatagcagtttccaaagagaatgaagagcaatcatgggtggacatctgtgcaaatctagcaaggggtgagtgaagcagcaaatgggcacagaaaaagacaaactggaaggatcatcacacggaaatccagggacgttgaagtcagctcgaaggagatggtccagttctggagcagactgccagatttcaaccccaatgcaacagcagcttggccaactcgctccctctaggactcccttccttgtgttctttgtgcacaaaacaatgataatcaggcacccacatcacagaagaaataacttaatacgtgcctggcacatactaaacatgtagtaaatagcatttcttgctgctattaagtcagtct

SEQ ID NO: 7659 - DNA, 2613 bp, mus musculus
atctctaatggttgacatttttaaaattttaaatttgttgttaatattgatggcagcagcggcccatctggagcagctgttgtaaagatgccagctgcagtgggggaggcgcgtccagggctgcatgctccactgagccagcaggagccggaaacaggcagaaacccagaccccttccgagttggaggggcgggagccctcccaggcgcagctgcagtggcccagtcgcagctgcggacccaggcattccctcactatcttcggcctagggagcccccttcccccacgggttcagaaatgcctgttcccgctgcctgacctctccctactcccagcacccactctgatttcagagcaaagttgaggccaagcctgggcactgttgcaggtgtgcccgctcttggggcattgctgacaccccagccccctgccacctcggcctcctctggactttggacactgacaagcacggaagggaggctggccaaagtgggggatgagggtgtcttggtgcaggcctgcaggtgccctttggcactccaggctgggcgccaggttacagctggttgatggcggcaggaggcaggctggcttctgggcggaaaggggtgggtccctggtgaagccccaccctcaagccagggatagcctggagcatgggagctgcgccaccagtttcacagaacggagtgagaacttacagtacttttttcctctggcccacccattgccacctatggaccaatcagcatatacttcctccccactgaagcccacaaaaaccccagactctggcagacctctggacgatctgcctgcagagaggagctaccaactgtgggtctcctctcagctgagagctgagcagatgtagagacaacctgcctgcagagagaatctacccactgtgggtctcctctcagccaagagctgagcagacagtgggatggcctgcctgcagttaggagctacccattccagatctcttgagagctgtactgctgctcagggaagcacctctttgtcttattcatgctccggttgtctgtgtacttcattcttcctggacacaggatgagaacttgggacctgcttaatggtgggactgaaagagctgtaacacaaaaagagctgaaacatgcccctcactcgccacattgcaacaaggagagaattgctgcagccctttggggagcccagacctaggagctccctgagcaagggctctgacacctgtttggggctctgcagttcctggcatctccaagcttccggacaccactgcattccccggtgccagcagtggaagctgctttcagtatgcctgtccagtcgcagcctcacaggaagcctggagccgcctaccccacggcagccggtgtgccctgctgtgtgcagtggttgaaccctgtactcactgacttgctcacgcaccccttgctcacacaccccttgctgctctgcacttggcttgccctcagcaggtgtgagatcccggccagtatagcttgagccgagtacagcctgtgaggccgagtgggtggaacaagcccagtgggcctgagcataactcgggcaaaggcgccactggccacaaaggtttccagctgacaaagtgacgccccaaggatcctgtgacagcaccaccatgcaaaagactagattgagtactggtacagcaaatatgactactaagcatttctatccaatattcaatagataggtttattcaaactttatggctttcatgactccctactcatattctgtatgaataataaaaaataataatttccaacccagtttttcatgagagatagtgtggcatgatgtaaaaagccctggctttggagtaagaaataactggattcaacttatggtcctcttaggctgtgtgacttgaggctaggtatatgagctctctaaacttcagtttactcagctaaaaagtaggttataacataaagggctttgtagggattaagtgagcaaaatcatttatattacattctttttatttatgttgtaactgctagagaaggagatttaaaaaaaaaaataggtgactatctgaaagaaacttactgttggtattttttttttattcaaagtttcatcttgattaaaaggcaaaagttttgatctttggaagctcatggctagttgtgtaatctcccagttagtcattgttgttatcttccagctccccttaactgacactaaatgtattctttctatcaatttcagttccttcctactgtcctcacaactgttaagtagatgacttttccagtaccctaacttcatacttctttgagccctacatgaatattgaccttcatctcagatctacttaatttagtcatactaattttcatacccgatcttgttagccaccaaaattctgccactgaaaagtgctgttctacctccaaatcaccattctccagtcttccatcttgcttgtacaactattacactttgacttaatctgtcatatcttatcaggacctctaattctttgtcccttctactttctcctgtctgtcaacctgtgtttccttcccattccttcctatataactgagacttcaaggttcttcatttcaatga

SEQ ID NO: 7660 - DNA, 521 bp, mus musculus
ctttattttgaattcttccaaacccagtatattcaagaacaaaaaagaaaaatacgattgtgataccggttaaaaggctgtaacaaaaaacaaaataaggatattttgccaaatatatcacacagcgtgatgtaggggcatacacatgaaattctgattctgtctggaattcctagaccttctcttactgtactggtgaaaatgcagctatagcagcatcacattgtggttcttgagccaacctaggctttgccttgaagatgaaatatttgtcctgaataatcttaccttacagtgttaagatttacatgtgtgtttactttttattaggcatgtactgatctgacttgtttgagttttattggcacttaaaaccgtgagaagataactgattcatgacagcagaatttcaggtgattcatcggattcattaatcaaaatgattagttcagcaataatttatattggatcagtaaatagcatatcttcttttatttaaaggtacctgaattacctggtat

SEQ ID NO: 7661 - DNA, 1171 bp, mus musculus
ccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacccgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttcca

SEQ ID NO: 7662 - DNA, 563 bp, mus musculus
atttctttggttaattgctgtttcaactaaaaactgagacataggatgaatggttctttgtcttagctgggttggctgtggatggagttttgcagagtcagttaaaatatccagacagggacagcaatggcattggcagaatcagttaaaacagtagcagtgaaggacagagaggcacatgtggtgtccattgccatttgcattgggaatagaccctgatgtaagattagcagcagcatcaatagcctcagaaaaatagctgtcaactatagaaggagcatcaggatctactccgaaggcagagagggattacttcacctgacagtacatctgcacttaaaaggtcaaaaacaacctctgttgttgagagtactagtggttctagggggaatgaagtctcagtaacacacactgtggggtgtgtgtggatgggtggagggggccttagggaggacgaggagagaggaagggagtaaggaggaacaatgcaaatatctgtgctgataacccaagaccttgaattatccccgctcaatttaactggaggatgggaagagattata

SEQ ID NO: 7663 - DNA, 606 bp, mus musculus
aaggtgcttgacaacaaactcatgatggtggttatctgaatgaagacacacttttttttttttttttttttttttttttttttttgagaaggggtctcactctgtcaccagtctggagtgcagtggcacaatcttggctcactgcaaactccgcctcctgggttcaggtgattctcctgcctcagcgtccagagtagctgggattacaagcacacaccaccatgcccagctagtttttgtatttttagtacagacagggtttcaccatgttgtccaggcatgtcttgaactcctgacctcaggtgatctgccttcctttgcctcccaaagtgctgggattataggcatgagccaccacacccggcccacttacttctcttatactgtatctttctgttattttttatatcttgaatttaattttatattctttatgcaattaaaacacataaaagcaaataaaggaaaaagactgaaaaactatgggacaaaatagtaatcgctgatggttcagtaaaataatctttgtttatctgtatttttaagatttacaacaattaatatgtatgacttttacaataaaaaatgctccaagtaattttaagt

SEQ ID NO: 7664 - DNA, 878 bp, mus musculus
taaggtagagtgcctgctatgggaacatcttgatgctcatgcccatgtcttgatagaagatatcctctacattagccttcacaaacaagtagaccacagttggttctgtacctgctaatcaacatctatgtaggtatatgtatttaaatagctgcactaggaaaaaatggcatgccaaaaaaggtgtaaactctatcctcaaccttacctctccagaatacatgttctcattttgttttcctagtccttcatggtttccatggctttactctgagccttctgctagttttccacagctatgataaatcgatgtctcaaaactgaaatccataaatagaaacaaccagtggactctagaaaaatagtggtttatcatgggaagcagattcccaaccagaagatttcacattaagctgtgtttgaatggaaaagaaaaataaatataaaactgaaagagtcaacataacagatatcaactcacaatcgggagaaacacttcgtatcattgttactagggatgactaatccaataaatgtcttagctaacaccagctgcccataatctaaatataccagcaaccattcccaggcctacaatgtgcgtacatgctattgagaagtatcattctatcaaagcctaaggagcctcaaagctcattcaggtctgagcctgaacaagctgcaaaacatttcaaacctctccaaggtgaattaaagctccagagaaggcaaattagaggggtgactgagatcctctcatttaatgcaagaatccctctacaacagtacatatccactgatccagcagcagggagctgggcaaggctgctccaacaatgcttgtcaagttttaaatactgggaagccactcctcatac

SEQ ID NO: 7665 - DNA, 740 bp, mus musculus
catgggcccatggggtcaatccagtgtactcttcccatcacaagatctgtaccgttaatcgcatctgcagagtccatttgccatgtaaggcaacatcttcacatcccaagggctaagacgtggacagatttggggggatggttattctgcctgccatgactgtgcagggccacggtaagccctcaataaatgctttgtctaatggttataaaacctggattaaggtccttaataacattgaattatttgcaggattctgtatttgtgttccatggctgtctcatcctaccacctggcagagcgcgccacacatcttgacagactctcatgcagttcattcatcaagcgccttctctgtagaagtcgtggttactaaacaccctcatgagagtgtactgtcaagtgtggacctagaccaggtgttcaaatatttattaaattaacgaagcaaaacagcttacctggtgcttctgaggaacacgttaatgcctcagttctcaccatcatctctccctggaatgccctttcccacttttgcttgtcaaaactgatctatcctgaaagactatctgcgttggctttttttttttaaattaacagatgaacattgtatgttttaaatgaagatatctctgaccttgcttgttactggagaaacttactgtaaaattgatggccttttcttgagcaatttgataacattgtatggttacagcgagacactaatctttaaccttggc

SEQ ID NO: 7666 - DNA, 148 bp, mus musculus
aaaatttcaaatgaaagtaattaaataatgtgttcatcacataagaagctgtaactcaatttcaggaaaagtcactatcagtatcatcattaaaaatagtgcctggatctacgtaagtgcaccgatgaatttttttcaggtgatttaa

SEQ ID NO: 7667 - DNA, 186 bp, mus musculus
cttccttccaggagtgaccaccccaagtttctgtcccccagctggattctgccaaggataataaagaagctcttcatgcttttataccttcaaaaacatttgattataacctactatgtgccaactattgttctagatgctggagatactacagctcttaaagttatttggaagaggttagatcat

SEQ ID NO: 7668 - DNA, 1240 bp, mus musculus
tagtgatacacaatgtaaacacatatcaaaacatcacattgtgccccacaaatatatgcaattattacctgtaatttaaaaataaataaatagattatttctgttgtttaagccactcagtttgttatgccagcgctagcaaataaatagttttctagctaggaagtcttactaccagtggctagatcctcagcacccctctcccaaccttccagattgcccgggaatgccttcaggagactccttaagatggacctcagggatgcagatgccttgccttctgcactgcagcctctgaattgcttgctactttcttacttgtgcacagcaagggggcataattacccattggcaagtgcttctggcctctggacttcagggacctagacgttcaaagcctgctggaataaaagaacttcctaaggttcagaacacaacctaacaccagcattcagggaaacaacacaaagacttgtccatgatggttacagccacccaaaaaagccatcttcatatatgtgtagtttcaatagtttccattggtcttctggtgacagtgcattcacccaaacacactagcacactaggtgtaccatccatctccatagaagagtgggacatagccgctgatggattctttgtgaggccaatccaagacccccatatgctattactatatgatctgaatgccaaggaagcagtcagtcccaccttaccccagagccagctgcttccttactaatgtactctctactataatttcagggaaggacctaaaaaacatacttcttggcttggcagtgatcttagaggcacttgtatcctagatgtcccagagacactgatcataggtcatgtccttcctgtcctccctgagagacaatgtagtttggtgaaaaaggcatgacaaagatgtgtgaccttgagactgtcagcctcatcatccaaaaaatgaggggcaaatgtactagaaaatctctagatcctttctctgatcgttatattcctgacactttgaggggttcctgtttcctaaatgctccaggttttgcaggcttggagtgattcccaaagccatcctttatcagcgctatctggcttcatcaacagttttctccaaggtgaatactcagatagccccctctaagtctcttttacaagtaaagagaatgaacactccacaatccgtatgaaaccctagcacatcagtggtttaagtggatttctttcaccaccagaa

SEQ ID NO: 7669 - DNA, 289 bp, mus musculus
attttgagaaatatttaaaagttagagctatgaagtatttatctttaatttgattcaagaatgataaccttggtttctagtttggccaaatggtggatgtttctattactgaaataaggaaggaagaaaagaagcagagggaagtattagataccttagcaataaatagtaaaataatttactttaatacaaggagggatttttttgggggaaaagtggtttatttctctaaaataaataaggctttttaaaattcaaattctggaaatgtgttactaataccaattga

SEQ ID NO: 7670 - DNA, 195 bp, mus musculus
atgaatgttcttcatgtgctggaaggtatcattgatctgcaacgaccctcaacatattgatacagtgctttgacaggatcgatctaggttccaagaggccagatctttttcacgtatctgcatattctaataagtaatgcagacttacgaaatcgcaggcaaactgtaatagcatgatgaatgacatgaactgtg

SEQ ID NO: 7671 - DNA, 1242 bp, mus musculus
tgactgtgttacattcttcaagaattttctcagatatcatcttcacagtgatgtcaatcataaccacctctgtgttaggccgtccttgcattgcagcgtacggtggctcacgcctgtaatcccagcactttgggaggccaaggtgggtggatcacgaggtcaggagatcaagaccatcatggctaactcagtgaaaccccgtccctactaaaaatacaaaaaattagccgggtgtggtggcaggcgcctgtagtcccagctactcgggaggctgaggcaggagaatggcgtgaacctgggaggcggaggttgcagtgagtcgagatcgcaccactgcacttcagcctaggtgacagagcaagactccatctcaaaaaaaaaaaaaaaaaaaaaaagaaaaaagaaacacttcagactgcataatttatagagaaatgtggtttaattggctgattttgcaggctgtacaggaagcatagtgctggcatctactcagcttctgggagcttttattccctggggaaggtaagcaggaacaggcatgtcacagagccacagcaggagcaacagtaaaaaagtgaggaagggaggtaccacatgcttaaacaacttaatctcataagaactcattcactattgcaaggacagcaccaagccatgagggatatgctcccatgacccaaatacctcccaccaggccccagttccaacactggggattgcaatttaacatgagagttggcaggggcatatattcaaagtcatcaaccttttttaaaggtataatcacattcctcccaattttcattaacttgttataatttattttctgttggaacttattattttgtagcattgctatggttttcttagttatttgattttttaaaaattgtcttttgacctctgctagaatgttagcccaaagatgtcaagtgattttactggttttgtttgcttgtatttggacagggtctgaccaatggaaagtgatcaagaaatatttattgaaggaacaaagtaatatattaacttcctatatttttatcacttttcagtaatatagtggatattaactcatttttgaggacagtataataaatagtaaaagagcatctaatattaatcacatttaaccagaagtaagtcatctggtagacatatgctccaaactgactacttcttacgtgtctttcacaaaagttaaacatttctgtaaacagaacttactttaaaataaat

SEQ ID NO: 7672 - DNA, 635 bp, mus musculus
ttttaaataaaatcttttgattcctgaatttaaaacaaattccagaagagggagatgtttactctcaaatgaaaaatgtgttgctcagtgtgaataaactggtttctataaaacaaagaataagatttatatatcatcctaaaatgtatggaaatcatagattctaacactatattgtggttaaaatttcatctttatgatgtattataggtacttttcctatttgtaggcatgttttatgtcaattgattttcttaattaaaatgtttcctgaaaatttcttaattattcaaaaatataaagatttttgttttcacagtcattttaaatagaaattaatatttaacatttgagaaaatatatttatcacgatacgtttttcagcaattgtcaataactgttttgttaaaattctttaagaataatatagaggcaatatatcataatctggaaatacttttaaattaacatgtattatttctaaatatgcatttatgtactgatatagagatagctagctgttcaatcagctcttttgtattttaaagaaaaaattatttaataagtaaaggcaaaatattttgttttttttttatgagaaagaaggaatgacaataaatataatgaaatgtagt

SEQ ID NO: 7673 - DNA, 1027 bp, mus musculus
gctgctccggagcgggtgcagggcccagtccagtgcacttgtttattgtcgcgcctctggtgcgagccaagctgcagcagacatgatgggcccggggcgaagcgggcgctcggtggccgatagatggcagccgagggcgaaggcgtccctgggctagggcggcgcaaccggggcccccttggatgtcacattcgtaggaagagagagaagtcttggaccatgtgtgtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacagtaagtattcttgggtctttccatgaaaccagacacttccatccccaaaaaggggtctttactttcataagacatgttttcaatatttgtaatattagacctgccgttcatcccgggtataagagaaaagttgataatagtaagtgacccagtgcaggctgagtgcacatgtgcctgttcctttgataactatgtagttagtttctccatgtaaatatattttacccactttattttgcaattaattacgtcttaattattattgatattgttttattcttagtaatatttgggataatactgtgttataatctggttaatcatatgtttaatattgatatagagtctgataatatgtctatgttctgagatgtatat

SEQ ID NO: 7674 - DNA, 206 bp, mus musculus
aatcctatgtgaattttaacattatcttatttctgtcaagtgtaatatgttcttttaaaggaaatatagtatatggaaaataagaacatataaattcaatttaaaaatcatctgaactaaggctaccaaaggagaaacacttcaaaattttgctagttaatattttgtacattgttaaatatgtacctttgtaaaagcattgctct

SEQ ID NO: 7675 - DNA, 788 bp, mus musculus
atgctgcagcaaacctttagtagaaatatgaccaaattctctattctagcccatgtttcatttttgggggttttgagaactgatctacttatctgacaagcccagacagaagaagcaagcaacatacttaaacaatgaactgcaaacaacagaatatctctatgtacttttaagtgaagtgattaaaaaaaaaactgggcctcttataatcattaggaaggtgaaggattaggcttgcagaagtggcagttcccagagggacactggaggattgagtagcagaagctacagcaaaggtcacagagataaacaaactagtcaacacattgcagttgtcactgtaatgaacacatttcctggcccttggactttgtttcaatcacttaagttccaatgtactgaagatataattggctatgcctacataatttctccattcattgtgtcctttgattaccataccaagaagtatacactaaatttcacgaggaagatacattttgaggataatttttctaaagtgagattgaagataaattacaaagtggaaggaagaattagatatcagaaaaatggtttgcattttcacataatgtttgtatatacaggtatagtaatagaacagatatctacaaggcttcgcagggatacagctgtatacctcccgtcccgcagctactgcaagcaggcaaagacacatattcacaggcatttcaatctttgagtaagtcttcgatgtctggagtacatgcaatggattttttgatagtaacaaaattattaatagc

SEQ ID NO: 7676 - DNA, 203 bp, mus musculus
tataatatgcaattatattttaaaaatttaagtaataaatgaaaatcttcaaatctatcaaattaattaattaaattttatttgacaacatgaaatagcctcccaaaacaaagtgtcagttatatcaaaggaaatttgcagcacagcttgggatgggctgcatgaaagaggccttgaaatttagctttgctcagcttctttct

SEQ ID NO: 7677 - DNA, 3755 bp, mus musculus
ctctgtgggatcacaagtaaaactgagaggtgacagcgtgcaggcagtcctcacagccctccctcgctctcggcgcctcctctgcctgggctcccactttggcggcacttgaggagcccttcagcccaccgctgcactgtgggagcccctttctgtgctggccaaggccagagccggctccctcagcttgcagggaggtgtggagggagaggcgccagcgggaaccggggctgcacgtggcgcttgcgggccagctggagttccgggtaggcatgggcggccccgggaaatgaggggcttagcacccgggccagcggctgcggagggtgtactgggtcccccagcagtgccagtccgccggcgctgcactggttttctcaccgggccttagctgccctcccgcggggcagggcttgggacctgcagcccgccatgcctgagcctcccacaccctccatgggcttctgtgcagccggagcctccccgacgagcaccaccccctgctccacggcgcccagtcccatcgacggctgaggagtgcaggcgcatggcgcgggactggcaggcagctccacctgcagccccagtggggtatcgactgggtgaagccagctgggctcctgagtctggtggagacgtggagaacctttatgtctagctcagggattgtaaatacaccaatcagcaccctgtgtctagctcagggtctgtgaatgcaccaatccacactctgtatctagctactctggtggggccttggagaaccttcatgtctagctcagggattgtaaatacaccaatcagcactctgtatctagctcaaggtttgtaaacacaccagtcagcaccctatgtctagctcagggtttgtgaatgcaccaattgacactctgtgtctggctactctggtggggccttggagaacctttgtgtggacactctgtatcaagttaatctgatggggaagtggagagcctttgtgtctagctcagagattgtaaacgcaccaatcagcgccctgtcaaaacagaccactcggctctaccaatcagcaggatgtgagtggggccagataagagaataaaagcaggctgcccaagccagcagtggcaaccggctcgggtcccagtccacactgtggaaggtttgttctttcactctttgcaataaatcttgctgctgctcactctttgggtccacactgtttttatgagctgtaacactcaccgcgaaagtctgcagcttcactcctgagccagcgagaccacgagcccaccaggaggaacgaacaactccagacccgctgccttaagagctgttaacagtcaccgcgaaggtctgcagcttcactcctgagccagcgagaccacgagcccacctggaggaacgaacaactccagacccgctgccttaagagctgtagcagtcaccacgaaagtctgcagcttcactcctgagccagcgagaccgcgaacccaccagaaggaagaaattccgaacatatccgaacatcagaaggaacaaactccagacgcgccaccttaagagctgtaacactcaccgcgagggtccgcggcttcattcttgatgtcagcaagaccaagaacccaccaattctggacacaaaacctcaagtagtccctccaccgaaagcacattataaggatcattttgcctcaaagccctcctacaggcaagaggagcttactgtgacttccaagaagaaaatgatgttgtggcatgaagcacttctctgatcatatcactgctgtactaaaggtacgttctacatgtactttttgggaagaaattgatggttatttcactagtgtttatttttgatacaaaggaccaagtaaatctgtgaagattaaggtctattttcttataaagaaaagaatatcaactattcagactgatgcaaagttactttcttagcataaattctaggtttatagttaataccttgcctggaatacttgggccaaagtccagccatctttgtcgggcttcttattctgtaaaactagttttctgctccatgtcattccaccatattttgctggtcattgtgagaatgaaattaaagtaagcatgaaaagcattttacacagcacgtaatacttactaaatgttcaataaataattagaatttaaatttttgtgcagctcacttttataaataaaatcctaacattttttactagtaattaagcaaacgtcttcacatatcaggcctctgttaatatctcagcttttactctcatggcgtgaagtaacttaagtacttacattgttataccatcattttgctatttttggaatcacctttctgaactgtatattgataattgcaataaaaaactagacaacacagcacaagggatctcagaccataaatttaaaagaaaaaattgtatataatttaacccaacagctgaacataaattatcctagaacaataagggcaaaaaaaaaaatggttaaagaatagaagtaaaattgtgggctaatctccataactttactagacaacaaacagtgctttcataatcttaatcaaagatttttcttctcaacttattttggatgctgttgcttaaatatgtatgatttacttaggctagaagaaggaaatatatcaatttggtgcctactaaagcaatatttacttgaattagatttagcaaagtatttcaatgttataagatgggtaaaatgttcagacatagattctttctgggggaaaatgtatttataattattgcttttagaaattattaaaatatagttagttgtgaagcagtgttagtaaagctggactgtgcttcagatctgatgcatatctgaaagacaacgtttaagagctttattttctacattcttccaattgaaataaagcattttttctaatgtattaaaacactataaaaataatggtaatattctttgaaaaaatttagctctgtattttaatacaacagacttgaattatgagaattcatggagaagggatttattacgagctgaaatgactataaaatactatcattactgggttaattctgactagaattctctctgaatgtttatggcagtcctatttttgatcaatgagttagagacttgaaccaaattatctgtcttctgcttctctttcttcttctctctttgtcttggctttctctgtcttgcaaatggaaaacatcattatgtgtacacacaatatagtttgaagcttcaaagtttttatgtgatcagaaaatcatgcccatttctagtcatatatgtgtgtaatcaatattcataagaatgtctactgccacacattttgtagtgtgttatatataatattgtccttattgatataacagaaatgccgattattcattaaaggaaatgtatgacacagagaaattttagacttacatctcttatgttttttacaagtgaaatgtttttctgaccttgtaatgaaaaataataggttactgaaatataaatgatattcaaattaattttataaaataagcaattatacaacttctaatattattctatgattatttatcttacaacacacaattgtgccctaggtatggaatgtattcggtgttgaggagtttggacagtacagcagcagctgctctaggtaagataatcagggcagtccattctgagaagattgcataatatacacacacagaaatatataaataatttaaaggcacagtcttatttttgtatgacatgct

SEQ ID NO: 7678 - DNA, 900 bp, mus musculus
aaattcagcttttataaagacatgaatattagggactactaaacccactctctataataagcactatataatgttagtatatagaatatgataaagtgctaggatgtattcaaaaccagaagataatattccacaacttggaattttgctattaatccaaagtccacaatttagagcacaattacattaaagttgcaaaattaaatgaaatgttgctttctcttgtttcaatttggcttaactgaaactccctttgccacatttgtcttccatatatctttccaagtgagaattggccacgaataaaatttgtaaatgattttttaaatgacaggggagcaacaccctgtttgtcctagaaaggtgagtgtgagttcaggatctattgcagcttatgcatgttgttgctgaattgctggtttatcttgttgttggagtagcagtcaggccccaaactcctctagctcctgccagatctcctctttcagcttctcctgcaaactggtccaggtaagtatgcagcttcatgatcaagagcaccgacttaccctgtaggcacctgcatctgtgaagataaagataataaaagacatgattccaatttaccattgttttccccttttcgtatccatccgacttttctacctacctcttctgccaacctcagacctgaccctaggagcagaaacaacagccttcaatagactgtttaacaaatacaatgcatttggtcaatcaatccctttaacaaatgcctttttaatatcattcactgtggttctgcttctctgcttccctgacacattaatgtttaaaataaaacaaattactgataaattccaaactcctttgtttctttggtagaattcctgagaggatgcgttaattctcttatgcttt

SEQ ID NO: 7679 - DNA, 1121 bp, mus musculus
ggtctgcttcagagcagccccaatcgaagtcaggaatcatatgacatacatttgaaaatagtttttttaacataaaatgatagcaaaaataaaaaatctcttataaccgttgcaaaagactagacatgtctaaaagtaatccatgtcagataaatttagttttttgatcaattgtgatttaatataattaattttgggcctggtatcaattttctaaaaagcactgctctgggaaaaagtgaaagcaaatccctttctctgacatatttttaatgttgagatattagattctaagacacagactctatggactctaatgagatcacattacccattgctagtgggtgtggcactgacagggataaggaggtagcatcctgctggcctttcagagacctgtgaagaaagtagtaggtgctcagtgaactagttacactttgagaggtcttctgataatcatttgtccacttccagggggctttcaaacctgattcatcttcaacctcaccaggggaatacaggcctctttgtaaaatcagagtaatggatggaaaagagaccaaaaagacacggttcattatcttcctatttcagcctttactttgacaaatgaggtgaccaagcccaagcgtgtaggaggtttacacaaaaccattcagctggttagtggaagggcagggacttagatccatgggtccaacgttctagctaagtgagtttcttcggctgatactactgattccgcttttgaattattcaaatatccttcaagattctgagagaaatgcaaatttaatctttcaccacttttttttctcagataattattgccattatatcagaaagttaagtgatgattttatcaattaccaaagttgattgaggttggttatttgtgaagtcattagaaagcttaccttatccgttatgaacctgactttaagatgagggatgggggatgtggatcacccttgtttttctcgcagaagggctgaggtgtcaccatcctacttctagaaagggagccacgtgtcaccaacaaatcaacagtattaaggagaacgtttgacataaaaagtcatgttttataacaaaaatgtagaacatttattcaagtcaac

SEQ ID NO: 7680 - DNA, 1473 bp, mus musculus
cagtctgaaaattgtttctgtaaatggcaagatagtaaacattccaggctttgcaagtcatctagtctttattgcaactactcagctctgcacttgtagtgagaaagcagccatagacaatatataacaaatgggcatcgctgatttccaataaaactttatttacacactgacatttgaatttcatatgtcacaaaatattctcctccttcttctatttttgctccagccactgaaaaatgtaaaaatcactcttagcttgtgggttgtacataaacaggaaggctagatttggcccatggactgtagtttgtcaaaccctgttctagaggttcaggttaatggaggcattagacacagacattagaagggtgaatcaaaagcagtttacatgtttaaatgatttagaaagtagtccatgcaaccagcttatacaatagagagattctctaataatgcaggagaggcatgggagttcaagttcttggacattaatttctaagtgagtgaaggtcacattagattttctttatatacaattgcccccttttatgtccaggcttatatttatatgacatttctgtatataggctagtctggctgtgtcttgggaccagtttagctgagccagttccccatcatcaatattggtgttacataatattcaatgtgatttcaggctctgcttgggatagtcctctcaggcatgatcactactctctctcagcccactcatgtgtacacagcccggttcatgtgctttgctcagataaggactgcggaattagaaccagtgttagttacccagaggtttttgagagtaagctattgggcctttagaccagtggcaagatcttgattacgcattttaataacacatatttttttttttatcagctcacagtatttttgggcttcattgtttaagtttggaagttgttgttgcctggagtctaagcccagttctactgttggttgctgtgtggcactgggcaaatgattgaagctttttcagccttagcttcctaatttttaaaatgggaatcatacccataacctaacttacagagtttttgtattaaatgaaataatctttgtatcctttcaaggcctatatttaaagcatctggtatatagcaaaacaaacaaataaaaatgcactatttttactacttatacactatttatactactactatagcactactattactattattataattgtagaaaataagaggaaatttggcattcttttcctagtagagtttttgttactctttttaaattggatgaatattagaaagaggagagaattaacttacttcagaaaagacttgcccccaaatcctaggaatattacagatcgcttaatacaagaggaaatcgaatatgagctgtatcattttgaaagaacagctgttaaacatttcaaaaaatttaatttagaaaaggttaattacctttactatg

SEQ ID NO: 7681 - DNA, 1699 bp, mus musculus
taccaattacagtaaataggagacaaacttgttaaaaaccaacaatatcagattaacataagacagaagataaccttgcagatcagaaaacctcaggtgttcttatcagtgaaaacaattttaagaatttctaagcaaaattatctgtgttccatttaggttgtttaacttttatcaaaaaccgcatataaatgcaaagacatacataaatgaccatgttgacttatgatttcaagcctttgctaaatcttcctttaagaccaaaatgttacttttaaaaaaaaaaaagcacacagatgctttcaaatttgttgtcattgcaagaaaagtctgagatgtgtattgagcattggcataagcttagttggctggcatcagagttagtaacaggtggcagagtaagcagtaaaattgcaaaggcagaactgtttgcatttcctgcaatatcatatcaatctttttctagtaagtataattctggtcattagaatcattattttgttttgttttttaatggaagcccagagacacaagaatatttatgtcttattgttaataacttatagagaaggtttttaatctattatatcagaaatagtaatggtcacatttgtgtatcctatggtggcatacaattcacttcctaggcatcattttattttttcccactctaagatgtgaatctgacatccttaaagaataaaatactatattatactagggttgggaacaggcccccaaatctggccataaactggcccccaactggccataaacaaaatctctgtggcactgcgacatgctcgtgatggccatgatgcccatgctggaaggttgtgggtttaccagaatgagggcaaggaatacctggcccacccagggcggaaaaccacttaaggcgttcctaaaccacaaacaatagcataagcaatctgtgccttaaggacatgctcctgatgcagataactagccagagcccgtccctttatttcggcccatccctttgtttcctgtaaggaatacttttagttaattgataatctatagaaacaatgcttatcactggcttgctgtcaataaatatgcaggtaaatctctgtttgaggctctcagttctgaaggcttaaacccctgatttcctactccatacctctatatttctgtgtgtgtgtctttaattcctctagtgccactgggttagggtctccacgactgagctggtcttggcatactagcaacttctatcatcaactaaccttctcattgctgtgtgcttgatttttaaaaatattgcatcattttcccaattttatggattgattgattgattgacacagggtctctttcttccaggctggagtacggtggcacaatcatggttcgctgtaacctcaaactcctgggcccaagccatcctcccacctcagcctcctgagtagctaggactacaggtgtgtgtcaccacatccagttaatttttgtatttttgtatgaacagggtcttgtcacataccccatctgttctgaattcctggcctcaagcaatcctcaccttttagcctcccagctcactgagattatagcatgagccaccacatcaagcttattgaaattctattagtccaaattattgctgttacaaacacgtagaaaatatcttctacataatatatttgaaattttatttggaacaataata

SEQ ID NO: 7682 - DNA, 602 bp, mus musculus
tgaaatctaataccaacatataccagccatgtgactttaaggaagttacttctctggcactcagattccttcattatcaattaaatatttaaatttctatttaattgagctggtatgagaatgaaaaaaaaatgctgtatataccatcagtacatttaataaatgtaaatgattcacacacttccctctccctctctcccaccctctctctctctcttctgaactgtaagttcttgttaattatatgaagaacacagagatatgttcagctatcatgaagataattaatatatgtgggtttttaaaatagatgctatggtgacaacttttgtggagctaaggctaattttggctactcaaaataacaaggaaaatttcgagctctctataacctaacaaaagccacctagaacgacaatgtgtttttttaatagaagccagatttgaagcttgtttttaccattcatgtgacaaatctgcctgataaggcccaggctgctctctacattgaagatgaggtgagcaggcagactaggcctccactgtcgcagacctcaagttcacatgcagaaaaccaattctaatttttaaataagtatgat

SEQ ID NO: 7683 - DNA, 607 bp, mus musculus
ctgactgtgctaggctcaataaggacccctgctgatatccacagctgaatccctggactctgcaggggtgttaccttacctggccaaagggtctttgcagggttgattaagttaaggactctgagatggggggattatcctggattatctcagtaaacccaacatcatctcaagggttctttatgaaaaaattaggagagtcagagttagggatgatgtgaccgcagaagaagtctgggttctgtgagaccgagtcagggaatgcgggtggtctctagaagctgaagaggtcgggagacagactcttccctagaaccttcagaaggaatgctgccctgccaacactttgacttcagcttagagagtcaaactttggacttccagcctccagaatggtaaactaatacacttgtgcagttctaatccatcatgtttgtggcagtttgttacagcagcaataagaaacttatatgctgaccacagctgagcctcaggttctgggctggaagttgagcaagcaccggctgcccttgattcactcaacaactcaatgaggttaaaggtgtgattctcatttcacagatgaaaatgacgagactcagagaag

SEQ ID NO: 7684 - DNA, 1994 bp, mus musculus
aggaagttgccctgaagagtggggtttctcattcctcttctctctgccttatggaaatcccagaatggcttggcagagagttcccaccgcattagaaaacactgcatcaccttgagcaagattggcttttgtcttcacatctctaacatgaggagtttggtctacaaagtgctgtgaacatttctgttgcctgcagaaacctttcttcagaggcaatctctatgtgaaggtcccaatggatgtaaggccctatgtttgagaggggaagggcagagaagggaggagatgaggtgtctggggttgggtgtgcttggcctcctcttcatcctctgtctcattctttaagattcttcaaggcagtctcagaatcttcataagacaaggtttgaggctgggcgctgtgactcatgcctgtattcccagcactttgggaggcagaggtgagcagattgcttgagcctcaagagtttgagaccaacctgggcaacatggcaaaacctcatctctacaaaaaaatttaaaaattagccaggcatggtggtgcaccagaggtcccagctacttgggaggctgaggcaggaggatcagttgagcccagggaggtcaaggctccagtgagccttgacctgggcaacagagtgagaccttttctcaaaaaaaaaaaaacaaaaaaaaaccccataaagtttgaatgttatcagccctggggatccttcgcacccatttaagctctataatcctacaataataatacaaagaatgtctcacccatgtgagctactctagaatttagaagatcccttcataatcatgatctctttgatcctcatgatctttggccctgtgaagtagtccaggcaaatatcatcagctccattttataggtcaggaatttgagtgtcagtataggttgggtgagttgccctgtattgttgagtcctgttgctactgagcctccgaggaggataagtacctcatgtcttgtccctgcctcattttctctttcatgccttctgtgagcctctgccatgttgatggcctgttctgatgagatatactgaaatactggacttctagatctcctgtttggttctcattttggtctaagctgagtgatacaggatgtccaggctggcccatcccctcaaatggcttcctcccctcccagatcacagtgtcatagatgctgtcatccttttcagcccagcaactgtctccaggctccacccaacagcctgtactctggaccagtctgtgccccgccatgtggcaccacattgtacctggagtgcacaggtcaattctctcgacaccatttgatagactctgctctttgggacagactgcttgcatttacattctacttctcacatctcaagatagtggttcccccatcctacctttgccctttgcacactccacctaccatcaactatgggtacctgagggtccaccctctctctgtacttctggcttccaattctctgcaggaatatctaaggccaattctttttttttttttttttttttgacggagtctcgttctgtcgcccagcctggagtgcagtagcatccatcatcttggctcatggcaacctccgcctcccgagctcaagcaattctctgcctcagcttcccatgtacctgggattaaaggcgcccaccaccacgcccacctaagtattttgtagttttagtagagacagggtttcaccatcttggccaggccggtcttgaactcctgacctcgtgacccacctgcctcagcctcccaaagtgctgggattataggcatgagccaccgcgcctggctcaaaggccaattcttatcaaaagtattagttttcagaaccatcagtgaagctataagtgtggatacctataaagaagtttacaaaattgaagagttcactaaacacatctacttttaccttcaaggtcagatgtggcacctaagaccatttttgtggtacagaatgggcttaccaggaagg

SEQ ID NO: 7685 - DNA, 1994 bp, mus musculus; identical to SEQ ID NO: 7684

SEQ ID NO: 7686 - DNA, 627 bp, mus musculus
ttgtattccccacaaaattcatatttcaacacatgaaataggtctcagtgaactttaagccctaactcccaatgtgactctctctggagatagggctttaaggggatcattaaggttaaatgaggttatatgggtgagaccctgatccaataggattggtggccttaaaagatgaacagagggagacttcacaaagaagaggttatttgagcacacagtgacatgttagccccgtgcaaactagaaagagagctctctccagaaaccaaatcagctggcatcttgatcttggaattcccagcctccagaactatgagaaaataaatttctattgtttaaaccactccatctgtggtgttttgttatattagcctgagaagactaatacaggtgtctttcatatgttgtgaagtgtggcttttggagaagctgaagcttaagcttaattggataaaacttaaagtgtaataaataataaataatgttagccaaacaagtgaagccgaggaaaggggaaacatggagtttgtattctataggtttggccgctataacaaaggccaaaataacactactttcaagactgaagtttctttctttcatctcctggtctaagtgtaggctgcc

SEQ ID NO: 7687 - DNA, 1041 bp, mus musculus
taatagcatctttaatgcaatagaaaagcaaactcttggtggttagatctctatgtttagtcactttggaatctttgatgcttttataagtcattggaaatgaaacactaaatttgccttcaagtgataatggagagttgtgtatttcaagcaaatttggggtcagggagtggtgaatatactgataataaaattttagttatgaattaataagaaaactttttaacttgccaactattcgtttatgtagcacttacagcatttcaggttcagtactaggcatacaaaagcaagataagatcctagcagtataaatttgatagtcacaaagtgaaatgagacattagacaggttgctccagtgacatattatgtgtgctgtgattgagaaattaaaagcatcaaaggttaggggaggggagtggatggggaaagtaagatgttgatcaaagggtaccaagtttcagttagacaagagaaataagctttagtactctattgctaagaatggtggctataatacataataatgtattgtatatattttttaaaaagttccacaggaacattcatttgctaagttagggatgagggaagtcttcctggaggaaataaagttaaactaagccttttatttaagtaggaattgggtaaagaggataaaggaaagagcctgtatgtaggttctggagcctttgaaaaatggaaaaacatccagactggtgagagattggagtgtagagaaaagtggcagagatgggtccaggagatgaactaagaagacattggcagtgcccatgagccatgataaaggaacttgtactttatcctaaacctgggatgctattggaaattttaaggagagtcaggacatgatccagttttattttatccttttaacctttctagctacagtgtggttatgcattccaggcaaggtagtatggaggctttttcttaggcaaggccaggggcaggaatagaggcaagtggacagattcagaaagtgtttacgagttagaatgaccaataggttaagtag

SEQ ID NO: 7688 - DNA, 656 bp, mus musculus
taagacttttttgaggccatgatgaaatacacattctcggatcctgtgcaggaaggtttgcataatatgtctcgatagcagtcaccttcacaggtgattctaagattcaaatgcccagccttgattcagagtgactttggctgcctcatgaattaattccctcacaaaattctgataaatgtttacctaaacatttaaacatttcccttggatgtaccacctcctatatgtgtaataaaattctttagtgttacaagagaacatatgtgctttgattttctaagttgttagtcctgaattagtgtttctagagatctttttctccctccaacccccactgatattagatacagtttgggggaatcttctttttcctttagcccttagtgactatttctaggacgacatcctcaagttttgcaacatgaaatatattctactgaggttgagagatgactccctcatacagcagcgaataatttttccaaactattgaatcttgacgaacctctattacattgggaagcttctatttgctgtgctaattttcaccatcctctaagttctgacccttggatcttttagtgtttgcatgctaattttccgttcttcatggtcaatattaaacgattaatataagtacctattaggtatag

SEQ ID NO: 7689 - DNA, 519 bp, mus musculus
gcaaatggaagatttggagacatcccatctgccctagataaacttttgcataacaaatggtgccaagatactggggccatgaaaggtctgtaaaacaggatcagtctgagcattcaaggaaaggggattcttaggaactaccatgagttcacctagctcccttcatcaacttctttttccagatctatttggaaattagtgattgagagtgaagcccgccacctctgggcccatgcagttgtgtgttgtggatccattggctgtgtgtgagcaggaacagatggggtcaaccagtgccatgaagcaaataagaacaaaggagaaacttacagagtaagaaattgaggaagctctgggacatgaaatagcttgcccacaattctcatggctagttggtgcatagcagagattacatccataggtatgactctcaagcaattataaatatctaatatggcataatatgatgactaactctccctgccatctcagagtgacaacatcttattgccacacttc

SEQ ID NO: 7690 - DNA, 995 bp, mus musculus
attgcatggtttctagttgttaaacaatatagtgcttacaatgtgtcaggcactattccaagtactttatgaataataatttgtttaatcctcataaggtatgtgctattattattcccactttgcagatggagactccggcatagaacatttaacagcttgctcaagatcgtccatctcctaatgggcagagctaggttctggattcagacagcctggctccacgatccaagttttaagtaggttcttccacctctcattgacttattctatttatttcatttatttctaatcatttactttatttctaatcatttatgttgtgtccctccactgtttctgctcatcactgcaaagtctttgttttcattacccccttgtgactacctctctgcgccaacaaagatgccatcccctaagtggtcaccatcattggagctgcccacaggtgtgtctctccatagggtaggggaaccagtaggaaattcgactccagtcactaattcacaagatggcctgcagctcagattaagggcagggtagctaccgctggaagaggcttggcaaagaggccacagccacgagcccattttgtgcctttcacagtgatcatcttctcaggtctctgtgctgagtcctttctccctgtgacactctcaactctcaaatttgttcaatgtataaatgaatatgggaatctgtcactactgctcctggccagcacagggcccttgggtgaattagaagttatcctcgggcacctggctagtgacagtgtatggatgtggtctgtgggcaaagaggatactcactttgggtcaaaaataacttcagagatcacctagtggtccaagcccaatcactagttcctttaagtgtaatagttcaatccaacaaaacactgcctgagcatcttctgaagaccaggaagtatgctaagtacaggggagatgaagagaattgtggaaggccacctataataaatcaatgacaga

SEQ ID NO: 7691 - DNA, 201 bp, mus musculus
cagagacaagtttaagatttgctttgttcttttacttaaataattcttagaacaacaaataaaaacaagggagggtgcattagagaatctcagccacatcaacaattatgaggcttctttgttgggtggaccattttgcaatcctggatcaaggtagtttatgccattgtgggcaacgatgcaaaggtttagcgattgggg

SEQ ID NO: 7692 - DNA, 193 bp, mus musculus
cagtaagcacttaactactattattaatatcactactttttatttggaggctatgacttgaattatgagcctcacagagcaaacatatatatagctgttcagttgtcttaataggcaagaaagtaatttttgatccctttattctcttgaattccaggttaaattaaaaataccttttggaaataaattacta

SEQ ID NO: 7693 - DNA, 213 bp, mus musculus
ttaaagtagtgggccaagtagaaactaatttaatcctatgtaatagtgagcttcatggcttttccagactatacttgtagcaagcagaaacatcgatctaatacaagacagatgcacatcaacaccaagttctacctctgagatgtatcttttatccgatctcttctcgtggtctccaccactactgtctgcgttaacttgggctattgtaac

SEQ ID NO: 7694 - DNA, 213 bp, mus musculus; identical to SEQ ID NO: 7693

SEQ ID NO: 7695 - DNA, 1051 bp, mus musculus
gtctaaaaaaccacttcttattttcaatgctgacttgtatgtaattttggtaaaggattcactgtttgcgtttatatggatttctagttttgattagaaaacaagttattgaatttctacttatgattacaaaatgactgaatttgccccaaacactggaaagtaaaaatgtggatggaattcttgttaccacctcaatatcgttcagttaaggagtgggttgtcctcactaaatattcactccaaagatgaaagagctaaagctatccaatcggggtgaataatttccccaagacctcactggagcaacggcaacacaactgtaatattgatatctaagacatcttcctttgccatctcttcgttcattctttgagcaatatttataaagcatgaaatttctatggccctggtgttacattatatactcaggattcagtaataaatgatgattaaaaagacagaattcccgctcttaaggagcttttaagatagagggagatggtatataaaagtaagccccctttgcaataaattctttaaggagcacacaggattcacagtgccctgctggagatacagtcacaagttttctacggtcacaggttttctgcaagaactgacttctacaagaaactgagaaagaactgaagcaggggaaggagtcgaagctccaggcatagggaaaatgacaagagggtaaagaaatcatggctggtgcagggacctgtgagtagccgaatactggggctcaaggttagctaaggaagtgacaaatgaggctggagaggtttgctaggacaagccatgaagggtttgttcattattccatgtcatttggattttatgcagagtctttgtaaaagtgacgtgaagagattttcatgttggaaagatgactaactgcatcgtagaattaatgtgaaagggtggcccaaggaagcaagtttcttcacagctattgcaataaacaggtgaggaatgactgaggtctgaattggatggtgttggcacatgaaaaagatggacagatacaagatatatggaagaa

SEQ ID NO: 7696 - DNA, 311 bp, mus musculus
ttggtgatttgcagagttttaaaaaatatatttacttgctataggactctaaaactaatgttatctatgattttgtgttgtgtttaatttgtgaacaatcttattgctaatatacaaatggaagggaaattaattcctcctacctgtattaggaagttgcatttgcgttaatatcaccaagagagtatagccacaaaacacaagtaaatgcctcttttttacattaaaaattccttttaatgccagtttaccattaagttatataacttcattcacttgttctagcaagcaagatttttcatttgtgaaaa

SEQ ID NO: 7697 - DNA, 882 bp, mus musculus
agacaaatctgtatccagagtgtctattcccatgtgaacaaagtcttgcacttctcttgatgaaaatgatccaatgcaatcaacaagaccaatgcaatcaacctagctgcatatttcctcagagaatggtgctgtagcatagggtactccccagaatttttcgtcaccagttttccaattgtgtttcttctaagcacatattcatataaattgatagccactgcccatgtattgaagtagatctgttcttaaatgatgtctctttctctttccaggcaaaacaataggttcactgctgcaagtaatgccaactgggaggatttcctttcagcagtgttctttagggcctcccatgagtaggactatcatgctgaaacagtcctcttctgagtagtgcccatatatcatgcagaaccacctgtgcaccaggtctaattcttcattctcaaagtcttcattgggactacacaactaacacgttgctaatataattagcatgtgtgtgccttctgggcctactcacatcatattctttttctatggagtactaccgttcacacctaaattgactctgcaattgtgtcatttaaaaaaacaaaaacaaaaacaaacaaaagtgagtcttcagacatattttctggagacttcttgaccagcatttccttctgtactcctcatttaggtttctctactatttgattaaatttgcttcatcgaagaacagtctcaaattttgagtaaaaatttagttctgccagtgatagacttgctcatggcaaaaatgttgtggttttcgttacattgcatctaatcacttcttttcatggtcactgtctaaaccaggtggaagaatggcttcaattttccttctaagaggaaggt

SEQ ID NO: 7698 - DNA, 199 bp, mus musculus
tggtcataatgcatgtgtgactgtcagtgatggagcccatgcttatttctgaagcctcgtggcatttattcaagaaactttagtttgaaaactggcattttactaatttgtctgaacttaaaatgtgtataatgaacaaatgatgtttacttgctttatataagtaagcgtttataaataaaaagtagattttctgtct

SEQ ID NO: 7699 - DNA, 1028 bp, mus musculus
cttagaagaaactctggtcctgaataacttcatcaagctgttgctcaagccttgtactaccatctacatgagtttctttctacctaaatgaaaatcagtcttcatgtgtgcaaatcactctggactaatttcctttgcatataacgaaattcagtcttaactgacacaaaggagaagaaaatcattaatttacactctactctgaattgtaaatgatgatggatagaatgaatctagtaaacatttgaattgggggaactaaaagatgaaaagatacagaaaacattttcggagtagggaatttttcttacatctttactgtatttgaaaatgtggggcaccaaggaatacctgatgggggtgtgttagtgtgatttctatctcaacttcagaacactggggaatagttactacctcagtttcccttgatagccaactggctactgttatgtgattagatatgttgatctcttagtagaaaagattaaaataataattcttatatagttgaacattttatgtaaaaagatttcaatggccacattacatatgatcaaatagaattctcacatttaaaaataggatgataaataaaatacttttaaaaggaaagataattttgaccattgaacacgaatcagccctggaaaaaccaagagcacataatgttcatgcttttggcctttcttaagacttcatctacctgtatacaggattcttaccctacgttatttcaaaggtaatccctgttccaaaatcctcatcttttttccttctttgctagagtatgaaaatgctttccacattgtccacagctagtagccccttctagacatgggttaaaatcacccagcactagaagctgtgccattacaacacgtgcatttttcttaatgacggccaatgaaccataacaaaattgaaacttccctctctggtagtgatcagacaggttcaaaaagaatatttgatgagatgccaagccagcacattgctgccattataaaagcaacgcccacacccaaatc

SEQ ID NO: 7700 - DNA, 166 bp, mus musculus
cttcccactgatgtaccgtttgtcatctgcagcggactctgacaagcgtcatgccagtgacttcgccctgtggaaggcggccaaaccccaggaggtgttctgggcctctccctggggacccgggaggccgggctggcacatcgagtgctctgccatcgctaggtaa

SEQ ID NO: 7701 - DNA, 769 bp, mus musculus
ctgtgctcagccctcccctaacccggctagtcctcagctgccccaggggcacctgggccctcaccaagcagctggcctggaaagagactcacggtgggccatgggtgacttggtttaaaggacaaaaggactctgggtgcatttctcctgccatacaggccatgagggaagagaagaagcagacatgtctctgtcccttcactaagtgtcaggagaaaggaggagacgactgcccatggctgcacttgctgctctttctggcatttctgagttactggggcagccaaaacatcccttctgtgaaatgtgtgtggctggtatcagctggcagccaggacaaactttgtgcagcacaagtgtggcattggagaccctctgtttcttgcatctgccctaggtgagctgtgaaagagcaaggaggccaggggagaggaggaggaggagggctcagtgcagcctccaggcagcaagcacctgcccaaggggctgccgagggtgagcatgggcctcaccgccagccccccgctcataggccacgcctcaccagagaaggtcctggaagtggagaaggtcctggaagttggccacgtgcaacagttagggctgagcaaccgggggtgctcaaggcatcagtcacaacaggaagaaagtgaaataccagggctgctccccgctggggaaaacctgtgtgcctcctgtacagaagggcctttttattgttaatctgagaaagaatgttccgtgaggcttgcttccagctacaaagggc

SEQ ID NO: 7702 - DNA, 314 bp, mus musculus
cacacacaacaccgtgcgtgtagacgccatgcacacacaacaccgtgcgtgtagacgccatgcacacacaacaccgtgagtgtagacgccatgcacatacaacttgcatgtagacaccatgcacacacaacaccgtgactgtagacaccatgcacacacaccatgcatgtagacaccatgcacacacaacaccgtgcatgtagacaccatacacacacaacaccgtgcatgtagacaccatgcacacacaacaccgtgcatgtagacaccatgcacacacaacaccgtgagtgtagacaccatgcacatacaac

SEQ ID NO: 7703 - DNA, 314 bp, mus musculus; identical to SEQ ID NO: 7702

SEQ ID NO: 7704 - DNA, 901 bp, mus musculus
gaactattccttggtgtcagaatttgtgttgcatggactctgcacttcacgacatcttcaaaattttttctttatatttttctttggggtctatgtggccattatgctgggtaaccttctcattttggtcactgtaatttctgatccctgcctgcactcctcccctatgtacttcctgctggggaacctagctttcctggacatgtggctggcctcatttgccactcccaagatgatcagggatttccttagtgatcaaaaactcatctcctttggaggatgtatggctcaaatcttcttcttgcactttactggtggggctgagatggtgctcctggtttccatggcctatgacagatatgtggccatatgcaaacccttgcattacatgactttgatgagttggcagacttgcatcaggctggtgctggcttcatgggtcgttggatttgtgcactccatcagtcaagtggctttcactgtaaatttgccttactgtggccccaatgaggtagacagcttcttctgtgacctccctctggtgatcaaacttgcctgcatggacacctatgtcttgggtataattatgatctcagacagtgggttgctttccttgagctgttttctgctcctcctgatctcctacaccgtgatcctcctcgctatcagacagcgtgctgccggtagcacatccaaagcactctccacttgctctgcacatatcatggtagtgacgctgttctttggcccttgcatttttgtttatgtgcggcctttcagtaggttctctgtggacaagctgctgtctgtgttttataccatttttactccactcctgaaccccattatctacacattgagaaatgaggagatgaaagcagctatgaagaaactgcaaaac

SEQ ID NO: 7705 - DNA, 1326 bp, mus musculus
atgtgctgtggctgctgctttgttgcttgggacctcctctgacctaggatcagacacagagtctgagttctggggcctggaacctcaatgtgcacttgaacaatgaagttggtgacaagcattactgtactcctatctttgggtaagtgttctgggcctaagaaagcatagttttgtggctaatgacaaaagagagttatctgctgtctccatgttttctaccatgatttaccaattgcgggaaaaaatttgtttctatgtgtttcttgagggtgtctgagcgtcagtgtgaggggttggtcatatccactactcagagaagattctccaggtctcacagctctcaagctgtaaggagttttaggttcattgagctcaagggtcatggaagatgggaaatttatttttggccttgtggctctgcatagctcaggaacaaataaataccagtaatatttatcttgtcctgtgcaacacacataaaaacactcaaatatggagtagggcagggaggacagttctggagcagtggtgaacctgaccttcagatgcaccaagagctgatgatccagagctaatctgctgtttttcaaccccataggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagaccacagtgggacagatggggctgcagctgtgcaatatctccctggtgatgaaagggaaggcatctaacgaggccactgcacaagaaggagcagaagtttaatagaggaagaagaaaatttaaagaagaaaagggaaaagaagtaaagaggaggtggtaaggaaatcaatgagaggatgagaggattaaaggaatgaagaaactgagaaagaatagctaagaagtcctgaagaaaggactgagaagcttggcgaagagatgaagaatcacaattggaattctgcagtcaggaagaaaggaaataagaattttcccggacgctttcttttaatcaactcttgctttccatgtagacctcactataaaagatgagaaccatcatctggtagtcccaaagcatttcttcatctagccccaggcaagtgcctgggctttgaata

SEQ ID NO: 7706 - DNA, 1109 bp, mus musculus
tttattgctgaattgcatagggtattatacagtcataacatcaactgtggataaaggacaaattaatttgggaacaatataataacaattgcatcactatgttaaaatttttaaactagattattccaatagttgcaaaattgttgttttctttgaattttggctgatatatagagtgtaagttaggtaatatttgtcagtagttcagatatactgaagatgaacttaaatactgaatttcttatatatttcattttcatctgtcagaatgttttctatcagttatcctttgtcatctgaaaccttgttgtgatatttaagtaatcattaatcagcttttccaacttgttttaaccatgttgcacatgtagaaaattgctggaagataccatttggctattgactagcagagccatctattcactcctttagcttgcaaacacattgtttatacatgaacgaatagagtcctcctccttctccttttcagtatctttatctttgtccctacaccaatcccaagtgctcattcaaagaacaactaacaaaaagatctaggataaaatctaatgaacaaaccaaccttattctttttttggatgtgcttattattattattatactttaagttatagggtacatgtgcacaacgtgcaggtttgttacataggtatacatgtgccatgttgcaaaccaaccttgttcttattcaaatggtagcatgttaggttctataggaacttgagtgaaatatatgcgtaatcttttactgctgtaatgtatccaaaaaaataaaagtagttagataatagaactcttaacaaatgaactggaggcagcaatgcaagatgaagctactatgccagctgtgtgacataaatgaagtacaggttcaagctgctcagaaggtcactgcattatgacttggggactgcaaggccaggggcagcctctcagaggaataagggcttagtctagattgtgaaggaagagtgagatttgcatgagaattattttcatttaatttaggcaaaagattaagttatgatttatgcttgtagatgagtccgtctaaatacaatttccagtcctttaaatgttcatatgca

SEQ ID NO: 7707 - DNA, 1226 bp, mus musculus
tagacaatgttttcacacatatgtagctagagtatcataagagataagaaagagaatggcagagaggcaatatgtgaaaagataatagttaagaactttccaaaataggtacaagacatcaacccacagatccaagaatcacagtaaacatgccagcaggatacatggaaagaaaactgctgaaaacttcataatcaaactgctgcaaaccaaaaataaatagaaattctcaaaaacagagaaaaaagtcacattatcttcacaaagcagtaataaaacttacatttttcccccacacagtatgaaagccaaaaaatgacagaataacatctttatggtgatgaaaaggaattaaactaggtatccacaacagaaaaaaacattcaaaaatgtttagaaacatggtagatggttgatgatctagaaaagcagagggcatttaggacttgcctaccacttgaaattctggagaaggcttcctgttaggtatagaacatgaaaacatactgtggtagccgaagtgcagtagaaatgcagtagtgttgtcatcaggcagagagattgcctgggatagcactcattttttcctacagcttgtgtttaggagggtggacatccagaagttctggtgtttcttcagaatgaggggcatggagatttatgcagtggaccagagaaacctagggttaagctatagtaaggtacaaatagggttgccacagaaatctccacaataacacacacctgaggaaggaacaataaatcattgatgaacacaccacatcacaccacacataacgaaaagaacactgaagattagtgtgcacgtcaaaacctccctttggtatattacaccaatgaagccctctttttgttgcaacccatgacacctttctctttgtatacatcattctatttcctctcatgtacattttatcatggtggaccattttacatcttttaatctttttcttcaaatagctcataatgctccttcaatatttatgatacacagtctttcccttctatctcaatctatgttattcattttacatactggtttacataaatatttatctgtatgaatgtgttagctacaaaagactagatagtctaagttccattgcaaatagcctccacatgtcagttactttgaaaatcaagtctgtttctcagttatagaaaatctgtatcagatctaagttactcctagggcttgtgccccc

SEQ ID NO: 7708 - DNA, 1224 bp, mus musculus
tcttttccaaaatgatttgcatatacttggatcaggttcttgccttatagggttgttggaagttaaaaagctccactcctgtgagctaatatcaaatattggagatgggtatgtacttattattttttagtctgtagctaaagagtaggacattatgtaagtctcaatggtctgtcagtgaataattattgaacacttagtgtataacctaaatttcccaatttataaagaatgtcagagccatgacacaattgacttaaactctttttttttttttttgatacagatacatctgtgtctttaatcatttcggttggtcttctataggtgcttccaatgcaaatgtaggtagaacatttcttgcttggcttaccctctgagaccctggctttaattgtgtcccatcaattaatcttctactccaattcttgatgaaactgacaattcaaaatgctaagactttccccctctttcctctctgtactttggtggcagtagttgttccgcctctccaccatgccatgttatgctcctatcttttcttgataacattctaaccatccttataggcccatcttaaataatatcgcccccaagaaagctgttcctgtcccctcagctaaatgttctccatcccttgcttgaagctccaaaaatgtttcattacacacttacagctcacatgcatgggcctgtggtacagtcatggtaggtgtttgatcttttcaacattaattgtcaatgttatcttttacatatttgtctatatctacacagacagggaagtgaaaggtggcttatgatgtaattcttatgcctgttgatgcacattttctatgtgtttactgatacccacaaaacctaaacttttgcttttattaaaatgatcttacaatagttttatttttctcttctgacctttctcaagacagaaaatctgtttagttcatcttgatttatttatttatttatttattttttctggagcaggtagcacagagtcttatatagatctgagattctataaagatttaagtttaaataaattgaatataatttatgtagaaagcataaggtggaacagagaagacattagtgttttatttacacattatttaccaagcacccactatagtggttaaagatacagaaatacatggaatatagccttttctctccagaaacttactgtctcatagaagaaagcagactgataattatagg

SEQ ID NO: 7709 - DNA, 165 bp, mus musculus
ccacagagggtttctaagaactatattacaaccagctctcctaaatatcccgttctatggcttttcagatgtcaagcaagtgatttaatactaatatatttaagaaccactggcagaaaaatttactctttattgcatctcacatagagcagctgttcaggcaca

SEQ ID NO: 7710 - DNA, 1045 bp, mus musculus
aaataagcctcctctgaggatgagatttggagtctgggaaggttaaatgacatatttcaaagggccacttgcaagccttccttggagcaccaggtcccattcctgagttctggactccgagtctgcccagaaagtatccttaaagcccaatttttcccatctgtgcctgagagctggagcactcaggagaggttccagattgacatctggcgatttaaagttcccctagagttatatagaatgagaatctggcttatattttcttttccctacatagcagctcataatgactcgtctgtcgctggctgttaaagtggttggcaggcctggtgtatgcaagaagccggggtaacagagccaggatgtctcagttggttaagggcgagagtggagggcccaagcatagtctctgattccagcttttgctttgggcagtcacttaacatctctctgcccagtcctcccatctgtaaaatggaaagaggaatactgatgaacctctcaaagaagctgtgaggcagaacccatccatgattaacacagtcttttggatacagaaagggcagtggaaaagtttaaaatcacttcagtatgggatcatttgatataaatgtgtttaaaattactatttggaaatccttgtgcaacaaacctttaatttggcattggctgttagatgtagccagtcttttaggaactactgcagcaataactgccctgtggaaattgtgtaggaaaataatagaaatacatcaagcaagaatgtgcattagatactccattccccagcccctcagcaggcttctggaggtcatactctatgtgttcttcatgtgttcttcatgtttcacttgccccgtagtacctacttcagggccttgcaccaaggaaaccatcggctgagagtcattcttcatggcatggttcaaggccacgagaagctatactgaatggtcctgggactttaatttttagacagaatggctaatggccttgatttgccttgtgtcactttgatagattttctaagtgccaaattgttaag

SEQ ID NO: 7711 - DNA, 618 bp, mus musculus
aggaaagggggaaaacaggatggtgttaggggcacagacaacgttagttaaatctaaatctcaatagtctccttatgaaagcgaaacactaaaacaccaaaaatataaggaaacgcaaagtattttagctgtagaatgagcgttaaatatttgaaaagaatataaccatttacgtgtgggctaggcccctctgatgatggtaacagatgtccataaacagattagtctctagattgcctggagtctcgtagagtttctgagatactgtgtcttttcttcgagtgggcagtggcaaagcctcttctccagtttatattgaacagacacataaatgtgtctatcttttacatggctgaataagttgggagtcactgttggtaaatttcattgtaaaagatcatctgtgaacaaggcagctaaggctaaaggaagggatttggttacgtttacttgaccaaactaagaaaagataaaatacaaagtacagaaatggatgtttataaaatggacatgaactacattaaggtaattaacacctatgtataaatgggacaggttcttagtatttattcatgcaaacaacataaccttaataactttccatacactatttcttct

SEQ ID NO: 7712 - DNA, 1618 bp, mus musculus
atgtccattatttttcattgttttctgttaatactttatgtcttttctaatataaccatgcagtttcctggacttagcatctggaaataaatttcaaaattttgaagtgattttccaccgttttttaaagcaaaatattaaagttgacttttaagtagagtttaatttctttctgtgacagaagaccacttaaattatcctaagacaatggatgtgaacaggcacttttcaaaagaagacatacatgcagccaacaatcaaatgaaaaaaagctctacattactgatcattagagaaatgcaaatcaaaaccacagtgagtaccatccacaccagtcagaatggctactattaaaaagtcaaagagattgcaaagaaaaaggaatgcttatacactgttggtcagagtgtaaattaattaaccactgtggaagacattgtgatgattcttcaaagacctaaaaacagaaataccattcaacccagcaatcccattactgggtatctaccaaaatcaatataaatttttctattataaagacacctgcatatgtatgttcattgtagtactatttgcaatagcaaagacatacaatcaacctaaatgcccatcagtgataaactggataaagaaaatatggtacatataccatggaatactatgcagccataaaaaatgaatacgattatgtcttttgcaggaacatgggtggagctagaggccattattcttagcaaaataatgcaggaaaagaaaaccaaatgcaccatattctcacatataagtgggagctaaattatgattacacatggacacatagaggggaacaacactcactgaggcctattgaagggttgagggtaggaggaaggagaggatcaggaaaaataactaatgggtactaggcttaatacctgggtgacgaaataatctgcataacaaagccccatgacgcaagtttacctgtgtaacaagcctgcacatgtgcccctgaacataaaagtttaaaaaatgtcctgagaatatatcattaaaaatgttatttgaatatcacatcttcttgtataatgattatggatgaaaaagcaggcaagactttttaccactagctttggatgacttagaggagaaagtgagagttgaactgtcttgttgattccctaaagtgagataagttctttctatatgaagttcctgaacatcatgactgatgttagctttcctaatggactttgatgagattttcatgaaagtttttatgttcctaagtttcatatgatttcatatgaaagcatgattgtttaaatataaactaatttccatagatatatgataatagataagttattttccaaagcctattttgtttattcctttgctggaacaaacacccaggcaatgagtcaacacaaccaataagaatgttctctttttccttataatttttaatgaaaatatttataataaggaataatttggaaaaattcagctcataagctaatagaagttgacatatccatcacttgccttatatgaaaccagtttttcaaaagtctatgaagttttggcaaatatttgacaatcgggatgcatggttgatgatctcattccacattaa

SEQ ID NO: 7713 - DNA, 376 bp, mus musculus
tgttgtgaaaatgtattctgggtacatgaccacaaagtgagttgtaggatgcagtcatcagaagaccaaataactgctacttcctagaacatcccttcccttaccctccattccccacttaggaatgttgaccagattgtgggaaacccaaacaatccctttaagtagaaagtacatagattaagaaagtaaccctatgacttatgatcatcagtgactttttttttaaattttgtccctttctcttttcttttcatggtataaaagattagacaagtatgcattgcaagcacacagatttacctagacatcacccaatcccacctcatatgtaagttcccaactaaataaatctttgactacttaacaatctgaa

SEQ ID NO: 7714 - DNA, 514 bp, mus musculus
cagttgtactgccattgtataggtatatttttaaagctacataactgagcacaaactgttccctgttgctgaaccttgttttcatcctacgatattagggatggaaaagtaaagaactagacaaacgtaaatagtcagggactgttgactgcttcaattcacctgcagctaacccaccaagtgggacaccctgtttgttgagaaatgctgtgccaaggatatagcatttaatggctttggcaagaagaatgattttcatcagctgtaacaaacaagttcctcatctccaaccctaccatctgtcctcctggttcccacccagaacgctatctatggtctcaattgaacaggtttcagactgcctaaggtcactatacaatcaaccttaacagatggcatcacagcaaacatctaaactgtagcagtggccaaatgcagaggatgatcctcatcactgaggaagaatgccctctgtgcacactgccctgatgttctggttctgctcaacattgca

SEQ ID NO: 7715 - DNA, 332 bp, mus musculus
ttactattgattcatagaaagcattgaaatattcttggtagtgatcttttgtcatctctatacactgtctctatacactacaaatatcttcatctagtctgttcttatgatttttctctttttcacaatgcctcttaatgaacagaggtgtttaattttactataattcattttattaacaatgccttagactgttctagacttttgtgcttcaagaaattctttattatcgaagtaatatctttctttgttttcttcataaagccggaaagttttggattttttagatcttctattcaaaagagcatttttgacattattgtttataatta

SEQ ID NO: 7716 - DNA, 696 bp, mus musculus
tcctgcaacactttgtgaaataaagaattgaagaaattaattggattaattcagtcaaggtagttgccaatttttatttaaattgtttccaaaggttttctaccgggtgagagggtgggtgggtgaaaagacattatttgtcctcctaccctgagagtatatcagaacctcagctataatgttgagacgatagctttgtatgggtatggggagatggggcatgcatatattttgtaaaagatccccaggggattcagattcttctgtccttatcataatcctggttaggaccaatgtgggcttgacttttactttacagtagccgtttttctcagcttttcagttgccttatatcaacctagtaccgctactccccccacttcttcatttttggaagggcaagtgattgtgatgaaatgagacattttgtagtaaaaaggatacagttttaaatacctttaaaacatttcaaaaagcaatacaattagctaagcacttatgttttattagtaatagcaagcaaaattaataagtaaattcaactaaaaatgattatgtgtcaaagtgtatagtttttacattgacatttcacataatctgactttgcttagaagagaaatcactcggctgttaaaattacttttaaagagctgtcaaaattggaaaacctgctgtcaaaaatatgatgagaaaagt

SEQ ID NO: 7717 - DNA, 292 bp, mus musculus
caggactgaggtaattattagaagtagttttgttacttagcaaacatctaccgaaaaagtagctaataaattaaattacatcaaacttcttggttgctggtctaacataaataacaatttgtctatgcaagtggtcatttacaaaataacaataattaccaaaaagatgacttacaatgagaaatcattcttaaaactggaagcttaatgatatttttgaaaaatattgttaagaaaacaccagaagaaagtattcacctaattaatttgctgtgtctttgtctttgtgagg

SEQ ID NO: 7718 - DNA, 1390 bp, mus musculus
tttcttcagaaagaagaaaaatgacttgtgataatatactgcttctctagttatataatcacaatgttataggccctttctaattactagtaaagctactatgagatttcatgattaagtatttgtgttggtctttttttttaattttacgtgaaagggtagagactgagtaaggctttctagactgcagtagttacttctctttagatgttcacattattctacattagtgcttttgctgaatgttactaaccacagggaagatttttttgtcaaaagagaaagatttgcaatgagacccccccaatttttttttgtgaactcaatgtgaaaaatatatattaatttaagattgaacataatgttttgccatgtatgcagattttaaagcctaaaagaaaacagaattaggtatataagatttctgccaataaagctttaaaaaaaagtccctttgtgtcttgatggcaccttgttatatgaaaaccagggaaccttctccatacacttctctttttcacattgctgctaggttatcaatcttctcatggcatcactctgcttatatcaacccctgctcacaaactatcttggtttcccactgtctccagaagaaactccacactctgacttgatattcaaagccctccaaagtccttctctaagcctcccaccatcacttttctgagttaattatataccaggcttattaacacacccaacctagattccctctaaactgtattcttagccagacttataagtatcactatggcttggggctttcatagcatcactcatactgttctagctccctgtctatcttttcagtttttgctttgtctattttgcctttcacctgctgttaccttaggagagtaaatatttgctggtctgtttctgatagatacccctgcgctggtccacaatacaaagacatcctaatgtaatgccccttgcctgcatggaaagttttaagtcatttttagaaggctttgttatttggcaaagcaataaacttaccatgttttcaggtttcggcatgctcagtgacactggaatgtctttaatatttctcctgatttccacttattccttctagttctaaataaaaataaaagtgccaatgttttacaaatataactgacataaaaaagttttaagtgtgcattagttatacaaaaacaaacatctggatgtttgcaaacactcagatcttgaactaaatgttttttactattttcttcctgatgttcaaggtcataaaaatagatacctgaggtctgatggtattataaaactaaaactaaaactaattctatccatatcttacatttttatggatgtctgaagcatatccatgcatctaatttaaattacattttctcct

SEQ ID NO: 7719 - DNA, 173 bp, mus musculus
agttgtcaaaggggtgcaaattaaaattacagtgagatatcactatatatccaccaaaatggataaaattgaagagaatgacaacaccaaaccctggtgaggatatagagcaacatcagacgttgctggtacaagcattaaaaagtacaactgcttcagaaaattatttgatc

SEQ ID NO: 7720 - DNA, 1814 bp, mus musculus
agtcatagattgctaactataacacttatttaaatgaacctatcctctatggaaagccctgattccaaaggattagctgttgacttccacaaaatggcacaaattaggacaattttcctaggccctctctgtacaatttcatgctcttgtaatgatggccagcaactcagggcaccagctgatgaaaagaggtgtacctcctccaactggggttttttaaacacctgtggctgcaaagatttttaaaatcttaatacccagctagtgatgttatggagaaattagcattttcataacattttgatgagttttggtagaccaaaaaaataactagtttggagagccacgccaagaatatatatcaaggcctttttttttttttttttttttgagatggagtctcgctctgtcgcccaggccggagtgtagtggtgcgatctcgactcactgcaagctccacctcccgggttcatgccattctcctgcctcagcctcccgagtagctgggactacaggtgcccgccaccacgcctggctaattttttgtatttttagtggagacagggtttcaccgtgttagccaggatggtctcgatctcctgacctcgtgattcggccgcctcggcctcccaaagtgctgggattacaggcatgagccaccgtgcccggcctatatcaaggactttttaaatgttcagatgctttctactgaattttatccctaaaactctcccataaagatctcaatgatgccagacgcagtggctcatgcctgtaatcccagcattttggaaggctgaggcaagaggattgcttgaggccagaagttttagaccagcctggtcaacataatgagacctcgtctctacaaaaaaaaaaaaaatttaattagccaagcatgatggcacgcacctgtagtcccagctactcagtaggctgaggtgagaggattacttgagatcagaaatttgaggctacagtgagctatgatcacaccactgcactccagcctgggtaacagattgagaccctatctataaagagagaaaaataaaaaatgaaaggatctcaatggtgatgtttccaggtgctctctgagtccttgctgcatgtaacacttatttctttgtgccatttgttttctgagagcaagttcatcttccatttacccaaaagatctcaaagcagtgcctattatttatgcggttgtcatggctgcttttctgctggagtcagtttttctctcacttgaatggttatgcaagaatattagtcattatttgaataacttggtcatattttcttgcatttatagaataacatattctgctctgtatcatttgtagcagcaaacataaaaccaggtttgatttcagaacaaatccaattgagttgttcagctgatggcatttgggggaaaagaaaaaaactagacttggaaactgtccctctgtttttaaattgtttaaccctttatcaaaggaaatcttacacatatgtgaaaacaaatacttgtcttaaaaagcagggcatatgtgatgggagaagaagtcaagagcactagataccatgatggtcccacctcattccctcccctgctgcctggcctcctctgaacacaatatgaaaaacactgtcccattgtctgtaagttcttttttttttttttttttttgtgacagagtctcactctgttgcccaggctggagtgcagtggtgcaatcttggctcactgcaatgtccacctcccgggttcaaatgattctcctgcctcatgtctgcaagttcttgattgagagttgaaacattctggt

SEQ ID NO: 7721 - DNA, 115 bp, mus musculus
gagtcatgattgaatcccctcctagctccttacctagaggttggggggacaatcttctcaacaatgtttcaggaatgcattaactttgtaaattttaatgttctttattggtata

SEQ ID NO: 7722 - DNA, 115 bp, mus musculus; identical to SEQ ID NO: 7721

SEQ ID NO: 7723 - DNA, 115 bp, mus musculus; identical to SEQ ID NO: 7721

SEQ ID NO: 7724 - DNA, 274 bp, mus musculus
tgagaaacttcacttaccttgtaatcagcataccttcaataattttttttttttggtccatgtctggggttttactggaacccttcctttgctttccatactctatgtagcacatactacctagtggagtactcacacattgttggcactcagtaaatatttgttgaacaaataaatgaatgaatatttgcccctggtaccatggaggatataggaaaaaattggagctgttgttcagccctttcatgaactgggtattacctgaagaaagtga

SEQ ID NO: 7725 - DNA, 1264 bp, mus musculus
aggctaagaattattaactgtataatacaggacaaagagaacagtaatgtgaacaaagatatcgctgaataaaaataaatttgatattctaagtgttcttccttgttattatttttgtattttttccaattgtgtggtggttttcagttgaagtcctgcttcagacctttggcaaatagcatcttttatcattatctacagatactttttgtctcagttgtacacaaaaagcttaatgactatgctccattggctaatacacaaaagggaaatcaggtagaagagtttgaagatgaaatctctggaaagcctgcattttaagcagactttctctcataacagtcttgtgcaatgccttgaaatagaagctcttgttttgtgtaattttccaaggcaatcaatagttctttcttctcataagtggtaaaatttgatattaggaagtacagatatacttctcatcataaaagggagtgtgttggggatgttgcactaatgatacaatcagcaacagcagtatcaaataatgtttattaagctttatttggcaggcattgtggactgcctaaccaatagccattttcctcctttgtcctaacagcatcacctgttttgtccacatactactttctttcatggtgtgtggtccaggtgaagtggaccctattccccagcccagccagtgaatcacagttagtccatgaggcaaccataagggctccctttgcacagctaattgatgcacttctggccagtgagatatgaagagagtctatggggctttgggaaaggttttctttctcaaaaagagataaacaaggctgggtgcggtggctcacacctgttatcccagcactttgggaggccaaggcgggcagatcatgaggtcaagagatcgagaccatcctggccaacatggtgaaaccccgtctctactaaaaatacaaaaattagctgggcgtggtggtgcacacctgtagtcctagctacttgggaggctgaggcaggagaatcacttaaatccaggcagcagaggttgcagtgagccgagatggtgccgctgcacttcagcctggcaacagagcaagactctgtctcaaaaaaaaaaaaaaaaaaagataaacaagaagaaaaggttccctttcaagctctggatgctttcacaagggtaacaagctgaggtgctatagccattttgtcactataaatggagctaggtcaaggataatgcttaatatgccaaggatggcagaggggaaaaatg

SEQ ID NO: 7726 - DNA, 426 bp, mus musculus
ttaagattatccatctagaaatatataaacatagttgtgatttatacactattagtgaagtcaaatactgcctgcttagcaaattatgccagagaacaaccaaaaaaactagctatataagttttcaaaaaataatttttattgtggtaaagatacataacataaaattagccatttaacctttttatgtatacagtggcaataactacattcacagtgttgtgcagccatcaccactattttcaaaagttttcatgactcccaaacaaactctgtacccattaaacaatagcccctccctgcttatccctcctttccctaccctctggtaacttctaatctactttttctctctatgaatgtgcctgttctagttatttcacataagtgggctcataaaatatttgtccttttgtatttggcatg

SEQ ID NO: 7727 - DNA, 327 bp, mus musculus
gggagcgagaaggagacggatgttgagagaacgaggaggaaggagagaaaatggcgtcaacggattacagtatctatagccaagctgcagtgcagcagggctacagtgcttacgctgcccagcctgctcaaggatatgcacagaccacccaggcatatgggcaacaaagctatggaacctatggacagcccactgatgtcagctatacccaggctcagaccactgcaacctatgggctatgcaacttcttatggacagcctcccactggttatgctactccaactgccccccaggcatacagccagcctgtccaggggtgtggcact

SEQ ID NO: 7728 - DNA, 1358 bp, mus musculus
tgattgatgcaaatagattgtttccttttctcaaaaggaattccttcctcacatgtcacagcactaacttttactcttcaattgaagtcaatagaatttgcacatggaaaggggatgtgtatattcaatgagtgactttacctaaccacaaattcagtgacatttttcaagaataaggacttcataattaggcctctagttaataacaacatagagataaaagcaagggaaaggggaaagaaaagtactattttcataaataaaccatttgtctttcttaggaggaagagatagattaataaattattattgttagcaagatcccaagtaaaattttaaagatctccgtttctgtctgttaactgtcaaatatttttagcagaaaacagttgtctctttacatggtgttctacctcccaccctacctgcacccaagcctgtttggatcgagaaatagtgatactctgtgacattttaaatatcatgtcacctgacctgagatctagaagaagaaacagtatgcaagctttaataaagctatttgcaggccaactcccaaatttctagtatttaccgctcctttgcagttcctcttacatttgtaacagttgacctactaacaggttcccagaaacacagattcaaattttggcaggcttacctcacctctttgtccttccaaagtacataaatgctaaactgggttcacagtgagaatgagagtcattctaacaagacttttaaaaccaagaccctttctgctccctaccaagttactgccatcttctccgaagaaataaagttttgtcagtgtgcccttggcataatttcttcagcctggattaaacacaggtgactgagagtccgccttatctccacagggcattagtcactctataaaagttaaatttattatgaaatgctttgtttgtgttaacatatatcttctctgggaagctggaaacaaaggcatgtcctttaagactccatatggggaaaacacatcctcctttggaatttaaccttaatttgaaccaagatctgtgaaagaaaagtactttagtgtattgttcccttgctccacccttctatccccttatctaaatggagttactgttgcttcgtgtttttttaacccttccaattccagtccttgctttcctgagtttaaaatttatcctgggaaagaaatatattaaaataattgtggcaaacaattatactttgcttttaagaatgaattttttttgtaatatattaattctgatatcctttaagttaagtaaatgcacagccagtttatacatcttcattgttcattttgttgttttaagatacattgtaaagaatattttatt

SEQ ID NO: 7729 - DNA, 491 bp, mus musculus
ttatgtcattgatatttttggaggcaccgggccaatgtcctcataaagtatcttacatgagcattttctcatggtgctgactaacctgttgctccatttcctgcattctcaagatactataatttttattcccaggcaagtggaaatagatctgacagagtcagcttgcctatcttggttttgcgttacctctttgtttaggtttttgagagtctttcattcttcagcccaggtacccatgatgtttttgaatatgtaaaccagcatttctggttggtagcaaggatatgaggcagagggctggattgtcacttcattctgacccaaaatttttttcataaaatgtcttcttaatctctgttctcaattaaaatttgtattttctttaaggatataattcttcctggaacttgaatgggaacctcgttgtgaataaaaagagttagaggtcagtattctctttcttctccactgcacatctctttcatcat

SEQ ID NO: 7730 - DNA, 556 bp, mus musculus
ctaaatctggcccactgcctgtttttttaacagctggaaaaaaaatagactattttgtggcatataaaagttttgttactttttcagtgttcaaatttcagtctacaaaaataaagttttattggtacatactacacccattcatttatgtattttatgtggctattttcatactccagaggcagagtagaatagttgtaacaaagactatatggcctgcaaagcttaaaatattatcttatctttacaaaaaaagtttgctgaccgctccctggtgactatgatgacatcatgacatgttctgtgggtttcattgaatattgtgcattcctcataggaacagagaattattctgggtttggctatgttctctccaactccccaatctttgcaattgctgtgatcatagtcattttgcatcctgggggctgtcaatgtcctgtgctctgtggcagcagcagcagtgccttcggctctgggtctagttgaatagcctcttaatttttctgagtggtcccagaggtatactgctatcccagagtttctagaaactacc

SEQ ID NO: 7731 - DNA, 222 bp, mus musculus
ttctcaatagtctatttttccctgaaagccagatgacatattttgaaatttgatgttattataatttgaactaggaaatgagtagaaaatgatcttccactatctagggaaaaacctcctattattagagggataactcatgtaaaatatggtgagggtttttctcctttatcaattaagaaaggatgatttttacaagatcccatcaacaataaagtacta

SEQ ID NO: 7732 - DNA, 280 bp, mus musculus
aatttattttctaatatgagatttctttgaaaatagaatgtctatttgtctactttacaaagtcatgaaaagaaattaatattatcaaggcattttatagtttaaaaagaaattaagttctcaatatcgtaatcatctaagatgagaatatggacttatcttcctaaagtttaaatataatgtcaattgcaaactaataattatctttaatctaaaagtgaagggcaacacactaatattttcctctttaaaatattttaccccattcctaacaatttgt

SEQ ID NO: 7733 - DNA, 816 bp, mus musculus
ctataaggttgtcagtttttcttaggggaatttttttctaccaagataaattacaattttgtctcttttgaggttgcaaaatgaaggttgcaaaggcagcaaatagctggtgcctagaaaagcaataaacttgctctgccttagttataactatataaaaaatgctcaaaacttttgcagtgcttatcataagaaaaatgtgtgtaatttgggactaagtaaggctgtgtagactgatggctatctgaggctctgacttctacaaattagtagctgtgtaatcttggacaagctattaagcctctctgtgcctgttttcttctcaggtaaatgaggctaataataaaacctacttcatagtgtttgggtgaggattaaattacattagtcatgcaaagcttttaggccactacctgaaaaatcataagtgttcaattagtactagttagtattagtcttcatattatttgattcaactacgtaacaatttatggtagaaaattcattaatcattgttggctaagttggctagagcactaattttcaaatctgttgagaatttggagcagtgattatcagttgccaatctagagatacatattagtgtccgctccctctatcttccctagaaataggacccaattttatttggggtaggaaggcatccaagaatgaggcaatgtatcttgggtgaagtatcttatataaactctgggttaggagatgtttgcataagtattttctgggatgctgagaaggctgcttcaagggcaatccctcaacttgagagtgcttcatttttttcttcatctaatt

SEQ ID NO: 7734 - DNA, 521 bp, mus musculus
aagtttatggaattgtttttctatatttgaaagagtaagaagccatactaacctttttaaaaaaaactttttttttgagacagagtctcactctgtcgaccaggctggagtgcagtggtgtgattttggctcactgcaagctctgcctcctgggttcatgccattctcctgcctcagcctcccaagtagctgggactacaggtgcccgccaccacgcctggctaattttttgtattttttagtagagacggggtttcaccatgttagccaggatggtcttgatctcctgacctcgtgatccgcccacctcggcctcccaaagtgctgggattacaggtgagagccactgcacccagccaatactagccctttaacaatttttttttaattctagaattttactctaataaaaatggctctccagaaattgtgctatcacctaaagagtaaaatttatgtctttattctgtctatagaaaagaaaattaacatctaatgatttgcttagaataataaccaca

SEQ ID NO: 7735 - DNA, 923 bp, mus musculus
cctcaggactctatggttcccgcgagggacgaggggcaacgtatataaatgcgcgcaggcgtagttaagagagcgcattttgacttcgaggcaccgccgacgttactgtgtcgccatggggcgccgtccagctcgctgttaccggtattgtaagaacaagccgtacccaaaatctcgtttctgccgaggggttcctgatgccaagatccgcatctttgacctgggtagaaagaaggcaaaagtggatgagttcccactcggtggccacatggtgtctgatgaatatgagcagctgtcttctgaagccctggaggccgcccgtatttgtgccaacaaatacatggtgaaaagttgtggcagagatggctttcacatgcgagtgcggctccatcccttccatgtcatccgcatcaacaagatgttgtcctgtgctggggctgacaggctccagacaggtatgcgaggtgcctttggaaaaccccagggtactgtagcccgggtccacattggtcaagtcatcatgtccatccgcaccaagcttcagaacgaggagcatgtgattgaagccttgcgcagggccaagttcaagttccctggacgccagaagattcatatctccaagaagtggggcttcacgaagtttaatgctgacgaatttgaagacatggtggccaagaagtgcctcatccctgatggttgtggagtcaagtacgttcccagtcatggccccttggacaagtggcgggttctgcactcatgaaggttttggcagtactgtctccttgggccatgctggtctgacttatgcttactaataaattctgtttactggcaaaaaataactccttattaagttttaatattttttaaatatccaatgttttagaatatagactactagagaatttttttctatttattca

SEQ ID NO: 7736 - DNA, 1021 bp, mus musculus
atcatataaatttttaaatgtctaattatttaatagatatgttctgtattagaagtggttatgtttttttctataaacatatttaatgctgaacttatgacacagtctttcaaaattcaatttcatttccaccagtaatgaggtttcttttgggccaaaatgtaagttgtcttccttcattcattaattcattatagtaaggtttgtttactgaaggtcttcttcctgataggtactgtcccaagatctgaaggaacactaatgaatgaaatatagtttttgccttcatggagttaacatgtgtaggtcggttggtagacacaacacaaaccaataaaaataagaaaactgtggattacaatatctgccataataaagttgagacagggcaacagaatagagaacaacaacttgtagaggtaaggctgtttttgccaagatacttaatgaggcctgtaccaaagaaaaaacatttgagctgagatccacactatgggagcaaagcactcccattctgggctgagtaaatgacaactgcaaagtctctcaggcaggcatatgttggagcagggcagaaagaatcactattgatgggaggttaactgtgatgagatcagagagacaggagccagctcctgtaaggatttattgacaaccacaagcagtttggattttattgtaatcacaatggaaaatcactggaaggcttcccatttatccttatatcacctaggtgatatcagtcttccatttcaggaagaaaagggaggggaggaataactaaaaacagcaacatgactattcaaggatgttctgattacctcagattttttttaagacattgagttaaacaatcacaataaataaaattaggcagaactctcaagctaatatccaaaggctaaaggccaagataagttaaggtttgtagaattgcttaaaagggcttttcatgtcttatttagaaaatgttaaacaaggagaactctctttagttctcactgtatatttctgtcttagt

SEQ ID NO: 7737 - DNA, 1328 bp, mus musculus
tagtccttgcctttcaaggcaaattatcaggcagtggggtatcatctgccttctgctgttcacgattggagcagctgggtagtggctttgagcagtgcaggtaaatatgtatgctatctcccaggaggtcatgctgtggtttctcacagaatccatgatacttggcattcagcttgatttttttccccttctataataaaataccatatcaagtccacttctgtcaaatgtcctcattggtttcacatctttaagtctacctgtagattactaaggcagtttcaaaattaatcacgggattctcatatgaaactcacagtcattgttttgtcactttttattataaaatagtgcagtgtctcttatcatttaaaagttaatggtaactccgtgcagttttaacaatatatctcacttggcttccagaacacttgttcaggttactaaattccttggcttgttgctgacagagtttacagaaaaaggaataagtttttagttgagctgatctattttaggacaaaagggagtggatcttacatacactaatgtttacttaaaattatatctctagccaggtgtgtggtggcatgtgcctgtaatcccagctacttgggcagctgaggcgggaggactgcttgagtacaggagttcaaggctgcagtgagctatgatcacatcattgtactccagcctgggagacagagagaccctgcctcaaaaaaaaaaatcatatatatatatatatatacgtatatatatatatatatgtatatatatatatatatatgtatgtgtatatatatatatatatatatatatatatgatagtctcatctcaatctaaattctaattattcactaaaagtacaaagtacatcactcttttgggataaaacccattcctatgccaacgccagagtgagtgtgactggagctggattgtcaattctataattaaaacgtcaattttttgttctttaaaaatgtggttctatttctattcttctattattctctttgattctcagaaagcaagaagaaaaataaacttaaagtttgtacccttgatgaagaattgacccaaacacttctttctgttgttgaagatgaaatgtgccttttgtattttagttattgaaatgtcagccttggaagtattccattttttagaaattaaaggtctcagaagttgctcaattaggatccttttatttgtgactgatttattaatcaattacaaatgtgatttaaaagacatacttttgagatttattaatttgttatttatcaatataattcatatttacttttcattttgagatgtt

SEQ ID NO: 7738 - DNA, 613 bp, mus musculus
atgaattgaaggatgcttagtaacacccctggcctctactcactatatagcaatgcacccctttccagttgtgacaaccaaaaatgtctccagacattgccagatgtcccacagggggacaaaacggccaccaccacctgccgttaagaaccactgccctggtaggagatttaggcctccattcaggcctctagatggttagagctctgcgaggagctccagactgagctcctcactgctttggtcacctctgtctactcagcacttagcacagtgcccggcacatcatggagcctaaataatacttgtcgaatgttagatgaataaatacacatatcacaatgcagaataggccaatagcgaggtataaatagaacactagaagagtccagaaaaggaatacactgatactggagggataggggcccaggaagaagaattcctggaggagagattgtggaaaaatgaggttgaggaaggcatcttaagcagaaatgctctgagagtggatgaggatgagctgggagatcagtcgacctggagtgtagggtgggcagaagatcggttgaagatagggcaaaaagaacttgaactcagttcatggaaggtctgg

SEQ ID NO: 7739 - DNA, 376 bp, mus musculus
tgaatatgacctataaagcatgaagaaaagtgaaattagagaatttattgaatcttaatgcctacagcttttttctgttgagtggtaggggatttagtgatacgagatcacagtttcctttctttgagtctaaacatgcttcttatttttatagaaaataatatctaagtcatgataatacaataattctgtttattgccataaattttagaaccatcctgtggataaagtagagaagtcctaattataacttttgaaaaatatgtaaattgtataaatcttggcagtaaaagtaatgtgaaaaatcagtaactggaaaggatataaatgatagtgaaaatgcactgaagtttttaaattttatataacaggaact

SEQ ID NO: 7740 - DNA, 9340 bp, mus musculus
aagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaaggtttaatggtctgtagcacttgaaagaggaatgtagtgatcattagacgtgatgtaatagaaatagccttgtacatggagtcagaagaacttgctctgagactgtgtatggttttaggtaagctatttaaactctaatcagtttttttcatcataaaaaggataagacattattatcttgtctcatggcgttgtcaggaggatcaaatgggataatatacacaggtgagctagctcagcccctttattttacagatgaggaagctgaagccagagaaggttctacaaacttaagagtcagacagacctgagaccaaggcttacctctattagttttgtactctacattcctgaacgaattgttcaacctctctcagctttaaaatggagataatagtatcttataagactgttgccgggcgcggtggctcacgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatatatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatgtttttttaaacaaatgttgactttttaaaattcttctgagggtatatatttgatactcaaatatttaattatagcatttgaatacttagatgtctttaaaaatgaatgtagttcctaaaagttgtcagtttttaaaattaatacaagttaaaagctggtttataaaccttaggtagttttacctcttatttcatatttctacttatgaagcgaatgtattagccccacaatttataatttattttaaaggtaattttatcaggtacatataactacaggtcaaatcctattgtaaacaatgccactaaaattttctgtcatgttgtatggaaggagtgtgtgtacacatgtatatttgtattaggtatcacttcaaattaagtcaccagtaaatgtttagaaatagtattgttttatagaattataaaaaattattattacagtgagattaacctgtaatgtttctctcctgtcttttggagtattggttatactgtattctctctatactgttcgggggagggggagtcattgcacacacacacgcacgcatgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaatctgagatccttgctttttgttcagatttaagactgtttttttttttaaggcaaaaaataatagatggtaaaaatttggcctttattctaaaaggacagtttgaaccatttaaagaaatattatgggtagccatgtctttaaaaattttgaggcctgatcaaaggacgaatctttatacacattgttattttcaaaggtatttacaaattgagaagcagaatgatgatttcttgccccactaatgacaaataaaataccatttcttaccataaacattgaaaaacaaactgaacaaaacttgaccatataacttacaaatacttttgacttgaatttgcatgtggagtatgtgtgctaaaactgcaagtgaagactttttatacttagaggaatagttgtagagttctttgtaaggttctttgttcataattttttatattttgtgatgtgaataatagtatgcatctgcatgacaacactgcagatcatattgctgtgcccttttaataactggatattttaaaattattttaaatgcagttgtatggtttatcaaatggttctctttttaaacattttataaggaaatttagaccttttctattcaaggctttgttgaagtaatcagtgaaggaaatggtattatatatctatacagtatattgtttaaaggtactttagagaagaattaaactgagacagtgatgttcaagtacataatctgtgcatgctatttaagtatcattttgcaaatataaatatatacataaaaataattgagttagtatataatctataaattcccctataattaagggttgttattttcaaatcttgaaattgtttattttttaaaattccacgcagtgtattatatagggcaaagttcaggaaacatgtttccagtctaaagagaggagtgatgtaagaagaaactagttgacatcttaagaaagggtattctcacttgtgcacacatatccttgattatataatatgctgatttaacatgaaatattttttcacattttaattttgatttgaagttaatcttatatgtcattttgtgcattttttgtcataaatcttcaaaggtcaacctgattttttttttttttaaatgataccagattagaaaaatctcagatgtggtaaatgccatctttaaaaagctaggttatctttgtttcggttttcttttcaattaaatttggataacacttacaaaaaaagtacttctgattcccagaaatcataaagaagcagggggaaggcgtccccgacttagtccatgtgatgcgcacattagcgagtgagaacatccccagcctcccaccagggggtgaattggcaagcaagtaagttacattctgtacactcttatgctttatgtcagtgtatgaaaatgttaggtattcattgataaaatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaagcttggttggcattgatttcctcatagagcataaacgagataatatactgaaagaactttttaaactaaattacatagcactacataaaaatttacaaaattctaagtgtcgttgttagtagtagtataatttgatttggtcaatccctgagtaacttaacaccctgaaaattccccttcctcatatggaccatgtttctatgcctgattttcccagtatttttggttgttgattgctggttagttggttttaggtgtcagggaagaagatagaatatatttcttgtcttttccctttccactttagttcatagaattggactactttgtgttaaatattaagcttacacctttacataataaagtggaaaattcaagcaattccaagggttaaaacatttttacctcaaatatccatataattgacttacaaacataaaacttgcaaatacctttagcttgaatttggatatagagtaaatgtgctaaaactacaagtgaagacttcttgtacttacagtgaagatatattattgactaattttctcgattctctactgtgttttgcaagtgtgaccatgttctttgtaatcactaaatagtgattgtaaaagctcctgtttgaagcttttattttttggaaactttttttttccatatgactttctatgaaacgatctataaaattgcttcaagtcaattttggaagtagggagactataacttataaatatactacagatttttaataaagtgttactcaaaactaattcctagacttgtcatggaaatgtcttatttgacatttcagttttaatagaacttttgaaaagggcattaagaaaagtagaagcttaaatataaagtataatctgagacttcaaaactacgatgcaactcaactagcttatgttagtattatatcttaagaatggcattgccattgatgactcataaccatttaaaccaattcaaatggaagtagactatatagactttttttttaatctgtaatttttagccttctattaactgggttggtagagtgttataacacattttagagtagactcacctctgctttaacataggagcccaaatatcttaaaagtgaggctcactattgacagcaagaaatagaactaaaataatatctgagtataagattatcttagaaattttaataaacacctggctatgagttactaagcaatgttttgctttctgaagaattaattttctgcatttttttacacttaggaggaatgttattgaagccgtttacaatagactgaatccttacaaaaatgacgacactgtaagtagcattttagctccctctgctttcccttcccctccactctaaatgcatatccttcctacctgtttttgcagagctgttcactgtacccattctcttacacacacccctgattgattgctctgaactctgcttgctctgatctctgcctgcaccacagttctagtgattgaggacataatcatggtgagtggccacctctctcaaaaaagaagaaagtccttttgaattattctagattttttaagtctttacaaacaatcaacttcagaaggtttgcctccactacatggttttttttttttttttttcccgaagttgggactatctctactcagaatattgtcttattctgagttttgtaagcagctgcagcagaacttcggaatgtctgtctcaactaaatagttcttatggttggaaatacctttgtcaggaatcctgaagtatatacttcacttaaatattagagaattgtttgcataaatagacattagaatgccatactctccagttaagtgttctgttgcaattctgttgtatgatgtttatagaaaagtgataacttaaagatcatgtgggcacagctctgaaatattttatgtattgcattatgaagcttcctcacatattgagttcttaatcttttctgatgcattaaaggtttataaaagtggtattctaaaactgtattggatttcattaaaaaattctttttagtagatttattgattgagtaatacatttggacagcctcatcataaaaccgcatttcaaatattttccaaaacaaaacaaaggattaacaattctttgaacagattaaacattgctatttcatatgtacacatatatacttatatactttaaaaaacatttatattctaaaagtcatctttacagaacattatctttctccattatccagaaagtatggtgtattttggcaccgctaaattttaacgttgttccttattttgcttccttttacaaaggactctacatcaacagatgatatgtggtaaaactgctcatctagccatggagtttac

SEQ ID NO: 7741 - DNA, 9340 bp, mus musculus; identical to SEQ ID NO: 7740

SEQ ID NO: 7742 - DNA, 9340 bp, mus musculus; identical to SEQ ID NO: 7740

SEQ ID NO: 7743 - DNA, 377 bp, mus musculus
agctgaatatattgctgataatgtacggacctgttacagaggaagaaacagaagacagaataggcaactagaaagctttacaacataagtctcactattcatagttatgtatttgtgtgataacaatgtttgttttccacttcacagtacagctcatggagggggcctctatcctggcatctaactcataggagagaataaatatttgttgaatgaatgaatgaatttgcctatctattacataatattttcctcagtatcaactctcacttgttcttgtaatttgagtcatataaagccacttgttggatggttctgaaaactggacaacatggattgtgtgagatttagccaatacagatataactacatcttcc

SEQ ID NO: 7744 - DNA, 966 bp, mus musculus
aagagttatctacccagcaatctgtttccctgtctgggggagggggttgcatgcaggctgggggacaagacgggcagctggaggtgccaagatcaatggcctcaaggggtgctcccaactgggtgctttttcccatacaacctagcgctatgcaggtgctgaaggtgacacctctgctcttgagatctggctctgagtaggcctgaggtgcacgcccctctgctctctcctcccctctcccttccctccccagagagaaaacactcacttgccaggtttatccagaagcccccccgcagggcactggcagcacatcaggatgtactcctgcagggcctgctgatggaacatccagtggctcatgctaagggcagggtcacctgttgaagggcaaagggtcagtaagggcccggcagatccagccaagtatcaatgacctaattccactttctcacctgggggaatagtcaaggtttcctgctccccttcctcttccattcattcttggtacaactgctatcttccccatgtcctacgcacagcatgtcccttctcctgaactttgacatgtgtcaaagagcagcaattcaaagtggcactttcactttcttgaaatgcaccctgttaacgtggatggtgatcctcaaccacatctctggcaggcagtgaaccagcctagctgtttagcttaccttcccagactgacctcggtagctgctcccaacttggtccataactctaccctggacttcaagagacattccctctagcatatctctataacttgttaaccagactgattagctcagagaactcttaatgggtaataaagtctgtttcttctacttttctaagcctaaatttaattgatctccaaagggaattctctaacttgtctctcagctcaaagaatttacctaagaaacattactagtaactgccctcctgcatcatatgataccctag

SEQ ID NO: 7745 - DNA, 966 bp, mus musculus
ctagggtatcatatgatgcaggagggcagttactagtaatgtttcttaggtaaattctttgagctgagagacaagttagagaattccctttggagatcaattaaatttaggcttagaaaagtagaagaaacagactttattacccattaagagttctctgagctaatcagtctggttaacaagttatagagatatgctagagggaatgtctcttgaagtccagggtagagttatggaccaagttgggagcagctaccgaggtcagtctgggaaggtaagctaaacagctaggctggttcactgcctgccagagatgtggttgaggatcaccatccacgttaacagggtgcatttcaagaaagtgaaagtgccactttgaattgctgctctttgacacatgtcaaagttcaggagaagggacatgctgtgcgtaggacatggggaagatagcagttgtaccaagaatgaatggaagaggaaggggagcaggaaaccttgactattcccccaggtgagaaagtggaattaggtcattgatacttggctggatctgccgggcccttactgaccctttgcccttcaacaggtgaccctgcccttagcatgagccactggatgttccatcagcaggccctgcaggagtacatcctgatgtgctgccagtgccctgcgggggggcttctggataaacctggcaagtgagtgttttctctctggggagggaagggagaggggaggagagagcagaggggcgtgcacctcaggcctactcagagccagatctcaagagcagaggtgtcaccttcagcacctgcatagcgctaggttgtatgggaaaaagcacccagttgggagcaccccttgaggccattgatcttggcacctccagctgcccgtcttgtcccccagcctgcatgcaaccccctcccccagacagggaaacagattgctgggtagataactctt

SEQ ID NO: 7746 - DNA, 966 bp, mus musculus; identical to SEQ ID NO: 7745

SEQ ID NO: 7747 - DNA, 1805 bp, mus musculus
ctgttcacaggttatcttgacgaatcagattacaacccatctgagtggagccctggcttctcaggcagacctggtgtctccagctgatgatttgtccctgtctgaaggtaaggaatctgtcctggagaggctgaaacttgacactgacatagagccccactgcctctccacctcctgttgagagctgggagatatggctaataggccctggccagtgaacccagccggagcctgttgatttaggtttggccacctttcctggcatctgatctcttatattggggagtcttttgccctgcctctataagggagctccatttggaggccagtcactcctctgtgtgttatttcaagtccttagtatgagggctgatgaattgttaaatgactttgtttttgagactgatactcaaaggttggctttcccagtggtcccctagcaatttagccttttgcttgtgctgagttcttttggactaaaaagcgtacatcagtttcatgtgccagagatatgacattcctgatcagctttacagaagattaagaaaaaaatctccacgctggtaaatctgcaaaattttctccaccctcccctgctagcaaaggtcaggctggctatggtttcgatggcaataagctttacgtagctggggaaataacaccaataaaccagagggtggtttctagttttattgaaagtgcttacttgacatttctgagttgttatccttgtagtctagtatctttcatgcagaatgctgtgggtctgggtagacatgcatagctcttccaggcccctcctccctttccactttctgagaattgctcatgaaggaatacaggagacttttaggcctagcaaggctcctggatggctgcccaggtgatcttctgcagatcagctttgctttatggtcttagaaattgcaagaaccacacctctgcttcttagtggtggctttaggagggaaaactagtggctaatttatgaaaactgtacaatgctttgtgtacgctccttccaagttcagggatacatcatcataacccctatcagcgaggctgaaaacctgaatcatcgagcattcctccctcctgaaacttttgtcatcaagtctgcttagtacttctttccgcatgtatctttcctttgtcccctcttttttgtaatgtgtgttgtgatcagcagatttactaaactcccaattgaattattttaataacatccagattggccttcccagctctagcctctacagtttccattctgccactaccaaattgaacttccccgtctggccttgttctgctctgttgctctcctactcagaaatcttagaatagttttttttgtttgtttcttttttgttgtttgttttgtttttgtttttgttttttctgagaatgagctaaaatcagtaagctgattttaacatatttagggatttgggatttgttagcttgaaatcagccatggtgaaagtatttataccatggaaatcagcaaatgctgaaaatcaggtggcttgtttttttatttcctccctttgcgtagactggttttcaaaacaccactagataaagtgaatgatttcaacccttcataatctgtcatttcctttctattcaaatttagttcctgccgatatcttaggtgaagctcctatgccaagtgtgccactcttggcctgcccctccccactcccagctccaggcctgtgcagagacagctcacctagaacagtgcttccccctttcacttcttctgcttctcgtcccacatccactccttcgaggcttattta

SEQ ID NO: 7748 - DNA, 1805 bp, mus musculus; identical to SEQ ID NO: 7747

SEQ ID NO: 7749 - DNA, 1805 bp, mus musculus; identical to SEQ ID NO: 7747

SEQ ID NO: 7750 - DNA, 908 bp, mus musculus
ttcgaacaacttctttttttttttttttaaggaaaatttgtattattttaattatttttatgtacagaaaactcaacagtgtacatttaacccagtttagtggcaagttctttagcctttgcctttttgcgcttggcgatacgagccacagacttaggacccaggacattgccaccccagtgacggcggatctcatcgtatctgtcattgtaattggtcctgatagcttccaccagcttagccaaagcgcctttgtcttctgagttcacctgtgtgaaggcgacagtggtgcaggtcttcctgtggactagacgtcccagtcttgccttccccttgataatgcagtaagggacccccattttacgacatagggcaggcaagaagacaaccagctcgatgggatccatgtcgtgtgaaatcaccaccagctgagctttcttgttctccaccaaggtggtgacagtgttaactcctgctcgaaggacaggtggtctcttcttcgggacgtcccctttgccagcagctttcttctcggcccgggccaacagtctctgcttcttctcttgctttgtctctggcctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttcggcatcttgggcagcgggaggagaga

SEQ ID NO: 7751 - DNA, 883 bp, mus musculus
ttaaggaaaatttgtattattttaattatttttatgtacagaaaactcaacagtgtacatttaacccagtttagtggcaagttctttagcctttgcctttttgcgcttggcgatacgagccacagacttaggacccaggacattgccaccccagtgacggcggatctcatcgtatctgtcattgtaattggtcctgatagcttccaccagcttagccaaagcgcctttgtcttctgagttcacctgtgtgaaggcgacagtggtgcaggtcttcctgtggactagacgtcccagtcttgccttccccttgataatgcagtaagggacccccattttacgacatagggcaggcaagaagacaaccagctcgatgggatccatgtcgtgtgaaatcaccaccagctgagctttcttgttctccaccaaggtggtgacagtgttaactcctgctcgaaggacaggtggtctcttcttcgggacgtcccctttgccagcagctttcttctcggcccgggccaacagtctctgcttcttctcttgctttgtctctggcctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttcggcatcttgggcagcgggaggagagag

SEQ ID NO: 7752 - DNA, 825 bp, mus musculus
tttaacccagtttagtggcaagttctttagcctttgcctttttgcgcttggcgatacgagccacagacttaggacccaggacattgccaccccagtgacggcggatctcatcgtatctgtcattgtaattggtcctgatagcttccaccagcttagccaaagcgcctttgtcttctgagttcacctgtgtgaaggcgacagtggtgcaggtcttcctgtggactagacgtcccagtcttgccttccccttgataatgcagtaagggacccccattttacgacatagggcaggcaagaagacaaccagctcgatgggatccatgtcgtgtgaaatcaccaccagctgagctttcttgttctccaccaaggtggtgacagtgttaactcctgctcgaaggacaggtggtctcttcttcgggacgtcccctttgccagcagctttcttctcggcccgggccaacagtctctgcttcttctcttgctttgtctctggcctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttcggcatcttgggcagcgggaggagagagc

SEQ ID NO: 7753 - DNA, 935 bp, mus musculus
ctctgaagacctgagcaggacaacagtgtgagcagctggaagacctcctccctgtaattcctcccagtgagaccaaggggacttcatatgctctgctggaggtggagagagttacccagatggggagagctcatgtacctggattattctttcaaaatccccaggaagaaaaccctgtgggctgggggattgtgcaggcctatctaggcttctagaatggctgtgcaggaatttgaggacaaaaaaggacaagaagcagcttcccttggctgtcgctggcatcttccagcctgtgcccaccttggctttgagctgggtcatagtaacactcctcacaccctgagggatgagggatgcaggggcagagaggaaggtctacagtagggtctttcctaaaacaagctctccccagggaggcctgcaagccagctccctctcactctccattgtcaagacaaagagaggaagaggatgccttctgccatcatcccctgagtccattttccctggatcatccatggagagtgggggctcaatgatgtttgccctggtgcccccaataccctctctagggccccagtccctcaggaacagacccagacctggcaaatccccaggaaagggcacagacaccaggctgagggggcaggcgaggtgcagcagatcccagtgggccccggctagtcctagtctgaatgactcattccttgtttccgtccactgtggtctgagtgccttggcccaggggcccccaagaggttgtaacacaggctggcctctcgcccatcagggctcagcagacaaaaattaaagatctcactcctcaggaactcacacagacagcacaggcatgctctgtactctgcctcaccagaccagacctcaggccagaggaggctgatggccaagagaggaaggaaagtcgtctccagctg

SEQ ID NO: 7754 - DNA, 1067 bp, mus musculus
aggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaa

SEQ ID NO: 7755 - DNA, 206 bp, mus musculus
agggcagagccaagagaatcactaagaacagagtcagacaatgtctgggtccttcttacctcctaagtgctgcagttatatcggtttaacttggggtttctgttatttgcaaaccactgaaagcatcctaacttatccataagctatcttaaatactggcttggctgcagaagcaagtaaaaagacctcttcgtgaaaaggaaaat

SEQ ID NO: 7756 - DNA, 1560 bp, mus musculus
gaaatcaaaagccagtaagagactccttcttgttcccccatccccagccttctgcagcctcacctcttcctgaagaaaatgcaaagaaaggcctggttgctgctggataatgggggacgagaagaaggaggtgaaaaaggaaaagtgggaggagggggtctcatcactgagttgtgaaaaaaagtctgaatctgtcataattatgtcaagtcttccatttgctaaagaatctctagtgaggtattcctgatgtttcggttcttttttggcttgtgggagggtccaattgccaaagggtgtgtctctcttcctttttgccctttttatccaccagaagatatgccatgctctattctagtgggacaccctttattggtttgcattttcatgctcttttgacagcagttttaggtcagccttaggttggtcgctggctccccccttcctgtcccccagtttttccaggccagcccatgcccacaggaaagccttgtggtgaggcaggatgggcaagattgctcactgggtccttctttcttttcttttcttcctttcctccctccctccctccctccctccctgcctgcctgccttccttccttctcttacgttattttgaagcttaggcattccctatcttcacgttatgctgagggtgtgttttttgtgttgctttattctttcatcttgttcttggttggttttggaggaaacattgagagatgacgtgacatggcaggtgccatcgtctccatgagatggaaaggagaggtgtcccctggaacttggggatgaaggggacgagaaacaaaaagggaccatttaagattctacaagacaaaaaataaccccccaaatcagatggcatataaccctcccttcagctccaaaaagaatccactaaaaccctggacattgttatactggtagaaaaggtgccattgaactagacatctggtaaaccactcccagatcactgaaatgaacagggggaaaatgaataaatctatacggagtcattatataaatcagaaaactagattcaacatgcctgaactcataaaaattactccctgggccgggcatggtggttcacacctgtaatctcagcactttgggaggccaaggaaggtggatcacttgaagtcaggagttggagaccagcttggccaacatggcgaaaccccatctctactaaaaatacaaacattggccaggcgtggtggcgggcatctgtagtcccagctactcaggaggccgaggctggagaatcacttgaacctgggaggcggaggttgcagtgagttgagatcgcgccattgcactccatgctgggcgacagagtgagactctgtctcaaaaaaacaaaaaacaaaaacaaacaaaattactccctgaaaaatcaccatgaggccgaagaaaactgtaagacattcctccaaactatttaaacagactaaagccagcatttggggatatgaaaaaccactatgaaccagaaattcaaaaactaagaacaaaaatggacaaaagcagaaactttctgtatagctttgactt

SEQ ID NO: 7757 - DNA, 1040 bp, mus musculus
atttaggtttcttgaatcaggtcaccgatttttaagtctgcatccattttagagaactctccctccccactccccttcaacatatcccatcctctttcacctatccattcagattctttcatttaattatttcagaccctgggaattagcagtcccttcttgaaagcattggaatggggcagttttaatttttattagtatcagctttctcctcctcactgccatatttacttctttgggaggaaaaggaagtgcatatgtagctataaaagaagacatagcccaggtttctaggatttgcacctccgcattggcaaattttcccagtctgtgtctccaaacagggttttaatcacctgggctcttgtccttggcattgaaagctttaagagtactgcagaaatggtaaattaaccacatttaacaaaatagaaagttttcattgtgtcataaaaagccctattgatcttgttcaggcattgactccaggtccttttaacaagccactctgtctagacttgcaggctagagcccacagtgctaacaaaggaggagctgggctgccctccctccccctgcaggggaaggctaagaggatgggcacagattcaggcttctcaatggggattttcttaaagaactagcatgattttattctgctgtggaaaggaaaagcattaggagacttgtggcagatgtacctgtcacttactccagactccagccttgtttgactctctgtgtctgctgtggaactaccccatcataacagattaacgtgtcttccatatccctcagcttccagcaacatttcctcctgttgcccttaggaaggtaggctgaactctgatgccaacgcacggagcagtgggtctccagaaagagcgtggaaagcaacgatggggcaggaggaggaattggcaactttagaatcactgtgaccaactcaacttcatttcaattcaattccacaggtctttacttaacaaattctgggtaaacaggagattttgaaaaggcaagaaaaattgctgctcaca

SEQ ID NO: 7758 - DNA, 1040 bp, mus musculus; identical to SEQ ID NO: 7757

SEQ ID NO: 7759 - DNA, 993 bp, mus musculus
aggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaag

SEQ ID NO: 7760 - DNA, 993 bp, mus musculus; identical to SEQ ID NO: 7759

SEQ ID NO: 7761 - DNA, 993 bp, mus musculus; identical to SEQ ID NO: 7759

SEQ ID NO: 7762 - DNA, 511 bp, mus musculus
ttttccagaaacaaaagcactaataagagagagagagattataagacattggcttacacaattgtgatggctgaaaagtcacagtgtccgtagttggcaagctagaggcccaggagagctgatgtgtagttccggcccaagtccaaagtcctgagaaccagggaagcagttggtgtaagtttcagtttgaaaaccagcagcctcaagacccaagaagagccagtgtttcagtgttaagtccaaaggccagagaagagcaatgtcccagctgaaacagtcaggcagaagacatttcctcttacttggtctttttattccattcaggtcttcaaatgattagatgaggcccatctgcattatagagggcaatctgttttgtttcctatcaattcaaatgttaatcttatgcagatgcaccctcatagacacacccagaataatgtttgacaaatatctgggcccccatggcccagtcaggctgacccatgaaattgaccttcacagagtgttc

SEQ ID NO: 7763 - DNA, 1879 bp, mus musculus
gcctgtggaaaacagtctgagtgagccagtgcaatgtgatcctgtcttcagatccatcagcaaccaaaaaagtaggttaagttttggaacacgtgggtgatgttaattttcctcctgggaactggcctagtaagagaaatgttgccagtagaaactagctattttgtggagtaataaagctgtgatagaaaaagggtgaaatctgattagtattgggctagacaaggaagaaccatcactcctgtgtttgttatgtaaggaaaacctacggtgactataaatagttctagatgggagtgattcacttcaccaccactagtttgccatcagtttcctatttatcagatgaggagttaggagaagataatgacaaaaggccctttcacttctaatatttgtttgcgtctagatggtaggctgtagcgttgtataagggaaagcccactatcaggatctcaggaggctggtggtagttgtgactctgacactaaagtattgccactagttttgggtattaagaagtatttttggttttgcacaatattttacatgaatcttttttttttggaatgaattcctaatgctagatcaaaagtactcatttataaaatgtttattctattaccagaacaaacccaccacattacactcatactagttatataattttgcctacttcactacaaattctccccaaatgaatattataatgaaaataaatcaagatcaatatgagagttttgaaaatgacttaggaacacaaaagatatgaatgccttcagaaacatttagatggcttaaagtattgttttgtagctttttaatttatctgtggctaatattttacccaagattagtgtgtgtgtatatacacacacatatatgcgtatatatgtatatgtacatgtatataatttgtttttcttttctctttttctttgatgctcaattccttggtgtaatttaaataatcttgccctatttacaaaagctttcagattttggtagcccctttgcaatgcttcagtgacagatcccaattgtgtttgagtacaataagaatgtttgttgtattcttaagactgacatcacaatgaaaacctactgatatagggaaaaaaaaagtctctccatcaatgtctaagctctcggagtcatctatatatatatatatggatgatatatattcacattctctctctatatatatttcaatctcttttctttaacaagtattaccaaaccccactctaatccctctgttgcccagagtgtatgcagaagggatcttaaagtcatctaggccatgttccttattagaatcaaaatcagaggggttaaatggcttgtccatcattgcgcagctcttcataaattaaggtagagaattctggagtgatgaatgtttgtgaagagttttcatggtggtaaatacaataaagtgatatgtgtggcatgcaaagaagcaagatattgagtaattctccacccttctcattaaaaaaaatacacattagacttgttgtaagtcccaggcctgttgtttataagacttatggtacccttatgcaaatcacttcatctcttaggaactcaattttcttaattataaaataaacaatcttagatcaaatgacacctcaattctcttctaaagttaatattcaagcattttctctgggtcacaccaaaggcctgctccacaggctgttgtattagcacagcattatggtgagtccatgaagcatcaagattttcatctttgtgcattttcattgtctacaagcaaaagatgacagattgaaggcctgaattttattttcaaagtcacataaccaggccagagcttaaatgtaatgttgaaaaataaagtagtaat

SEQ ID NO: 7764 - DNA, 7036 bp, mus musculus
gcctctaaaagtctcatttgattagggatttctgttagttaaattctgctttataaaactgctttgcttatgtgtttctcattttctaggactttgtttctgcaaagccaaaatataactgcttaaagcaaaagttatttaataatgtttagatatctaatgatttataattactattatcgttgccagtaaatatttattgtgtttcaatgggttatattccactgtactaaatattttcttgacttcaaggtgtattcttttgcatttaatgttgtatatgtagtcaacataagggagaataacatatgcagatgcaaagtgtattgggcgttagaaaccgatatggtcttggtctgtgtctatacccaaatctcacgttgaattgtaattcccaatgttggaagagggaactgatgggaggtgattggatcacgggggcagatttcccctacgctcttcttgtgatagtgagtgagttctcaccagagctgatggtttaaaagtgtatggcacttccccccttgctctccctctctctctctctcctgctgccttctgaagaaggagcttgctgcttcttttccttctgccatgattgtcagtttcctgagatctccagtcatgctttctgttaagctcgtgaaactgtaagtcaattaaaactcttttcttcatgaattactcagtctcaggtagttctttatagaagtatgagaatggactaataaagaaacttattttatgcacacatacacatgcaaaaattaccatactattttaataaatgtatcttattctctatttatatatatctagagaaaagccaaggatttcttacttaaaattttgtgctcttcatgtcaggggaggagccaagatggccgaataggaacagctccggtctacagctcccagcgtgagcgactcagaagatgggtgatttctgcatttccatctgaggtaccgggttcatctcactagggaatgccagacagtgggcgcaggtcagtgggtgcacgcaccatgcacgagccgaagcagggcgaggcattgcctcactcgggaagcgcaaggggtcaggcagttccctttcctagtcaaagaaaggggtgacggtcggcacctggaaaatcgggtcactcccacccgaatactgcgcttttccgacgggcttaaaaaacggtgcaccacaagattatatcccacacctggctcgggggtggggagcgggggtcctacgcccacggagtctcgctgattgctagcacagcagtctgagatcaaactgcaaagcggcagtgaggctgggggaggggcgcccgccattgcccaggcgtgctgaggtaaacagagcagccgggaagctggaactgggtggagcccaccacagctcaaggaggcctgcctgcctctgtaggctccacctctgggggcagggcacagacaaaggaaaagacagcagtaacctctgcagacttaaatgtccctgtctgacagctttgaagagagcagtggttctcccagtaagcagctggagatctgagaacgggcagactgcctcctcaagtgggtccctgacccctgacccccaagcagcctaactgggaggcaccccccagcaggggcacactgacacctcacatggcagggtactccaacagacctgcagctgagggtcctgtctgttagaaggaaaactaacaaagagaaaggacatccacaccaaaaacccatctgtacatcaccatcatcaaagaccaaaagtaaaaccacaaagatggggaaaaaacagaacagaaaaactggaaactctaaaaagcagagtgcctctcctcctccaaaggaatgcagttcctcaccagcaacggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcaagaactacgtgaagaatgccaaagcctcaggagctgatgcaatcaactggaagaaagtgtatcagcaatggaagatgaaatgaatgaaatgaagcgagaagggaagtttacagaaaaaagaataaaaagaaacgagcaaggcctccaagaaatatgggactatgtgaaaagaccaaatctacgtctgattggtgtacctgaaagtgatggggagaatggaaccaagttggaaaacactctgcaggatattatccaggagaacttccccaatctagcaaggaaggccaacgttcagattcaggaaatacagagaacaccacaaagatactcctcgagaagagcaactccaagacacataattgttagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttcaagaaaagaattttcaacccagaatttcatgtccagccaaactaagcttcataagtgaaggagaaataaaatactttacagataagcaaatgctgagagattttgtcaccaccaggcctgccctaaaagagctcctgaaggaagcgctaaacatggaaaggaacaactggtaccagctgctgcaaactcatgccaaaatgtaaagaccatcgagactaggaagaaactgcatcaactaacgagcaaaatcaccagctaacatcatcatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaggcaggggttgcaatcctagtctctgataaaacagactttaaaccaacaaagatcaaaacagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacacccactgtcaacattagacagatcaatgagacagaaagtcaacaaggatacccaggaattgaactcagctctgcatcaagccgacctaatagacatctacagaactctccacgccaaatcaacagaatatacatttttttcagcaccacaccacacctattccaaaattgaccacatagtgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatcaaggcagaaataaagatgttctttgcaaccaacaagaacaaagacacaacataccagaatctctgggacacattcaaagcagtgtgtagaaggaaatttacagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacacttcaaaaaattaatgaatccaggaactgcttttttgaaaggatcaacaaaatagatagaccgctagcaagacgaataaagaaaaaaagagagaagaatcaaatagacacaataaaaaatgataaaggggatatcaccatcgatcccacagaaatacaaactaccatcagagaatactacaaacaactctatgcaaataaaccagaaaatctagaagaaatggataaattccttgacacatacactctcccaagactaaaccaggaagaagttgaatctctgagtagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagtatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacacgattatctcaatagatgcagaaaaggcctttgacaaaattcaaccacccttcatgctaaaaactctcaataaattaggtattgatgggatgtatttcaaaataataagagctatctatgacaaacccacagccaatatcatactgaatgggcaaaaactggtagcattccctttgaaaactggcacaagacagggatgccctctctcatcactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctgcttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaaaaaaatacctaggaatcctacttacaagggacgcatgaaggacctcttcaaggagaactacaaaccactgctcaaggaaataaaagaggatacaaacaaatggaagaacattccatgctcatgggtaggaaaaatcaatatcgtgaaaatggccatactgcccaaggtaatttacagattcaatgccatccccatcaagctaccaatgcctttcttcacagaattagaaaaaactactttaaagttcatatggaaccaaaacagagcccgcatcaccaagtcaatcataagccaaaagaacaaagctggaggcatcacactaccagacttcaaactatactacaaggctacagtaaccaaaacagcatggtacttgtaccaaaacagagatatagatcaatggaacagaacagagccctcagaaataatgctgcatatctacaactatctgatctttgacaaacctgagaaaaacaagcaatgggaaaaggataccctatttaataaatggtgctgggaaaactggctagccatatgtagaaagctgaaactggatcctttccttacaccttatacaaaaatcaattcgagatggattaaagacttaaacgttagacctaaaaccataaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaagtgggcgaaggacatgaacagacacttttcaaaagaagacatttatgcagccaaaaaacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaagacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgcagggacatggatgaaattggaaatcatcattctcagtaaactatcgcaagaacaaaaaactaaacaccgcatattctcactcataggtgggaattgaacaatgagatcacatggacacaggaaggggaacatcacactctggggactgttgtggggtggggggatgggggaggaatagcattgggagatatacctaatgctagatgacgagttagtgggtgcagcgcaccagcatggcacatgtatacgtatgtaactaacctgcacaatgtgcacatgtaccctaaaactcaaagtataataataaaaaaaaagaaaattaaaaaaaaaattttgtgatcgattttggtctttacaatgatttctgtgtaattatacgtttacataacattactgttgtatacatttggtttttattctatatgttttactttatatcattttttgtgtaa

SEQ ID NO: 7765 - DNA, 1696 bp, mus musculus
caaaggtcctgaacttccatggctttttgcctgttgtcttatagttagtatcaatttggcttacatattcacacagtattttttttcacacattggaattaaggtttttatgggaacactaatcaaccaagtcagcagccaaatgcagtctttaaaattattattcatgttccataagggtcttttcaagtacaaagaccacatcattatttctatgtgagctgtttaaatgaacattttaaaaatcaactctgttggcttaaatactaaaactccattctcagctgtcaagacataaatttatcatgaactgagttggaaagactttggcctctccttgaagaaacatactacatggattatcctctcaaacaaacatgttcactgaacaaccatcttgtaaatgtttagggctactaactactcaactcctgggtacaggctgctttgagaaaatagtgaaaacaaataaccagcaaacaaacaaacatgccaatgggttagttatagctctgctggcaaggctgaacagtagttcagattcacaaatttccaattatatcctgatattatttttcaagaagtggagtgaaaacagataagcagagaaacacaacaagaaaactactttaaaactgagaatttggccagacatactggttcacacctgtaatcccaatgaagcaggaagatcacttgagaccaggaatttgagaccagcctggacaacataaagagaccccacgtctacaaaaaattgctgaacatggcaatgtgcacctttagtcctcgctacttgagagactgagctaggacaatcacttgagcccaggtgtttgaagttgcaggcagctataatcacaccactgcattccagcctgagttacagacagaatgagaccctgtctctaaaaaaaataatagtaatacggagagagaaagagagaatttagggaaaagatgatatatgatgatgataagtggataagtaattgggctaatttaacagaaaaatctttctgttggtctgctctgaaatctagctttactatgaaataacttttacaacagaggtattcaaaaaatcaaaagaaaggattatgaattaacaataataatgaaaaaaggaaacaagatagacaatggggacataaaaaatgacagggagagataggaacaggaaaagagacaaacaggggaggggggaactaatatcctctctttttatgtttttctcttgttctttcagtgactcagataagattccccatttggccaaacaattgtgttgatcagcagctgatgatggtgacctagaaatgaccgaactcctaggtagatacagattattgtccagaagaattatgggcgatcaatctaaacagatacacatcttttttgttttttttttgtaaccaaatagattcataattttaaaattcaacaagcaaaaggaaaacaaggacatttaaaaagtaaagcaaataagcataaaacctcattttagctggtattctttgagaagacaagagattatgctgataaggccaagaaagaactaaaagggaaaagctaaccttgtgaagtggaatctcaactatgacaataggcttgcagtttgtttcaacaaaataatatgaaaatgtaactctggtgcagaattattttggatcccctcctccaaatagacaccaga

SEQ ID NO: 7766 - DNA, 850 bp, mus musculus
atatctcagtatgtgtacatacatgaaataacctaagaatttcaaaaatgtatctgcatgtgcagatagcaggcagttaagattggagtgaatcgtgtgtatagtacccttgcctcttagcttattttataatttaaaagcataagaaatgttaacattaagtggtaagattttttttttctacaatgtctccctgacattcctggccatcccttttttctcatccaaggctaattattttaagatctggcctttgctaaagaaaacaagcaaatgtgggtgaggctacgtggaaagggatttcatataaaacagacgtcctgtttttagggaaaggaatctcagcatctttggagccgccctgaagaggtaatagtctttaaacaatgaaaacaagggagctcatagagagaagaaaggtaaaaatagacagaagttaatgccatttacaaaaaaacctgatgggcctgagctggacctcagtagtaactaacagaacgaaaccccccaaactacacatgtggttcagctcattacccagggcctacttcaggaaggcctcctgagttctcttatcaacttgggagtccttttgctctaatccacaaaggggattacagctgataaattatgacaagcacccactggaaacccagtgagccaagaagggcatcaccccttttggcatgtgcattcacattactttggcacttactattatcatttaaatgtaatctcaccttagaagaaaaaaaaaattcccctctttgctgcggacttaaaccttacaaggtaattgaaatcacttattaaggcttctaaatgagaagctccagatattagaactgcc

SEQ ID NO: 7767 - DNA, 212 bp, mus musculus
gtgactttgacagtagaaatcaagaaataaaagcagagtggatccttaatgctgaagaaaggctgctaggagataggaatagaggaatggccagatatactgtggacaatggagggaggaagtaatgaagtccagtggtttttattcagaggtggaacctgctttccacacaatggaagatacagaagcatggatggaagtggcatgtggaa

SEQ ID NO: 7768 - DNA, 500 bp, mus musculus
tatagcaactttattttaaaatattagagatgacagaaaccatgtagtatttgcacatttaatatcataatgaaaaattggagaggtcaactcatatatatgagagaaggtacgtcaattttctaattcctttaaggggtattaggaagatcatcaattgagagtcctggttacatggtgagatggattcttcactatctactgttggcctcattagcccttctctagagaaaaggaccctatgatgtctgcgtccattaattcctagtctgggaggatccacaatgaccagaaagatggcatgaccacccaccccttcactttaggctcttttgctgaatccttactcccagagtcacagtatgatggatataatcctaaaccagtcatgcatcaaattctgtttaattcacagtaaagaaagaattgtcttctacataaatttaaaacatgtatgagattctgtcactaccctgtgtaagtgcattcaatgctctttt

SEQ ID NO: 7769 - DNA, 1216 bp, mus musculus
aaggtcatgcagtcattagatatcattcatgtgaccatcctctcaacccccaggtttctgtggaggtttaagggaacaccctcactgctatttcagtctcactgtgtgtcatagcttcaagtaaccagtgtcatttgcagacctggatgtaaacccttgggggtttgtatcagtttgcttttgctacagtaatcctgcataacaaaaaagtctcaaaacctcaatggcatacaacaatgagcactggttcggctcacgtggcccagctcttggccaggtgtctctcatcctcctaatgagtctgcaggctgcctggagcattcttctcatggtgatggcagaggcacaagagggcaggtagagacgcaaaagatcaagcataaatgattaaccatcacttccatctgattgcattaaccaacaccagtcacatggccaacccaaagtcaagggcaggaaaacatattccacccatggaaatgagggggctgcgaggtcacatggttaccagaaaggggtcccaatccagaccccaagagagggttctaggatctgacacaagacagacggggccagtccataatgtgaaaagcaagtttattaggaaaataaaggaataaagaatgcctattccataggaagagcagggctgctggctgcccatttttatgaatatttcttgattatatgctaaacaaggggtggattattcttgagttttctgggaaaaaggtgggcaattgccggaactgagggttcctcccctttttagaccatatagggtaacttcctgacgttgccatggcatttgtaaactgtcatggtgttggtgggagtgtcttttagcctgctaatgcattatggttagtatataatgagcagcgaggatggctggaggtcactcttgttgccttcttggctttggtgggtttcagctggcttctttactgcaacttgttttatcagcatggtctttatgacctgtatcttgtgctgaccccctatctcaatgcgtaacgtcctaggagggcagccagtaggtctcagcctcattttacccaacccctattcaagatagagttgctatgattcaaatgcctctgacaacatggcaaaaggtgtggattcagggaaaaggggagatttgtggtcattctctctccctcttcctttgtacctggcagcatttggggatacaaatgagacatgggaagat

SEQ ID NO: 7770 - DNA, 480 bp, mus musculus
ctcccctatgattccaatgccagtgggttttagaccacattttgagaaacagtgctgtaaactgttttccatttgcagtgaaggaaaatgtagggtttgtgtcgtgaaactatgcagagaaattgaatagtattttagtctaatcttgcttttaaataacacggaaattttgaaagtcggctttagggagttccagaacctgtccatgaacagcaacaagaaagatccctgtgtgaaaatgaacactggttggtaaaacccttaaataggacctaaatatgaatctgacccggggagcccatccttgttttcttttgctcatttatttaatgttcactgccagcactgctagaaaatttaatctctatatctgtgatttataagggctcatctttgttccaaatgcccagttatgtgctgaacaaaagctcttaaggggaactgctgccagaaagaaccactatctctaatgtgcatatc

SEQ ID NO: 7771 - DNA, 328 bp, mus musculus
aagctcatgctaactgcatataataaggtttaaaaggaggcaatctctcaaaggggaggagcttcataactgggtctttaaggaagactgggacttaaaaaaaatagagaaggccttattgacaggtaaacaagacaagcaaatacacaaagcacaaagttagaaatgagctgtggacgcatggaaacagtgagaccaaatggcatgccagtttgtcctccgtattcatgttgtgtgactgtccttgatgtggttgtatgtgctcactaaggctgcctttgactgagtaccgagtgagctgagcttgaacctttctgtcttacccagc

SEQ ID NO: 7772 - DNA, 214 bp, mus musculus
acttgaaggtaaacaataaaatagcagtatttaaaaatcgatatgtagcatttaagtgctattattttacttttatatttttaatacaaaattcatataaaatttttttattttactttttatattttgctctttctgtagaagaacttaatgtacagtagttttgaaaggtcccattttgaaatctgatcataatacaataatttgtatgtag

SEQ ID NO: 7773 - DNA, 214 bp, mus musculus; identical to SEQ ID NO: 7772

SEQ ID NO: 7774 - DNA, 1111 bp, mus musculus
gaggcagcacagctcttctttacagatgtgcttccccacctctaccctgtctcacggccccccatgccagcctgacggttgtgtctgcctcagtcatgctccatttttccatcgggaccatcaagagggtgtttgtgtctaaggctgactgggtaactttggatgagcggtctctccgctctgagcctgtttcctcatctgtcaaatgggctctaacccactctgatctcccagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgtaagtatgcctttcactgcgagaggttctggagaggcttctgagctccccatggcccaggcaggcagcaggtctggggcaggaggggggttgtggagtgggtatccgcctgctgaggtgcagggcagatggagaggctgcagctgagctcctattttcataataacagcagccatgagggttgtgtcctgtttcccagtcctgcccggtcccccctcggtacctcctggtggatacactggttcctgtaagcagaagtggatgagggtgtctaggtctgcagtcctggcaccccaggatgggggacaccagccaagatacagcaacagcaacaaagcgcagccatttctttctgtttgcacagctcctctgtctgtcgggggctcctgtctgttgtctcctataagcctcaccacctctcctact

SEQ ID NO: 7775 - DNA, 1111 bp, mus musculus; identical to SEQ ID NO: 7774

SEQ ID NO: 7776 - DNA, 901 bp, mus musculus
tagtggcttgagctggtaatagaacccactggggaatgtgtggaacattcttggagaatagatgtgtgggcttgcgtatttcttcactacgtcttctctgtgacttggccctttccttggtcttaagtagacaaccactctgttttcccaaatttctgaaagctcagaaatgagcttttcccatccttaactatataatagcacacaaaatagtcagtagttagatgtgaacagataaccctatttgggtaactactgactacccatccaaattcctcctgaatttcaaggatctcagccatccttaacatttgatttttgctgtctgatccattcttgataacacatgtttcatttgagaggcaagaattgtcctcctgggctccagcagtgttaggcacacaacaccctcactcttgatgctggaggatgagaatggtgagcagagtgtgacttggatgaacagaatcagctccctgtcatcatgtttatcattagtaatgcccattaatagtaattaattactattttattaacaactattataactattgctatgattactactaattagttttaattgatcctctccacatgggcctttgcatttgatagcactgctaacaatctgatgaaatgaacaaagcaggtacttcagtagtcccattgggcagatggaaatactgaggcacagagaagtgaggtgacctgggtgaggtggcccagcttgctgtggctgtaggacctgtgctccgcctcaatgtcacaatgccccctgagaggggacacgtgagtgggtgggggatggagctgcggctttttttgtttggaggccttgatttgattcaatatctgcctctcgtgggtgcaagtggtgttgaactcacccctccacagaact

SEQ ID NO: 7777 - DNA, 862 bp, mus musculus
cgtcgttctggattcccgtcgtaacttaaagggaaactttcacaatgtctggagcgcttgatgtcctgcaaatgaaggaggaggatgtccttaagttccttgtagcaggaacccacttaggtggcaccaatcttgacttccagatggaacagtacatctataaaaggaaaagtgatggcatctatatcataaatctgaagaggacctgggagaagcttctgctggcagctcgtgctattattgctattgaaaaccctgctgatgtcagtgttatatcctccaggaatactggccagagggctgtgctgaagtttgctgctgccactgaagccactccaattgctggtcacttcactcctggaaccttcactaaccagatccaggcagacttctgggagccaaggcttcttgtggttactgaccccagggctgaccaccagcctctcacggaggcatcttatgttaacctacctaccattgctctgtgtaacacagattctcctctgcgctatgtggacattgccattccatgcaacaaccagggagctcgctcagtgggtttgatgtggtggacgctggctcgggaagttctgcgcatgcgtggcaccatttctcgtgaacacctatgggaggtcatgcctgatctctacttctacagagatcctgaagagattgaaaaagaagagcaggctgctactgaaaaggcagtgaccaaggaggaatttcagggtgaatggactgctccagctcctgagttcactgctactaagcctgaggttgcagactggtctgaaggtgtacaggtgccctctgtgcctattcagtagttccctactgaagacaggagtgctcagcctgccat

SEQ ID NO: 7778 - DNA, 662 bp, mus musculus
caggtgttagttattaatttatacttttatgttctcgttataaaagtcatcaattcttgtggtaaagaattcagatacgcagaagtgtcttcattagggtttgtgagttcctctgctcttcctcactccctgtaggaagtgctctgctggtccgtaactcttcagactttcttctaattcatttcttccttttgacaaaatgatccaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagaggtaactgaatacttgggtggacacatcagaacccttctgtgcgctttcccaactttcacctaaagagcatttaatggcttaaatgtattctgtagaaatccctgggagcagaatggcaactgccactaataacatgtgcccatatctgtgtgaggtgatggaaaagggccagtctgggaccaataggctgacaggaatactagtgattgcgtgggtggatggattctctctcttcacctgcagaagcactcagggagtgatagaaacaaatgccgtgtgatcgctgtctaggtttaacacattt

SEQ ID NO: 7779 - DNA, 813 bp, mus musculus
gggcaaatgtttatcattctctacttaccctagacattctggaagggaatggggaggcagagattcctgaagaatatctgggttctgacatcctctggtttggaatgttttgctgccaactcctttcctccccaccccttcccctcttcttagaggacctaagctttctggatatcctagtccctggcccacagcagtgaacaagacagtcaaaatctttgccctggtacggcagtgagaaagacaatacacaagtaatgaatgaacaaatattacaaatagagatacatgctaggaggagaaagggtggggcccctgatgcagaagaatcggggaggtggtgatggtgatggtgcttcatttggagaagggtccaggaaaacctctcaaagaggagacctgcaagaggagaaggagctggtcacgggaaaagcgaaggaagagtgttaccagcagagggaaggggatgtgggaatgcccagaggcagggaagagcttggtgtgttccagcaactgacaggaagctaggaggccggcatggtgggtaaggggaagggaggcacgggaggaggctggggccagggccgattgcactggacttaaaagccacagcaaagacttggatttggacagtgctgaagctccgagaactgggaagcacatctggtaattgaaaagatgaaaaaagtaataataaagtgctcactcacaggcagccgtgatgaaggaaatggatggtggccaggcaggccatatgcacttggctaacagaattaatcatgttcggtacggcacaaaacaagaatgacaagc

SEQ ID NO: 7780 - DNA, 1509 bp, mus musculus
ttctcctacaggtttttatgagaacatagatttgcattttatttggataaatacttaggaattggctcagtcagtggtatggtaaatgtacatttaactttatttccttttacaggaagctgtcaaattgttttccagagtgactgttttccagactaccattttgcaggcccccgagaaacacaggagaattccacttgctccacatccttgccaacacttgctattatcatttccctgcttatttttagccattaagacaggcacatagtggtatttccttacggttttgatttgcatttccctagtgaccaatgatatggagtatcttttcttgtgtctgtttttatttatttattttttttggtgaaatatctgatcacattctatatccatttttttactgtactatactttttagaacagttttatgttcacagcaatattgagtggaaggtgcagagctggctttcccatatcatccctgcttccacatgtgcatagcctcccctagtatcgacatcctccaccggtggtatacctgttgcaattgatgaatgggcactggctgtcataatcacccaaagtccatagtttacattgggccacgtttggagttgtgcattctaagggtttggacaaatgcatgatgacatgcatccacacatataacatcttacagtgtagtttcactgcttgaaaacccccgtgctctgctggttcatctttccctccctgcgtacccctagaagccactgatctttttcctgactccttatttttgtcttttccagagtgtcatatagttgcaatcatacagtatatagccttttcatattggcttctttcacttagcaatatgcatctaagattcctccatgtcttttcatgacttgatagcttatttctttttaacactgaataatattacattttctgaatgtatcacattttattttattttatttcattttatttttttttgagacagagtctcgctctgttgcccaggctggagtgcagtggcatgatcttggctcactgcaagctccacctctcgggttcatgccattctcttgcctcagcctccccagtagctgggattacaggcacccgccaccacgcccagctaattttttgtatttttttatagtagagactgggtttcatcatgttagccaggatggtctccatctcctgacctcatgatccgcccgcctcagccttccaaagtgctgggattacaggcatgagtcaccgcgcctggtgtaacacattttattgacccagtcatttactgaaggacatcttggttgcttccatgttttggaaattaagagtaaaggtgctaacatctgtgtacaggtttttctgtggacataaattttcaatgcctttgggtaaatatcaaagagcgtgatttctggatcgtatggttagagtatgtttagtttcgtgagaaacttccaaactgtcatccaaaggggctgtactattttctattctcaa

SEQ ID NO: 7781 - DNA, 142 bp, mus musculus
cttctagaagcattatagttttaagttttacatttagacctatgaaccattttgagttagttttgtataggggacaagcatcatgaattattgataccctcttacaccaattgccaggtcaccgtggagaggccagagcaca

SEQ ID NO: 7782 - DNA, 924 bp, mus musculus
attttttgaaaaaagttcaaatccccagaccacaaatgcactatagacatttctgaatgtggaagaaagttttttaagctcactaccaacagagatacagctttcttttcaccgacgtgcagcaagaatttcctctaacattctatacactattgcatctgattctcaccacaaccctatgtggaagatactggtattattctgatttttgtagctggggaagccaaaaaacaaacacagtaataatttgtttggggtgcagagctggtaaaccttggggtatgcactgggaccctggatttcatagctcattcctcattgtctatgccaggcagcattccagcaatgagggatagagggatcaagaggtggatcagaaatagtccttgctctggtggaaagttcagagcaagaaagaagagatgctcaagatctcagcaaaaaaggttgttgtagactgaatgtttgtgtgacccccaaattcatgttgaaacctaatcctcagtgggatgctatttggagatgggggcctttgagaagtggttaggtcatgagagtggagtcctcataaatgggatgagtgcccttataaaagaagatccagaaatgtccctcaccccatccaccatgtaaggacacagtaagaagacatctatgaactaggaagcaggttcatacaagacaccaaatctcctggtgcctcgatcttggacttctcaggcttcacaactgcaagcaatacatttctgtgatttatagatcacccaatgtacgccaatatagaatcagccagaatgcactaagatagaattagtcctgggaatattgtactgttgaaacaaatacctaaaattgtggaagtagctttgaaactaggtgacaactagaggctagaatagttttgaggtgcatactagaaaaagt

SEQ ID NO: 7783 - DNA, 1021 bp, mus musculus
attattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtg

SEQ ID NO: 7784 - DNA, 1967 bp, mus musculus
ctgcatgatgtcatttcggatgcattaagctggaacagctcaaaattgaataattaattacactcagcttcaatcgcagtgactaattgatcaggggctgccagcagacacctggacaggattaactgtgcacaatgagggctgcgggcaggtggtggcccctctggacccccagtccctgtgtgtgacttaattaaggctgacttgatttctctatcctcactggagatctcaggcaggccccatccaggcccaggggctacgtgcgggctaggcaccgagtgtggacacgtgcaaacggctgcgatctggaaggatgctagcccctgaccactgggccatcctgttctaggcccagatcccaatgctgcctccaactatgattatttctgtggccttgggcaagtgtttaatctcatggagccttagtctccttgtctgtcaaatgggggttgtcattgttgtgtccagagctgtgttcggccctgggtgtaaactgcttttgtcactgggatttttggttccctctggggaggctgtccttgttctcacctcccttgcttgtctctggctggagcagctggcattcccagacctgtccaccagccctgacgctccttatttattccctggagccacctttctgtgtacacagcagcatttgggggcctgacttacaatcctgctctctcaacgcacagccatcatgctgggggattcacaagcacatggatggcacatccagctcctgaaagggccagcaagtacagttgcgcatgttgtgcactgcacaattcagactttgctgtgagtggtataatgtgcaactacacaatggggcataccagccttattgtcacattgcagagtctcttttctgtctgcctcctcactgtttcctggtcttctggagttcagtaacctctgtctccatgtctcctcaaccccactcctggagtcatatcacagggggaactgtcatgtggaaatggcaaaccccaacgccttctgccctgccggctcccagcacatctgccagtgggtgtggagagcacttgtctctttgtttctgctctccccattccctgcccatctggtggctcctcttccttggtctgcagacacacttgagactctcccctgctggcatgcaagcaccctggggtgactcgggctgcccctcccagcctcgtctctcaagtgggtctccactgacccaactctacttcatatcaaatgcacttcgccccctgccttctgctcccctgcagaatcccacggcacggcattctccccgtgaccaatccaaggggcactctctgtcctcatcacactgcagagtctgcagccttgatcgctgcggcctctctggcccctccgcatccttggagctccctccttcctgactctgcccagcagtctccttgctgtccctctgcttcatgtccctgggcactgtgccctgtacccctttaactgttgcaatcacccgggtctccagccttggcctttggctcttcccagctgagcagccacacagacaaccatgatgagcccattttgtttcttgcctgttctttgtctttttcctctagaaaatgaggcagtcatcttttgctctcctaagtggagcagactaaaatgagccaacaggccccccattggcatgtgggtgaggggcctcagccatgatggaggaggactgtgtggtgactgagcagtgagggcttgagctcccagatgcatggccccaggaccttcctcaacctcctcctgagccttccttggagcacggcgagtccctggcgctcctgggcctgccattcccttgttcttccctgttcttgcctttgcatctggcacatttgccagccttatgatcccagcactggcgtgtcctgtccattggagcacagggctgtgccaagtccccgcagatgaagtcactcagaactcaggtcccttct

SEQ ID NO: 7785 - DNA, 851 bp, mus musculus
tttgtcaatccaaatggctgtatttctggaggagaggggaggaaaaagaaaaggcaaataacgaaaatgtgcaccagaaaaataccaagtgttgaccaaaatgtatggccaagatgtacccaagcaggactctccctcctggccgttgcaaactgtcatggccttggttgcatctgtctgttaaagattaacgagcccttggccttagcatgtcattcccaggtatgccctccagtagacacgctcacagacatgcaacaaaaagtgtaaactacaatattcccagcagcactgtttgtaatagccccaaactggaagctaactacgtgttcctcatcagtagagtagataaactgtagtacattcatgcattggattaccatataacaaccagaatgaaggattgaaaaccacaggcaagactgtggctaaatctgactaaatgactaaatgttgcaacaaaagaaacaggcgcgaagaaggcacatactgtgtagctccgtttatgtaaagtacaagaacaggcaaaactgctctgtatcattggagggcaggctagtgatttaccgtggtggggagcaggggagtggggcaatttcagaggttatgggatattctgtctcttgatctggatgccagttacacaggtgtgttccgtcaatgaaaaggcatcaagctgtacactcctatgcacttttctgcctatgtattatatttcaaagaaacgtttagaaaagagagagaacaggaaaggtagtacttctctggaagaaaatagctaaagaccttcacagtaagaataaaatcagccccatttttgcaaacaggggtgcaacacgcctgcctgctcc

SEQ ID NO: 7786 - DNA, 987 bp, mus musculus
agagcagccagacagcgtggaaataatccaaacagagaaagcattcaagaacttggcctctggttgacttaacacactacttcaagtatatggcaggtctgtataataaactcctgcctgtctagtcttcagcctcatagaaagcaagaaagcaggtggcgtatgttgcagaacaattcttgggtagaacaaggggacatttgatggtttgggtttttcagtaagaaagatgaagtcctggagtatagggtagagtggtacagtggaaaatatttcagcttgggggttagaaaataaacatgccgattcttgctttgccataaatgatgtcacctaacttgtgtgaccctgttttctcatccctaaaatgatttgataagtttaagattaggctatttttaaatgtatggaagaaattgggtgttacccttcttgaaagacattttccctgcaagtatggcaggctgtatctttcagtgtaacaaagttctattaaaggtcataactgctgccctgtaacttttgccttattctagaaacttctactccttgaatgacatgtgttggtacatgtttcttctctttcagatagaatggttaattttgacttgttgcttctgcacacgtgtcctggaaataaaagtttcttcccactacttattgctgatttatttcataggaagtcttaaggaaagaggcaaaaaacgggctcatgggtcacttgaagttggaaaattctgtggagattgacaaaggagactcacttttgagcatctgttctcagtgtaaccttcaaatctgtggaaacataactaggcacattttatgattatttagaatgttaataaattgctctgagtttcctcaagtccattttgtaagatcagaccataggtgggtgttgtttcttttaagtgtgtgtactgtgtccaatgttacatttttagaagtgttcatgctttttgtaaagtgattcgttttaagcac

SEQ ID NO: 7787 - DNA, 1530 bp, mus musculus
ggggaatgacattctccctcagttacctgaagctaaacccctttgtctgccccattgtcagccttgctgagacggcatcatacccagggcgtcgtggctagacaccaggcctgtgaggtgcacggccagctccacccacgggcttactgcagtgtgtcccggctccatcccgatggccacaccacagcagacatgtgtgggcagtggggctgggccgtgggcctgcggtgaggtgcaggaaggggccagtcccgctgcctcagcaccccttgtcctggactcttaccccccaacaccctgtcctcttcataggcagccagcacagggtttaaaaccacacaggatttacatttttgcaaagcgtaacgttgaagagggcccaggtcacttagtgcaatgtatttataatcttggccacacgtgtctggcgtagacacctgaagttcctcggttctccgccttggtgggtcttctctcctgcgggcacagtgcagatgcagatgagtttcagagctggtcaaaagtaattccatcacctgtaggatgcagaactgctcattctgcaccctttgctagtgccctgtgtgggtggcctcccctgcccctccccatcccttagggcaggtgttatcagccctgttggagaggaggcagctgaaggccacaggggccgcgtgctctgtatcagtcacatgtcacatctgtcaggctccagagcccatgttcttttcactagaatctgtttcactagaatcttttcactgggcatctgtttatcactgagtcagcaaactagacttcttcctgcttccttgcaagcgaatccccacatactcggcaggcaagggccttcccagaagcccgtgtggagagtggttccctgaagggcagtgtctggggctgcttttgacttggttctcagaggcctcacaggtgcatctgaaatgctccttctgagacagtttggtgaccaggccagtatcttttgtctttcttgcaaaccctgtttgatttccctttttgtattcagaagaaaagtcctgatcttgtagcctgtttggagtctgtgatagaaacagagcagaaggcttttaaaatgcatcttcagacagtgaggtgtgtcctgatgcaggattaaccttgaactccggaggcagaagagccaggaaggagcactgagctggagctctcttgcatttggggcttgccgcctcccagctctgcgtttctgcaagctgatggccaggagccaagctacgctgaggggctgtgggggcagtgagcgtgccacccacacagagggactgagcggaagacgcacaccgctcccttgtcgtgtggcacagctgtgtcactgctcttctaaacgtggagaaagccccttaaactccaaatggccaaaggctttgcagtccttggtttcacatccgtggcaccttgggtggagttgcttctgtaagccaacagatgagcaggtgaggagcacagcgcggaccccagagctccctgcaggacgcccttagcctcgct

SEQ ID NO: 7788 - DNA, 829 bp, mus musculus
tctaaacagtcttaaactgaataacccctgtcattttctcagctcagcacagctgactcctccctcagggtttctgacactctgaggatgtggtttctcacactgtgtctctcgcacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacctgcggagaggacacagtagagaatgacagtcctctaaactggaaaaaatcccttcctcagccctggaaccagttggccctttacctggagctacagccagcaagcagaagaccctccaggtccagtccatggtgaagaactttcctctcagaggcttctgtagagaagggatgtggttgttggatgatgctttcagggcccagatgtatccatatttacctcagtagatctaaggttatttgcatattcatgagacagattatttcatacctcaaagcctgatcgaggttgagaaagaagatagatgtcccatctgccacacaggagtgggatgctgatggtccaagccctaatcctgcttgaagaaatgcatgtcctgctccatttctgtttgcggacaggatcctttcactg

SEQ ID NO: 7789 - DNA, 784 bp, mus musculus
taacccctgtcattttctcagctcagcacagctgactcctccctcagggtttctgacactctgaggatgtggtttctcacactgtgtctctcgcacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtagctggtgaaggtgtatccagatgccttgcaggaaaccttcactgaggccccaggcttcttcacctcagccccagactgcaccagctgcacctgggagtgagcacctgcggagaggacacagtagagaatgacagtcctctaaactggaaaaaatcccttcctcagccctggaaccagttggccctttacctggagctacagccagcaagcagaagaccctccaggtccagtccatggtgaagaactttcctctcagaggcttctgtagagaagggatgtggttgttggatgatgctttcagggcccagatgtatccatatttacctcagtagatctaaggttatttgcatattcatgagacagattatttcatacctcaaagcctgatcgaggttgagaaagaagatagatgtcccatctgccacacaggagtgggatgctgatggtccaagccctaatcctgcttgaagaaatgcatgtcctgctccatttctg

SEQ ID NO: 7790 - DNA, 672 bp, mus musculus
gcgccccctggtggtcctggggacccctgcagggaggtttgtgtccgggctcacactgacttcccctcactgtgtctctcgcacagtaatacacggccgtgtcctcggctctcaggctgttcatttgcagataggtgatgcttttggaatcatctcttgagattgtgaatctgcctttcacagacgtggtctattctgttgtcccaccattagctttgtttctaatgaaacctacccactccagccccttcccgggagcctggcggacccagctcatgtagtagtcactgaaggtgaatccagaggctgcacaggagagtctcagggaccccccaggctggaccaagcctcccccggactccaccagctgcacctcacactggacacctgcaaacaaaaagaaaccctggtcagaaactgccacacaaatccactgtttctctcactcttatccactcacactcaatttcaatagttctcaatgaattaccttttaaaatagcggcaagaaaaacccagctcagccatgactccatggtgagtcctctgtgttcagtcctgatcaccaaatgaaaacacctgaaaatcccagggctggggctcctcttccagtgctgcagggtcagggctgggctggttttcataagccgagggagggctctatttgcatgt

SEQ ID NO: 7791 - DNA, 738 bp, mus musculus
ctgtaatctcctcaaattcactgcagctgcctcctccctggggtttctgacaccctcaggatgtgggttttcacactgtgtctctcgcacagtaatacacggccatgtcgtcagatctcaggctgctcagctccatgtaggctgtgctcgtggatgtgtctctggtcatggtgactctgccctggagcttctgtgggtagtttgtgttaccattgtaagtgttgatccatcccatccactcaagcccttgttcaggggcctgtcacacccagtgcatatagtagctggtaaaggtgtaaccagaagccttgcaggagaccttcactgaggctctaggcttcttcacctcagctccagactgcaccagctgcacctgggagtgggcacctgtggagaagacacaggagtgggtgaagtctcacatgactggcctggtttctccctcagccctgggactggggagtcccttacctgttgctgctgccaccaagaaaaggatgctccaggtccagtccatggtgaggagctgtgatctaggggattctcccaaggaggggtgtggttgttgtgtgatgctctcagggcacagagatatctatattcacctcagttatttgcatattcatgaaggatgctatttaatagcccaattcctgccccaggatgagaaagagcaaatacatgacacatggacgacacaattgtagaagctgagggttcaagccgtaatcctgttag

SEQ ID NO: 7792 - DNA, 154 bp, mus musculus
acagttctggaggctggaaggccacgatcgggggccagctggcttgggttccggtgagggccctcttccggctgcagatggttgccttctgattgtatcctcacgaggtggaaagagagccagagagctctcttggtctctgtcacaagggcat

SEQ ID NO: 7793 - DNA, 478 bp, mus musculus
attgggagtagtcacaagttggtcaatccaagtgagtggcacaatgattgtttcaaacaatagaactttcaaaggatgcccctgcctgttctggaagcggttggctctccactactcacacaggcttacattatggttaagagtatccaggcctaagcacggaaagaaatattttaatcccatttgggaaatggcttagaagctaagaaagtttcaagaactttctacctctgaaaatgtgcatttgctaagagtattgacctcaacttagccacatgtgtgattctatccagaggctgatcccgtgcctcagtttccccaacttctgtgaaagctgacttggtgaatgggatctggtttctgtccttgccctctacgtccctgtgcaaacctctactgaagctatatttctacttgcagacctctcacttctttatatcccagccctagtgactcctgcttcaggaagcgcctcccc

SEQ ID NO: 7794 - DNA, 708 bp, mus musculus
taaacaacatctttacacagtattcaggattagctactgctgacatttccaaagacttctttttctgttattgttgttgttgatggtttgaagccacaaattgcagacgattgtaaatttaaaattggctaagaaatcaccttactgcatgatcttcactatttgactgaaaattttgtagagacttgagatattaaaaagtttgaaaccctcatgagggaattgtcttgcttaaaagaaagcattttgtttaacatgggagctatcgctaccttcgttttcatctttttcgtgactaagtctgacctttttgatcggttggcttgataaaaattttaatgatccccattgtgtggaaaccagctagatgacactcttttgagtgtgaatatgtccaaatctttctttcatacatataaactttctttcctctctttactaaaacaagatagttagcttggtctgaagagcacttccttttttcattctgtcacactcttatctcgtgagaaactttacccattaactgataaaaaaaattcagttgttgtatgcatatactctagaaagatttaactcagataaacagtcaaaattgtctaaaagagacagaaacaagttatcaggctatgtttctctttgtggctactgagaagttcatttacaagatagcctttgtcacaacagctataagataacaataagagg

SEQ ID NO: 7795 - DNA, 749 bp, mus musculus
actctgcaagttggcccaggccaggtgtgtcaccattgcccaggccttcagtggctttccagtgctccctccacatccacgttactcggctggattttctcaagttcccccacttgctcccaagaatggcccctccaggctgccctggctccaggcagacaggcttactgcccagatctgccctgggttgtccccaccccatccccacctgtcatcttggcgcatgtccatcctggagatcccaactgaatgtgggctctttccctcttattccttggtcctcagatttgtcaggccactcttgcctcagggcctttgcacctgctgttcccacccccttggcatgagccacccccagatgctcacatggctggcccctcacttattgcccactccctgaaagccctacataaattggctttgttaaccttgctttgtgtttctcttgttaaccttgctttgtgtttctccttagtactcaccattcagtgtgttatttatttacttgtttgtttattgtcagtctcttaccactcaattgtaaaagactttgttcacctctggatccccagtagctagaaaagtgcctggcacacagcagagccttagcgctgttgttggatgagtgagtgaacgaaacacgggagcagtagtctccttgcagcacatgtcctgctccctgtgcctccttttcccgcgtcccagagctggaacctagctgtgttcacatttggatcctcctggcatgt

SEQ ID NO: 7796 - DNA, 313 bp, mus musculus
tcctctaacttttttctttttcagtgttgttttggctaatctagtttctttgtctttctatataaatttagaatcagcttgtctgtgcctacaaagaaacctgctggagtgttgactgggattgcattgaatttatagatcagtgtgactatacttgacatcttaactgtggtatatcttaaaatccataaaaacaatacatctctctatttatttaggtcaattttggtctctcttgtctgaattttgtgaattgcttagttagaatttttgactgtgtcctggctctgttgttctccaggtctacatggac

SEQ ID NO: 7797 - DNA, 313 bp, mus musculus; identical to SEQ ID NO: 7796

SEQ ID NO: 7798 - DNA, 1256 bp, mus musculus
tgacacagagcagagcctcactcaaggctagtttacttcccccttttcagttcctttcactctttcattgctccattcttacactcagctgccattaactgggccattgctctgtgttatgtgctagggatacaacctaaaattaggcagggtctctaccttctaagagtatttgggctgctggcctaaaaagcaaattaatgaggcagttatatgatgcttagagctatgagagacaagatggtgtcaggcacaagggaagggcacccatgctagactggagtggaggagagagtgagagaggctctgaggaagtgacatctcatctgaaaaccacagaggactggggattttgcaaagtggagggctgagctccatgtaattggggaagaggtatggacagtggtgcaaagctagaaaaagggaacagggtccatgtagacctggagaacaacagagccaggacacagtcaaaaattctaactaaggaattcacaaaattcagacaaaagagaccaaaattgacctaaatagagagatgtattgtttttatggattgtaagatataccacagttaagatgtcaagtatagtcacactgatctataaattcagtgcaatcccagtcaacattccagcaggtttctttgtaggcacagacaagctgattctaaatctatatagaaagataaactagattagccaaaacaacgttgaaaaagaaaaaagttagaggactcgcacacttgattttaagatgcattataaacctcctgtggccaagacagtatagtattgggatagtaaaggatagacacgtttactactaaaacaaaagacaactgatttttgacaaaggcacaaagacaatccaatggagaaaagatagacttttccaaaaaatgatgctggagcaaatggacttcagtaaagtaaactcaatctacatcttacaccatatataaaaattaactctgaatggatcatagactaggtgtgcctgtatgtttaggtgtccatgtgtgagcatgtgcatgcatgtgctgtgtgtgtgcatgtccatgtgagtgtgcatgtgtttaatagtgtgtatgtgtatttgtgacttctgtgtgcatgtttatgttgagtgtgtgtgaatatatgtgcatgtttgcatgcgcatgtgtgtatgaatgtatgtgcacattcgcataactgtgtgtgactgtgcgtgttaaaaagggacacagggaagggtgtctaagggacatttgg

SEQ ID NO: 7799 - DNA, 870 bp, mus musculus
gccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggtatgcagagtaaccaattaagtatattggatttagtgtgtaatttaacaaattacatttgccgaattatttagtaatccgtaatttgcaattgttagtagcccaactattctttaaaaggattttgtctttttttggttagaaaaaaactgcaaatgattagtatgcctttatattaaatgatatttaaaaataagacgttttgtatagtttggcatccaggattatcaaatgatattaaaataagttttctgttcctaaggaaaagaaagattagagctgatggccatttaatctctttattaacaaatattttttgaatgcctactatatgcctggcatatagtgctagacactggggatagaatggtggacgcatacgttaaaggcttattctaatggagctcactttctagtggaagaggacagacaataaacaataaataacatgcttgatagtgaagagtaatatgaggaaaaatgaagcagaatcagattgcacatgatggcagggcatagctgtggaggtggtgctacgtatggttgtcaagcaagacatttctgataaggtaacaagtagatgtaaagaaaatgagagactgagccttgcttaaatctgttggaacaggtatgaatttaatgcataagtcacagaatgtaagagtttggcagccattttgcactgattaatttctaggagcgtatatttgggctcatttatctaat

SEQ ID NO: 7800 - DNA, 870 bp, mus musculus; identical to SEQ ID NO: 7799

SEQ ID NO: 7801 - DNA, 923 bp, mus musculus
atttattactttttgcatttttcttatgacacagaccacagagctataagaaactgaccattgcatttcacgtgacttgggcttaaaatatgataaaggaaaagagtaaaagttgtcatggtatcttatattaaaaaaggtattctatgtaacaaagcttattaaattcaatgagcttctctgtaaaataatgacctttttatcaaattttatataatgaatatttttctgcaatgaaattctacttgtttctctcttataatcactatcactaagcaacagacttatttgctgcttgcaataatgagatacagatgaattcattataattgtttcatcccaccatccaacaacagttacaaataaactctcctaaagtttttgctctttaattaccaaaaaaagttcagccagaaaaaagactcaaatacctaaagtttgatttcactgaccccgaacaattacagtaactaaaactaaaaatggcagatactacgcaacatcttccacttttcctggcagaaaaccttcttttcctcacaagctaattcaaagtatgaatcctataagattcttttcatctttaccacttgctgatggcaaactgaattttaagtaagactcccttatgaagcaattgtgatgcctcatgcagtttgttatacttttgaactatagcaacctggtaacataggtgaaagcccataatgattgtgagcatgtgtgtgtgtgtgtgcgattttatgatgcatgggtttttattgttcctatctttgtgtcactgtgtacccaaagatactgtcactgttcttctccccaccagaagtcagaagcataacacctctttgtaatcttaaaaacagtcatactttctataaatattcaaaatacaatcgcttacctggattaatagaaaatatttt

SEQ ID NO: 7802 - DNA, 825 bp, mus musculus
ctccataatgtcctgctactttcagaacaactagctgtcgaacagcaaagcacatgtgacctaagggatttaggatttaggaaactctcaaatgagggggacacagaaggggtaacagaagagttccataagaaaaacatagcagatggaaatgagagaaaaacaaaataaaaagttcagatttcatacatcctgtgtgtgaaaaaggagaaaatgaggcttggagaagctaaataatttggctaaggtgctacaaattggcaatgggccaaaccgatatttgaacttggcttaaataacaccagacaggtttttaatataattcctgaaccagtccaaaaattaatctccattctgttactaaaaaaaaggatctacttgagaattgacttacagtttattttaaagtcctcagtttgaattaccaggggatgagaaaaagctccatttcctctgccagcaagggacaggcacaaacggcaggcgccacagtccttagtgagcactggctggtctcctcactaagtcttgagcagcctgcagtgacctgcccttgaagtggtggtttaacagcctttgcccaagcactctctggctctttgtacatctttaatagtttccttgacggactatgaagaactgccagatgacagttctatttcatttttgtcactgcctggtgctcctttttactctcaggctttttctcaagggcatgattctataagtcaatgtggcaatgttcacgatgggtattgctctttcaaccactgtatattgatgcagtgtgagcaagtcacggacatgtcaagatttcaggccttc

SEQ ID NO: 7803 - DNA, 318 bp, mus musculus
ttcttttaaaatgacaacattactgaattgtattttacatatcataaaaatcactcctttccagtgcaataaaataaattttggtaaccttactgcatggtctagccaaaatcctaaattagttttagagcatttcatccctacaaataagatcccttattgccatttacagttatttccagtttccatcgctagtctcgtgtaacaactaatcgactttctgtctctataaatttgccttttccaggcatttcatataactcaaatcatatattattagatctctcgtgtctagctctttcaatgaatgtaatgttt

SEQ ID NO: 7804 - DNA, 941 bp, mus musculus
ttaagaaagagaattttcagagtcaaaagaacagaaatcagtaatctgttctcttccagggtggggagaaaacctccttccccataggttcgagactatggctagatggtgaagaagggagctcagtacccaaccttggggagacacagaaagggcccatgccaggcacttagctagaggcaagcgtagcttttgggccacaagacctgatggccactggggtactggcctggaaacaagtcctcatcttcccagaaatgtcttatttttgtctgcagcagctggctggagaaagattttggaaaggtgtgtacctggagcacccaaaggcatacccttcctttttccttggcataggctttataacactgaggaaaggtcatggtttggcaatggagtcttcaatagtcttcatccctgtagagttcagtggcttttagggtgacaggagaggagacgacttgaaagaccaagagtctttcagcttctcccccactgaaacgctatatgctggggccacagttcatggcagaacacacactcacacacacatctcgggaacccaacaactcgggagcaggtagttctgggtattgttggtctggcatttgcctacttggcatctaagctgtcctaaagctccttacaatcacttctcactatttccaggcccatgtggtgaggccctccagctttcactctgtccgtcaggtgatcctaaaggcacagcataggaaagacccttactgggatgaccactgcttggaagcagggaaggctaagaggcctgcccctacccaaggctggtatagatgtcctctgctctgcttctcaaagactgggaacaggttcagcaactcagtatctgccatgtcatcaaaccaggactgcacaggcactgcattctctgggtggaagatgtaagaagcagacaagttgtc

SEQ ID NO: 7805 - DNA, 941 bp, mus musculus; identical to SEQ ID NO: 7804

SEQ ID NO: 7806 - DNA, 2282 bp, mus musculus
cagttcctgacggagctgaccagacttttccagaagtgccggacgtcgggcagcgtctatatcaccttgaagaagtgtaagcagcgggaggggagccgggcgatgctccctgggttcccggtgtctgggagccaccggagtctgtctgccgcggaccgccgccttcctctacctttccccaccctgtactgagcacattcggggcttcgggcccggaaaatagtagggattgtagctggctcagtccccagcactgagccgcctaggttgcttctggtaacaatgggccccaagcagcccagggctctttgtcagggatcccagacgccgccactttgagtggaatttaacgtgcttcgatattacatgtttccgtcgtggaaataatagtttctccagggtttcgccagaccgtgatagcagatgaggtgtttaacaaaactagagcagcggggctgggttaggtcatcacttaccccactcctctgttttaactgtttgtctgccgctcagccacgtacgcggccgtgttcaccaggatgcattttttccttcagatgacggtcgaaccaaacccattccaaagaagggtactgtggagggctttgagcccgcagacaacaagtgtctgttaagagctaccgatgggaagaagaagatcagcactgtggtgagcttaatttctaaggctgtcttttgaaatgtaaagacttgaacttaacagaggatggggcgtttctgaaccaggcttttatttgtttttcccttttgccctgtgtggctatttttgagaccaggaccttcctatactttagtagtggaaacctcaagaataaaataagaaggtagaggtcagacagtcgttagttctgctaaagctcttgtggaaatgaaagtagcatattggtccttattcgtagtactgtaaggagcagctggcataaatatttgattccttagccccttactgtgctgggccttcaataagcagtttcttggtaccaggtgatgctattatttccttatctttgtggttcacatggcgaatgtgcagctagatgttaggtttgacacttgagaaaatatacatttagtcaagagccctagtctttcagtggaggttgaataaggcaaaggaagaggctccttgaattgagtgaatactactttattctgctgtggcagaaatcacattagtgtaggatactgactgcatgaaaatgtagactatacttagttggaagtcttgagttatcttgagaggacttctacagtaaaacaagcttatgtggttttacagattaagttagatatcatgaaataacaaaaacctaaggacaagttatcttgagaggacttctacagtaaaacaagcttatgtggttttacagattaagttagatatcatgaaataacaaaaacctaaggagtgttcttcagaggtagaatttattttgtggtagctcgcattgtgcttaaatatgcttgaattaatggaaggcaggtttaaaaataagatggggagggagtagtttaaatatatcttctattaatgtataaaaaattaatactgagaagtcctctgacttttctcagaacccagggagaaaacccaatgccacctttctaagggatttcaagaggtgagaaacaaagctttttttttttttttccccaaaaggagcctactgcctttcacctcttggtgcaattctcatgtggaaaaagatgcagagctccttttcttgttctctaggcagaggaaagtagagtagaaaaataaccattcgtgtattatgaaccctgaagttggggagaagtattttaaagataaggatattgtcttccggaggcttttgagatactatctggggtggagaagaggatgcttatatggataataggtatgacctcttttttccttctttttcaggtgagctccaaggaagtgaataagtttcagatggtgagttttgggtgttccttatgtttcccttctcagggcaagagtcagtatgatagtgaacactgggtaagattgatacttgggttcactgctctccggagataagttttaccagtatgtttcaagtaaaagctgccagggtgtgaatttcaatgctaataccgtcttcctttctagtttttttaagttagattttgtcttaggctgtagatatatgctacctatactatagttgaacaagaagttgcctgcaattttcccttggaaaaaaacgtaaaaaatgtgtgcaactgtctgtgggtgttgcagaagctgc

SEQ ID NO: 7807 - DNA, 2182 bp, mus musculus
ctcccctgccccagcctctgaccccggcttcccccgcagtccctagagcgtgaagtgggccgcctctgccaaagaagccccgaggcagcccacggcctcaggcacaggcagcaggaggtggctgagagctggtggcagctccggagcagggcccagaagcggtatgaacccgcaggccttgccctcgccgacccatcctccagcatctcagtccccacacctcccctcagcccctgtgttcccctaggattccttctccacccttcaaataactgtactgtcctcccagtaactcccagcccatgggccctcctgtggttgaggggattaagggacagaagacaccagtgggcatgggggagaggggtttgaaggcctgacgactagctgatgagcgctgtgggcaggagggaggcgctggatgccttgcaccaagctcagaaactccaggcaatgctgcaggaattgctggtcagcgcccagaggctgcgggctcagatggacacgagccccgctcctcgcagccctgtggaagcccggcgtatgttagaagagcatcaggagtgcaaggtgaatgggcagctggcccaagcctttcccaggctctcagctccgccctgccctccccttcctctcatctccttgctcttgggcctcctgagtgtcccgccctgcctatctcctccagcctcccgctcctcagctgcttccccacctctctcctgcctgctgggctgcttccagcccccagtgatctgagcccagtcctgttccaggccgagctggactcctggacagacagcatcagcctggcccgaagcactgggcagcaactgctcacagcggggcaccccttcagctccgacattcgccaggtgctggctggcttagaacaggagctgagcagcctggaaggggcctggcaggagcatcagctacagctgcagcaggccctggagctacaggcaggcacagtcccatccccagcctgcatcttgcccccccgaacagggcctgcgctgaccccacagcctctggtcaaggctaagactggaggggctgctgtgccagggacttccccaccactcagcactcctgccttccaggaccctggttccctaacctgtgccactggaacagtcactccaactgcagtggctggaccctccaccgactgtctcttgccttttcctttgttctcagctgtttctgagctcagtggagaagatggaacgttggctttgcagcaaggaagactccctagccagtgagggtctatgggtaggtgcccagcaggaatgggcaggaggggggaattaccagagcagcattaggggtcaaaccagccagtgctgcctgagctccctaggccagggatcctccccttcggggccatctccccaccctgggccacatccgtcactgggcagttacttacccgtcatctagagcagttcccatgcagctgtgggcaggccccaccgcgaacaccaaggagcttctagagtgcctgtgtgggcctgacccattcttgccacctcacccctgccctcctcgcttcccaaatgcctagaggttggcttttcccgccactgccccaaccctgaagcagacgagtgtaacttataggagacctcagaggataactggggactaacatggtcctccagggagtgcagaggagggagctttcaccttaaatgaaaaagctctgcttgcctcagagattctggctcttgatccctaatccaaatgcctcccctggctgggaatcactgtcctaaagctggaaacagccttgagggatgtgagggatgtgtttgggcggagcagccgctctgtggatgagcatttggtaggatggttctaggtgggaaggcaggtagcctgggatgggagggggaggctcatggacagtattgggttccccactcccaccaggaccccttggcccccatggagccccttctgtggaagcacaagatgctggagtgggacctggaggtgcaggcgggaaagatcagtgctctggaggccacggcccgcggcctgcaccagggtgggcaccccgaggcccagagtgccctgggcaggtgccaggccatgcttctgaggtagtggtggctctggggtgaggggtgctgtgggcaggctggcacaggcatctggcatcccggttctt

SEQ ID NO: 7808 - DNA, 656 bp, mus musculus
aaattaactgggtgaagacaaaatacattttagctatctcttcctcctggatgggtgcattcacactttttttttttttttaagacggagtcttgttctgtcgctcaggctggagtgcaatggtgcgatctcagctcactgcaacctctgcctcccgggttcaagtgattttcctgcctcagaccacgcccacccccctgccccaccccctgagtagctgggattacaggcccacgccaccatgctcggttaatttttgtatttttagtagagacagggttttaccatgttgcccaggctggtctcgaactcctgacctcaggtgatccgcccgcctcagcctccctaagtgctgggattaaaagtgtgagccactgcacccagcccgtgcagtcacactttaataaattttgtaaggttacatgaagtttctttgaggatccaagaattctgttttctgagcccaagggaggaatgatgcagacagaaaagattggtaaccaacactggggagcgaggggcataaaggagatagtgctgacccttctccctctctcccaaccctaacctgttgcagacaaccggttccttgtttaaccctttagccagttaatgaaagtgtattatgctggcaacaacatgtctacttgacatct

SEQ ID NO: 7809 - DNA, 318 bp, mus musculus
tttttttggtaagtttcccctttaaagcctggagatacccatgaaagatctagaaaactagagagaaagggtcaagcttgagagaaacctcgagcttgagagatttggtgattagactctgtctactcattggggactacagatcttaaatcttgctacatttagaccagtgatcattggattgaagactgaaagcagatcaagatttcagcactaatatggcaatacttttttaatagcctttcccactttataaaaatcctttaattctattctccctcttctcttccatagccaatctccttgaaggatatcttg

SEQ ID NO: 7810 - DNA, 1108 bp, mus musculus
ccaggaattcattcctaccaccaccacaaccaactaagtgctcaatcaatattgattgactcagtgaatcagtcccggaaccaagaatgtgaattccccacaagctccccgaccttgggaggcccagcagcctctgtgtgctctgtcaccagtgcctggcacttgattcacgctttcagtcaacactgaggtccccacccagtcagctccacgagtgctagggagtgaagacgtgtcagggcggagagctgggaaggaccccacaggcaacctggaagcagcggactgctccatggaccctaaaggagaaagaggacatgttggctcctctaattccctcttgcagcccacctctggctacagcagatgctggtgtgaagtcacctctgcactcagtcactggttctctgacatcttccccacccagtctcccttgtgtagcacagtcctgcctcctccctcctgactcctattgtgtgtgcaggaggcctgttggggagttggtggagccagaggttaggagaaagagaggcaaataggatttatgggatatttgcctttcctaagaactgtcctctgctcatgatgtcaacctaggttcaaggtacagaggccaaataacagggaagcaatgctcagaaattagcagccagctgggacagaggctgggtctggctacaggcggtggggcctggtcagggtcatctctgggtggcctcctccacacactgacttctacctagggctcagggaggaggaggatgaaggggcagcagtgaaatggcttcacgaggcatgcataggctgcaggaagtgcctccaagacaccagcagacattctctggtagagcctctgcccctcactcccagcttccttctctcttaaagccctggctgaagcagacactgagctccttctctgggcacctgaaagggggcacagggcgtgaggatgatgtttccaccaagactgcttagtgcatcttctcatcagtaggagctgcttggtgggggtggtggcatggggagcatcatttgtcctctaggactggacacctcaggcctatgagaggcagcatgttgtaaaggatttgatgtcaggattcct

SEQ ID NO: 7811 - DNA, 925 bp, mus musculus
ttaattttacctttaaaaatgacatatgaaagaatcccagggtgaaagtataatctatgtgagtccaaattacattggtttattctgttccttttccctataccattgtttttgagcaaatacttcctgcctagctttggaaagttaattaaatgtcaaatcacagatgtggagcaaatgaaacacttgggggataaaatgttacatatgtatgaaatgaacagcttgaaggaaaaagggaaaaaaagaatgaagaaaattgcattttgggatgttctagtctttgattgcattcttcaatttggcacactttgacagttaaatgttcctcaatctctgcatttatatatattcttctgaagtagtgtcattcttgtacttatttaactatttttgacagaaatacaaaaaattcccctgcaaacttttttgcactaaagaagaacaggcacagattttcccactacataatataaaagtagaaatttgcttgccttggttattcatagataagaaacaccaattctccctattaagtacctgcttatggtagacatgaggggtgattactagaaaagatggaaagagtatacaggagaagtatatacttagatgacttctttgtcccagaaattaggtactgtagtggcctcacgcttctgactttctgtgtctcacactatagtcatacataatctcagagagccctactcatttgctttgtctgatgtaaaggcatgtgatttttacctcatgacctctttggttttggcttcagtttaattattgagttcatcctccatagccataaattttcggagctctaggcactcttgaggccattttacctagctccttacttttatgactgagaaagccagtgcccagaaatctatccaagcccagaggaggaattgttggtaat

SEQ ID NO: 7812 - DNA, 1110 bp, mus musculus
atcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggtgaggcagcctggtgggggccaagggatgccatcaaataatattgtttaaattaatggaaaaaaatgcaacatttcataatctacgggaatgaagatcattccccacttcctatatgaggagtctctgatgatacagagctacacttgttcccttctaaatacctgtaggatgaaagatttgctacctggctccatgattttatgaggctctgggtttggagtcagtttggagtcagctctttacatcatgagaaagacctttccgtctttggatgattaggcctttcaggatggtaactttgctcagagctgggccctgttaactttcttatgatatgttttattatactgctgctctgccagaaactcctgtccagtgtcctaattaagtttagtagttctactcagaagaagggagaaaactgacagaggatctcaagcttgatgggagcatgtggggagatttgctgaaggaatcacccagaaagccagcatttcctgccttctaggtttagtttaggcagtttgaggaaataaaggctgaagaaagcccaggtgatacatggttaatagaggcagaaatgtaaagaggacaactctttcacaaagcctaaaatcagctttcctaaaattgtgaaagaatggagataacagagttagtcctcttacccaggaaggagctcagtgaccctgggagaactgaaactgggaaagttctcaaacgctagatgttacttcactgtgagaacacaatgctacactacaattagtaatggaaatgtaattaaccacttggcacttgtggcttgcctcagtcattgccacactcccagcctgaaaagtttaaaccaagtaactccagtgatcacaaatggcctgggtaatccagcttgtcaaaagacttgaacaca

SEQ ID NO: 7813 - DNA, 1110 bp, mus musculus; identical to SEQ ID NO: 7812

SEQ ID NO: 7814 - DNA, 2300 bp, mus musculus
tatgaaaaattatataatttagtctttttatttcaagtatgactaacttggcatctatcagtcagtgaataacttattttgaaataatagttttaattattatattatgattataaattactaggggagagccaaaaactttaccatacatattaaagaaccatatacaatagaaccaacctaatgcttatttctcagatattcaacatatctttcttaaaattttaagtcaatcaaaatttatatattttgaagatcatagtagcacactgctaacccaattttctttgttttaggttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgatttgaatgacagcaagtgcaaaggcacaacactgaaaaaaattatatttatagatagcacctggaaccaaacaaacaaaatattcactgatgagcgacttcaaggtaaaaaaaaaatgtttttttggactgctcctccctcagacttattttgaaaaaacttcaaacttacagataatttgaaagaggagttacactgaatacctatacattttgccatatttactttatttctctctttttattatatatgtgagtgtgtatttatatattatatattttttggttgatcaattgaaagtaagtttcaggctttgtaacacttcacccttaaatattaagtgtacattttccttttttttcttgagacagtcccactctgttgcccaggctggagtgcaatggcacaatcttggctcactgcaacctcctcctcctgggttcaagtgatcctcccacctcagcctcccaggtagctgggattacaggcgcccaccaccacacctgcctaaattttgtattattagtagagacggggattcatcatgttggccaggctggtctcaaactcctgacctcaggtgatcctcctgccttggcctcccaaagtgctgggattataggcatgagctaccacgtccagcctaagtgtacattttctaagaataagaatattctcctatattaataaagaatgacatctcttttataaacaccctaatggtgaatacatttactaagaagttagatcttctattttgttttttttgttttttgccttacaggttttttgttgttcttgttgttgtttgtttgtttgtttttgagagggagtcttgctctgttacccaggctagcagtggtgcaatctcagctcactgcaacctctgcctcctggggtcaggcgattctcctgcctcagcctcgctagtagctgggattacaggcacaccatcaccacgcctggctaatttttttgtattttcatagagacgggtttcaccatattggccaggctggtctctaactcctgacctcaggtgatctgcctgccctggcctcccaaagtgctgggattacaggtgtgagccaccacgcgcagccttccttacagtttttaaaaataacttttttgagtaagaattaacatgtagtaaactacatgtttccagagtattaaagttttctcatatgtgtacagctgtgagaccatcactacaagttaggaaatgaacctgtccatcccctgccaaagtttctgcctgaccttttataatctttctcatccagctttccccacagcacacttccacactctccaaccccatctctaatcaatgatctatatctaatcattatagattagatgcattttctgggatattatagaaattgaatcatatagtatgtactcttttcctttttttggtttggctttctcacacaaaataaataacttgacactcatttttgttgtagcatgtatcaataggtcatacatttattgccaagtagtatttcgttgtatggatatgctacaattagtgttatctatttatctgttgatggacatttacactggttgtttcccattttctactatttcaaataaagttgctatgacacttgtgtaaaaaaaaaaaaaaaggatgttctcctgtataataaatacagtaccattatcactcctaagaaaattaatgaaaattacataatatcatctaatatactgtccatattcaaatttccctaactgacccaaaaataccttttgtagcttccccccatatagcatttaaactcgtcacggtttatttcattattatgtatctttagtctcttttaatcta

SEQ ID NO: 7815 - DNA, 879 bp, mus musculus
aaacccacagcaaacattgcatactcagggaaattttagagacaatcctgttaaagttaggaacaagaccaggatgccatgtaatgctattcaacactgtgctggatgttttctaccggtgttataaagcaggaaaaagaaatagggggtcaaagaaaacaatcattttgtgtaggcaatgttgtctacattaaaaagtccaagagatgctatataaattagaactcataacagagctcggcaaaatgtctcaattggagataagtatacagggatcagttgggttcctatgcatcattaataaccatttagaaactgtaatagaaaaaaattaacagcagcaaccaaaactgtaaggtagctagaagtaaatctaatgaaagatatgcaagagatttatggagatgactgtaaacataattgaaggacacagaagaagatatgactaaatggagagacatgtcatgttaatggagaggaagattcagtatcataaagataccagtttaggctgggcgtggtggctcacgcctatagtcccagcactttgggaggccaaggcaggcagatcacctgaggtcgggagtttgagaccagcctgaccaacatggaggaaccccatctctactaaaaatacaaaattagccaggcatggtggcgcatgcctgtaatcccagctactcaggaggctgaggcagaagaatcgcttgaaaccgggaggtggaggttgcagtgagccgagattgcaccattgcactccagcctgggcaacaagagcaaaactctgtctcaaaaaaaaaaaaaaaaaaaaaaaggatcccagtttacttcagatcaacatagagtgctcatggcatttgatcatattatcctaaaatt

SEQ ID NO: 7816 - DNA, 512 bp, mus musculus
cttcactgcctgactgccgccatcatgggtcgcatgcatgctcctgggaagggcccgtcccggttggctttgccctatcgccacagcatccccacttggctgaagttgacatctgatgacgtgaaggagcagatttactaagtggccaagaagggcctgactccttcacaaattggtgtgatcctgagagactgacatagtgttgcacaagtacgttttgtgacaggcaataaaatcttaagaaatcttaagtctaagggacttgctcctgatctccctgaagatctctaccatttaattaagaaagcagttgctgttcaaaagcatcttgagaggaacagaaaggataagaatgctaaattccatctgattctgatagagagctggattcaccacttggctcgatattacaagaccaagcgagtcctccctcccaattggaaatatgaatcatctacagcctctgccctggtagcataaatttgtctatgtactcaagcaataaaatgatt

SEQ ID NO: 7817 - DNA, 270 bp, mus musculus
gtttcatttttgttgtttattagtgtcaacagaatttgaaataattttcaagctgattttattcattgtttacctccttaattatataatagaaataagtagcttgtgtttcttatgaaaatttacctgctacttgatgtatcttttttcagtgcacggtagtaaaatcagttgtatatatcctgtctaacatcagtatgcatattatactatactgtacatttaattaggagtttattagctgttggcttaaatgagtttaaaactact

SEQ ID NO: 7818 - DNA, 1026 bp, mus musculus
gcaaagaaagcataaccccaattttttgatatcagtttttaacaatacaaccaatttaggaaatatcaagaactgattatagcaatgacaggaatattagtccccctgcctttgtactttgccccttagcaacaagtgaattcattactgtattttcttatttgtgcttctctcctttaaaaaatactcagtttgctatttttaaaaattacccaagaatgggtgggcatggtggctcatgcctgtaatcccagcactttggaaggccgaggcgggcggatcacgaggtcaggagatcgagaccatcctggctaacatggtgaaaccctgtctgtactaaaaatacagaacattagctgggcatggtggcgggtgcctgtagtcccagctactggggaggctgaggcaggagaatggtgtgaacccgggaggtggaggttgcagtcagccgagatcacgccactgcactccagcctgcgcaacagagcgagactccgtctcaaaaaaaaaaaaaaattaagactgattttatgtggtggctcctttcaccattaaaaagttagtttatacatttttttgctttgctccttgttttagtttctttcttttatatgtgtatttatcagcatattgtggtatgtgtgttagctgtgccagtattcagctcttagaaacacagccacgtgttactatgccaccttcttgaagtttggagtgtaacagtgtagactttgatctagtttttgtttttctgtgagacatttacatgaaaacaacatctttgattttaataacttacctgtttctcctgtttatttcccctgaaattgtcttaatgctccataagggacatagcagctggttgcgatggaattgactgacactaagtaaaagattatgacttcgggtagaaattaagtagaaagaactgctgatttcttaaagagatgggatgcactcagattgtcaaatattgacatagaccttctgttaatttaagagtaacaattctggttttggtgaaaa

SEQ ID NO: 7819 - DNA, 1026 bp, mus musculus; identical to SEQ ID NO: 7818

SEQ ID NO: 7820 - DNA, 1998 bp, mus musculus
acccttgcatcatttctggtgaggctgacaagactttggggtgagagttccttaggtgagtacatgggaatcaaagggccagtcattgtccccaccagggcaggaagcttgcttctccccaagcccattttgttcctgattttccatctcctctcactaaaagatgtggccagatgcagtttgtttgatctgattaaagttttatctccttttcttcttttgttgtgtcagaaggggttgtaactagtaaaatgcttagagaacagatttccaaaaaggaggaaaaggagaggccagggaatcggagtcaccagcatcctgactgccatgtccacctccccagccccgcttaatgaagtagaggtggctgtgtagcaagttttggggttgcaggaaaaatggccctgggccttcttttgctaccactcaggtttcttaataacattttattcacctctgtcccatcctcttgggcctaggggtacagagctgaaaaacacccctctgggggacatttcctagaaaatagttcatgacagatcattaacaagatttggaacattctcagtccttaactaacagagtctgctggaggtgggaatccctctctgctcctgctcaatcttcctaactctgctcctgctcaatagtagaggtggccaggccggttcattcctaggacacatttattgaatatttcttctgagataggtcctgggggtgaaacactgaattttttatttttctagagatgggatctcactgtgttgcccaggctggtctcaaaactcctgggttcaagcactcctcctgccttggcctcccaaagtgctgggattacaggtgtgagccaccatgcccagcctttttattttattttttttaaaccaaaagagaaaccttatttaactcttatgctgcattagtttgctagggctgccataacaaagtatcacagactgttgtggcctaaacaactgaaatttattttctcacaattctggaggctggaaatctgagatcaaagcgttggcaagtaggcttctccggaggcctctctctttggcttgtcgatggccgttctttccaactgtcttcacatgatctttttcttgtatacgtgcatgtctgtgtcctaatctccttttctttcttttttttttttttgagacggagtctcgctctgtcgcctaggctggagtgcagtggcatgatcttggctcgctgcaagctctgcctcccgagttcacgccattctcctgcctcagcctccagagtagctgggattacaggcacgtgtcaccatgcccggctaatttttgtatttttagtagagacggggtttcatcatgttagccaaaatggtctctatctcctgacctcgtgatccacccgcctcagcctcccaaagtgctgggattacaggcgtgaaccaccgcgcctggcctaaactcctttccttataaggacaccagtcatagtggattaggcccatcttagagacttcatttttatttaattatttctctaaagatcctatctgcaaatatggtctcattctggggcttaagacttcagcacatgtatttttcagggacatcattcagcccataacacatgtggtcgcctccttactcctggggtctgagggttgtcccccaaagctgcccccgaccctaggcattggatttgttttctcaccaaccacccagcacgtccctgtccctgtcactcccactaccctctactgggctcccagcctctgtgaagggcaccatgtgagctgggtccagcatggcattggggaggaagagtcctggtcatatctgtgactaactggcagtagggagaggtccacttggttagtggccaacagaaaattcagccagcttctccctcagcactgaagtgagactctgagctgatcagtgctggctctcaagagatgaactttggtgcctaattttttcatctgaaaaatgagactggtggataagt

SEQ ID NO: 7821 - DNA, 1998 bp, mus musculus; identical to SEQ ID NO: 7820

SEQ ID NO: 7822 - DNA, 1174 bp, mus musculus
ggccattgctgagaaagaggttcaacttgctgttctattttgcctcagagggtggaaatagaagcaatgagttgaaattagaaggaggcagaatcaaattggtacgaggaagtcttttctaatagtaagaaccatccatcattaacacaaggttagacactgaaggaaagaggtccacattgcaagagacggtgaatgtctgtctctatggcaaaggacaccaagaaggtgcttcctgcagcaggaaggcagctaggaaagattccctccaatgactctctgtgaagtaagtactaggattctagtaacttgaagtgcataggccctgtctggggcctcagaacagggcctgtcagatggtcgcctctatgtggaaatagatattccaactctattcatgtgcatgatataattttagaagggcgaggatgtcgtcacttcccaaaatatacttcttgacggtcttgtttctgcattaattcaccattaaaacttttcttctttagcttaatactttattctgtgttcaaatgcacattctcatgggaaaaaagagtggttcaatagaagctactgtgggcccatcatatccctgtggtgtagtgaggttctccgtccctcccagagagcaggtcttgtctggagaggtagagctggaggggagggggttgaggcaggggtattgggtgtctggggtgggggctagagagcaggaaagactgtaagccaggagggagtgggagtgccaaagccagtcttggctgcctttatgaatgtgtttggggctgggcctgtcctagagatatcccaaaactattttaggaggcagtaaatttagctggtggctggtttgcaaatcatccagatatgttggtatttctgatgagacaatctgtctcgagaggagacatttagagcctttacaaccaaaagggatgtgcctttttgaacacggccatggaaaaagcacaaccaccgccgcctattttgttggccaaacccagcagtgggtaaaatgtgcatgatcacgggagttgcatttgtacagagcctttcaggtgaaaacctgcttctagatttattatctacagaattctcagaacagcctaaaaaagcaagtgggccaatacccatcttgtagatgagtagactgaggtgcttacctaaagttacc

SEQ ID NO: 7823 - DNA, 702 bp, mus musculus
tcccatttcttttttcttttgttgccttgccttttcttttctattgtctcttctgtcttccctctctctcccttttttttttccttttaattacatttattttaatgctgaatttactcccgtgccataagtttttgtttcttcagtttcttctgggatatctttttcttctgggcaacctcctcttctggtttaggaacaatctgttccttttccgtaaggatcatctcaatgtggcagggagagctcatgtatgggttaatccgaccatgagctctgtaggtccggcggtgcatcttaggtgctttgttcacttggatatgctcaatgaccagagaatctacatctaaacccttaagttcagcattactctctgcgtttttaagcatgtgcagcaagaattcagcactctttttgggccaccgaccttgtgtccagccccactgcttggcctgcgcacacctgccaactccaccgttgtaatgtcggaatggtacacactgtttctgtaaagtgacatctttcagatacttcgtggcttttcgtatatgcatacccttgatggcctgagcagtttcacgagtgttcttaaagtgaacacgaagattggaacctcttgatttgcctgatttcgtggggttctccgggtcaagtgaatagcgaaccattttcacagattacctcaggctgcttaggaaaaga

SEQ ID NO: 7824 - DNA, 1212 bp, mus musculus
ctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccatccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggag

SEQ ID NO: 7825 - DNA, 1452 bp, mus musculus
tactaagggaatttataatagtctaaagggtgtaactgtctcttaaagagactaaaagttctttaaaatgttgcaaacaaaaagtcagtggtagactgggcgtggtggctcacgcctgtaatctcaacagtttgggaggctgaggcagatggatcacctgagatcaggagatggagaccagcctggccaacatggcaaaaccccgtctctgctaaaaatacaaaaaaaaaaaaaaaatagccagtcattgtggcgggcacctgtaatcccagttactcgggaggctgaggcatgagaattgcttgaacccaggaggcggaggttgcagtaagctgaggcactgcactccagcctgggcaacagagtgggacaacatatcaaaaaaaaaaaaaaaatcagtggtagaatttagcaatttgaaagccaaaggatatcacccctcatccttaaataccaaatccactgcagtcatagagtactaactgtatgttattttagtttgctcaagttgtgtaacaacacaccatattctatatgacttaaacaacagaaatttattttccctatttctggaggctaaaaaattcaagttcatggttccaacttatttgctttctggggagggctttcttcctggcttacagccagccaccttctctttgtgtcctcacatggcaaggagtgagggagagaggaaggaagagagtgcaagggagaggctatgcactggtatctcttataaggacaccagttctattgtatcagggccctatgcttatgacctcatttagccttaattacctctttgtaggtactgtctcacattgggggttaaggattcaacatatgagttggtggtggggaacacataatttagcccatagcactctacctctaacccatcctgcctcagaatatctgtccttatagcatgcaaaacacattccaacagctccaaaagtcttatttatgacagcatcaactctaaagtctaaagtccaaagtctcatctaaatatcatctaaatcagatatgggtgagattcaaggtatgatttgtcctgaggctctccagttgtgaacctgtgaaaccacaagttacatgcttacaaaatacaactgtgaacaggcataggatagacattcccattccaagagaaagaaatcagaaggaagaaaggagtgataaatcctgagcaattccaaaacctggcaagtcaagttctattaaatcttcggcccaagaataatcctctttggtttgatactctcccctgcaagcccactggggtggcaccatcaccaccatggctctgcatagtggcgcaatactgaggcactggtcatggttatcctagcctaccagatctcaagaggcagcttcaccctttgaaactgaggatggaacagccttgcctactggtcctttggtgggaaaagcagccctgatgtt

SEQ ID NO: 7826 - DNA, 5358 bp, mus musculus
aggaaaagcaagtgactattcaaaattaggactaagaatagatatctagctacagatgaggaagaaaataaagaataacactttaaactctattctaatagatctgaatatctgtattaaaaatcctttaagattgtatgccatggacacccaactcctgctactgcaggagaagaaagaagctctgccagatattaaaagatattatcatgctatagtaaataaaaatgtatggtactgaggcatgaatccacagacaggtcaaaggaaatgaatagagtacataaattgacacaaatttattcaaaaatttagcatataataaaagcagtgtttagaagaagtgcagaaaagacagattatttgccaagcagatcaaatataaatatatagtataattattaaacaccacaaaaatgagagtttaaaaataatttcagaaagcagatatctttctaactgtaacacaaaacctaaaacttatcaaaggaaaatatgggatcaatgtaataaattagatataaaaagttttctgcatgacaagaacattaaaaaagacaagcaataaactatgaagaaatattttcaatttatatcacaactgggtaaattcaccaatataggtaaagagctatacaaatcaataagaagtggaatgctttaataggaaaatggacaaagtatatgaagacgtattttcccaaaacagaaaaagaaatggattttcttcacatgaaaaaaaagtcaaccttttttataacaagaacagtgtaattagaacttatgctgagttttaaaaatttacatatcaggttgataagaatcaaaaagtttgatgaaattcaactttggaaacactgtagagaaagagatactcttaaacacttctgataagaacagatactacacttgatcttagccaaaaggccaagaagcgatactcttaaacacttctgtagggagtgtaagttcatatcacctccataaaaggtaatcttatcatatctatcaaactttaacttaattatttcacttccagattatatattccacagataaacccatgtattataaatatattcattgcagccgtgttgtgatagaaaatattagaaacaatttaaatgttcatcgatatttgatggttaaatatagtccaaacataggatggaaaagtatacagtcattataaataataaagcagctctataaaaatttatataaaatggtctgctagatattaagtgaaaaagctagatgtaaacaaatttatataaattaccatatatataaatatggtaatatatagactcctacatatatatgtatattcttacaatctgtatatgcatgcaatatatcaggcaggatacacaagattctgatattaagtacaagcataccttgttttgctgctttttattgtgcttctcaaatactgcatctttacagattgaaagtttgtgtcaaccctgtgtcaagcaagtctatcagcattatttttcctacagcatgtgctcactcatgtctctgtgtcatattttggtaattctcataatatttcaaacttttttattattattatatctgctatggtgactggtgacctgtaatcttttaaatgttactattgtaattgttttctggcaccacaagccatgcccatctaagagagcaaacttaatcaataaatgttgtgtgtgtgttcttacagctccaccaacaacctgtttgttctctgtctctttccctttcccgggacctcaccgttctctgagacatgacaatattgaaattagtccacttaacagctctacagtggcctctaagtgttcaagtaaaaaggaagagttgcacatctcccacactaaatcaaaagctagaaatgattaagcttagtgaggaaggcatgtcaaaagccaagacaggccataaactacacctcttgtgtctaacagttaatcaaattgtgaatgcaaaggaaaaggttttaaaggaaattaaaagtgctactccagtgaacacttacacaataagaaagtgaaacagccttattgctgctatggagaagcttctaatagtttagatagataaaactggccacaatattccctcaagtcaaagcctaatccagagtaaagcactaactctcttcaattctgtggaggctgagataggtaaggaagctgcagaagaaaagttggaagctaccagaggttagcccgtgaggtttaaggaaagaagctgtcttcataaaagtacaagatgaagcagcaagtgctgatgtagaagctacagaaagttatccagaaaatctagccaatatcattgatgaaggtggccacactaaacagcagattttcaatgtatatgaaatagccttatattggaagaagatgccatctaggatgacattcatagctagaaggagaacgcaatgcctagttttaaagcttcaaaggacaggctgcctttcttgttaggggtatgcagctggtgactgtaagttgaagtcaatgctcatttaccatcctgaaaatcccagggccctttagaatcaggctgaacctgctctgtctgtgctatataaatggaagaacacagcctggctgatggcacagctgtttacagcatggttgactgaatatttttagcccactgttgagacctactgcctacaaaaaaaaaaaatttctttcaaaatattactgctcattgacaatgcacttggtcacccaagagctctgatggagatgtgcaaggagagcaatgttgttttcatgcctgctaacacgatatccattctacaatccatgggtcaaaaagtaatttcaagtcctactatttaagaaacatattttgtaaggctatatagctgccactgatagattaattaatgccatagatgccattaagaacatttgtaattcaagggaggagaccaaaatatcaatattaacaggagttttgaaaaagtttattccagtcctcatgaatgactttgaagggttcaagacttcagtggaggtaataactgcacatgtggtagaaatagcaagaaaactagaattaaaagtaaagcccaaagatgtaactgaattgctaaaatctcatgatacaacttaaatgaatgaagagtttcctcttatgaatgaatgaatgagcaaagaaagtggtttcttgagatggaacctattcctggtgaagatgctgtgaacattgttgaaatgacagcaaaggatttagttgataaagctgcagcaggggttgagaggaatgagtctaattttgaaagttctactttgggtaaaatgctgtcaaacagcattgcatgctacagagagctctttcataaaagaagagccaattgatgtagcaaacatccatgttatctttttttttttttttttttaaggtagagtctcactcttgttgcccaggctggagttcaatggcgcaatcttggctcactgcaacctctgcctccatcgttcaaacttcccaagtagctcggattacaggcacctgccaccatgcccagctaatttttgtgttttcagtagagaccgggtttcatcatgctggccaggttggtctcgaactctcaacctcaggcaatccacccgcctcggcctcccaaagggctgggattacaggcgtgagccaccacacctggccagtgttatcttattttaagatattgccacagacacctcaaacttcagcaaccaccaacctgatcagtcagtagtcatcaatgtcaaggcaaaaccctctgccaacaagagattacgacttgccaaaggctcagatgatcattagcatattttagtaataaggtatttcttaagtaatatatgtacatttttagatataatgttattgcacacttgatagactacattatagtgtaaacataacttttacatgcactaggaaaccacaaaattcatgtgacttgctttattatgacattcactttattgcggtgttgggaagcaaatctgtaatatctgtgaggtgtgcctgtagcagcttctggaaagggacaatgggtgatggggccaggggatggagagagccttttatctcactatgaagccttttgaatattttgcattttgtacatgtttgtattgcccatttaaaagcaaacagggacaagttttgaaaaacatgccagaaaatattcttactaaaacaactacaaaatgattaccaagaaaaaactaacatcctaaatagcaagtcaattgggcaaaagacaagaccaaagaattcaccaaagaagcatggtcagtcaatcatcaattgttcagtctcaaaaagaaacagtaaaaaaaaaaaaaaagcaatgtttctcaactgaacatgcacaatgggtcagtgatttgcctacattctctgtaacagatacctgaaagggagatggtgtaggagaaagggaaaagaggaaggagggagagggagaagtggggaggaagggaggatgcctaatctctaggtccctgggtggggcagaggggaaggtgcagccaacaggaaactgtgacacttctccttcctgagcaggaaacaggagcccaggctacatgttcactttaaaaacttgtccaaggcttattatcccttatagtatttataatcacagccccacgcaaatgtatgtgggtttccctccctcctccctgttgcaaagtaaaagcctaaagtcacagaacagggcgcctcaggaagatactggtaatgagatcaactgcctccttcaaaagttaactattcctagaacagtaataatgacaataccagcaattgcaagctactgttgccctacttttaatatctcacctcatttaatccccccaatagtcctatgagttaggatttatctccgcttcatagatgaagatgtggtggtttggtaacttgccaaacataccatgtgccaaaggtcggatggcaaggatttaaaaccaaactgcactgccctcttagatgatgtctagatagagactattttctctctactctgcagaaccacacatagtatagaagagatggctaacttcacagtcagggatggccaggttcccccaatagctgcatcctaatccatatggatcagggctagagtgaggagacagggtgagaaccggtcacttgctgacattagcacggagagaaatgattaacaaatcaaagagattagtttccatggaaaccgttcacctaaagcgatatcagtgtgttcctggatggatggaggagcttctgaaatcttaataacgggcctgaaggaagataagctgtcaggctggaaatggtaagatctcagtgttcaatctttgttgaaacatc

SEQ ID NO: 7827 - DNA, 393 bp, mus musculus
gtttttactatctttggagcattgctttttccataaattctaatcttagctatgaacattgtggtctcttgactttttgtttctgggagaattataatcatgttagcaaatctgggcatatctaaatagcaagagtagattcggtaattggaacagcaaaatgtaaaccagaagttcaaagagacagtgtttaaaatatactgaccatctgcagtctgcatccctggtaatacagaggaaagaccagcatttatcttttcattgaaaccatgtgctgtgtgtgtaggaaggaaatgcatgctggtcagaggtcagaagcaggatggatgaggtttgaaagggaatatttactatggggttttcctaaacccttagcctctagggagatgttat

SEQ ID NO: 7828 - DNA, 4567 bp, mus musculus
ccattgttattctagcttgactgcctctgggatagcctgtatggggtgagcttaagagccatatcctatactctggccagcctctttccactgcctttcaaggagacttggggtgtggtgactgacctaggggcataggcctgcagtgaagtagcagcaagatttaaagtgaatccagtttctgaatggatgtagtcattgctttgtcctcccaggattctggtaattgagagatgaccagggttggctttctggggtcacgtgatccatcctgatccagctcccagccacacaccttccttaggtctgtcttggttccaccatatccaccctgcttggggctgagccagaatccccccaccctccaaggtcccatagctttcccctacacttgccagtagtttagatctccattttccacgccctgcttccctgcccccatctcttgatagtgtccagtgacagtagacagatctcttgacttctcatgttgcattcagttttccagatggaaaacatttggtaaaatgtcctgactcagatggacattggcattatggaagggttattataaagaaaggaaaagtcagctggaccgtagcacatgaacatcagtacttcatagatggggaaaagaagaggggcagtaatgtttccttcatcgtgtataaaatgagaagcaacatgatatggaagtttataggacaagtcttggagtcagacaactgggtttttatctctagagtctcctactggccagctttaatgtgttaccttaagcaagttagtttaacctttcccaaatctcagccaggtgcggtggttcacgactgtaatcccacactttgggaggccaaggcgggcggatcacctgaggtcaggagtttgagaccagcctggccaacatgatgaagccccttctctactaaaaatacaaaaatttgtcgggtgtggtggcggtcacctgtaattccagctactcaggagactgaggcaggagaatcgcttgaacctaggaggtggaggttgcagtgagccttgatcatgccattgtactccagcctgggtgacagagcaagactctgtctcaaaaaaatcaaacaaacaaacaaaaaaactttcccaaatctcagttacttctgtgaaatgaaggaatagtcgtatgcataggctcgttgtaaggtttaagtgaactaatataaatgaggcactcaataagtgttcaacaaatagtaattgctgttgttagtattctaaaaattattttaccagctaagctaaggttttctcttgagccagtggcttatcagcaaactcaatagtctgatagatagataaatgtagatctagcaagagcaatgatacttctgttactactgacagctgtcacttactgtctagatccctttagttaaggcaacggtttgtatctggaaggtctgtcctttagcaaaagagtagactcaggttcctaccacagaaagcaagccctatgccattcaaactttttttgtcttctctgttttatcagttacaaggaaagtgttctgagttgaccattgagaataaacaaccttagtaagtaaaattgctggtaggttcactctttagaatacttacttagattgctcttattccctgttcagatcatctgatggggaagcagccagtggttattgctaccctgcccttacatagacacccagtaatcctttatttccaagagtatttttcctgagtgtttcttagagtcctagggcttgcaatgatttctactgaataagccattgttgatattttataacccttatcaattgtttgatgtctttgccctcttcctgactacttgccattgaaagaccaggaaccttgactcattcatctttgtatctttgattagcagaatgtctggtgtatagtaaatgttcaataaatgtttgaatgaataaaagtaccatgtgctagatattatcttcttacccttccacctcagattcatcctctacccttcttgacactgctctggtccctgaggggctaacttgcagacatcagtgggctcccaagccctctggcttctagctgggtttatccaatggcaagtggaaatcaaagggagagaggcgagggtgtttgctcccccagttccccactcctgtgaggttgccatgtgctgactgtgtcccccaacaggtagcttgctctacgtgacccctccccctcccagggtctgtagcctctccatcccctcattcttttaggccaaggagtggtgacagctagcaccaggctgctgcaccatccttacagattccctgtaccccactcacacccgtataattagtttctttgtcaattaaccctccacaaattatcctaattggactgtacctgctccttcctgttgggaagcagcaggcctcaattgcttatagagattttcaattgtttgagttggacactggggctccaggtgactcataaagcgacatagtgcagttcttccaagaatgtgggacatggctagccattaagggcactctgatgcgtggcagctttggggaaataaatagcagtttgggaaactattctttgtttaggagagactttctcccacggataacgtgtaggatcttattttagactgactgttaagtctctgaagttgccccttttcatggttgtgtatctgactcagcatgggttgttcatctgactcagcatgggttgttccaggagaacgcgggaccaaatttaacagggcagaggatacaggcttgaagcactggctttgccaatagaagactttctaaggaatgactttgtctcattcaacatttaaattttcactctttgggctgtttttctgcaggtgatcataaacagcacaatcacaccgaatatgaccttcaccaaaacgtcacagaagtttgggcagtgggccgacagcagagccaacacagtgtttggtttggggttttcctctgagcagcagctgacaaaggtaacttggtcctatccacagtgcagtaaatcccgcatcagatgccattctcatcagtgattgcccgccgagggatgtgcccttggtgagcaggattcctttctggtctttggtttcactcctcctggcatcacggggctgccaaagcagaggcccttttgaaataccaggttcacggaagtcatctggggaagggaaattcgtatctaacaaatgctgctttggggcctgaagttgcagtgtggccagtccatcctcccctccaggtgtcagccactgctccctgtgcccggtggtatcagcgcacagactgagcgctggcttgtgtgccaaaaccagatccattgggttttcaggactctgaggattaggtgaccttcctgtgtgagggcacagttatcggagggttgttactatagaacttccaaggaagagactgtgttcctgctgccaagaatgcatcttgatgaaataagcatgttaccccttttgaagtaaggcacactttgtctctgacagccatcaacgtcagtgactctgtttttggagctcttggggagtaaggtgatgcataatggaagcgcttagcttggactccccacgtgccttaaaatgccacacagtggtgtgtgtatgttactttttttctagggagaggattcatagctccaagtcacttctccaagggccctgggacaaactccttggatggttagaaaggtgttgaggagcaaatcatggctgaccacagacttggagaacctcaagaactgagggaataaactgatcgcctctgagaggccttactcagcagtttaaaggggctgagagcctgttttagagactacatttccttttagggtggtagaagagccctttgtaagtatttagaatattttggtttaaggtaagactgactagtttacaagtcaaagaaatttattggaagaatgttggagtctctcaaggagtgcaggagagagctgcaaacccagggaagggccagagccagacttgcttctggcagcttggctctaagaattgtttttctctagacccttgctgtgaacatctgactgactggctggacaagtgctgacccagcctctgctctgctgacaccatcctcagcactgaggatgcagagatgtggcccttgttccagggcttcacaaatttccagattcttggggaattgacagagttgcctagaacagacttgactgcttgggttacttgtgtgtattgaagacagttttcaaagagggggaaattagggtgagtcaggaagcctcccacagcagaggcctgctaactggtccccttcctttgtccagtgtgtgtgcatgtgtgtgtatactcacatatatgtgtgcacgcacacacacttctaaggaggtccccagcgcacagatccggccatcccatacccagtcacaaatgagcaccccagtggggataccccacagactgtcctctgcatcccaaggaacttccacgaagactctgtttccttagaagcctgagaagtccaaaatggcctgatggcactctgagcatcca

SEQ ID NO: 7829 - DNA, 179 bp, mus musculus
atgggttcttttcttgaattttagtgatgataacctcacacatagttaagtgaacttcgtgcctgaagatgggggtcctgcctagacaaatgagcaaaaatgtgtcttttttcctgaactggaaaagctagtttacagagtgatgacttctttgtgattaaagttaccagtttctgtaa

SEQ ID NO: 7830 - DNA, 1249 bp, mus musculus
ttgcaatgcacagaacggtccccataacaaataattttatgacccaaatgtcaatagtgctgatgtagagaatccttgttatagaccctaacaaatgcgttttatccatgagaatgtatattcattttattttcacgaaagattagttcacccatcaaccagttgggatattgccgagtagccttcttgcaccgtccttccataacctcctcaaatgcaaaccaaaatgagttatgtcagcacaaacatcccaggggatcctgatacacaaataagaaatagttagccctggcttgccaagctccctccacaccaagtcaatagtctcatcttaaattagagtccatacactgtgtccttcagtgcctgctcctttcccttctccctgccacccggagtacaagatgcagacttttccctaaatcctataataccacaaagcccctgctctttgtattattctcaagccctagcaggactttttgcactcaggcaaataaacacgccaccaataatccaataaaaccttcacagacatcggatataaaccacagtgatgagcagcgcacaatctatagctgcttggttcttttttataaaccgtgcacttgagccctgaaggcaacacaaatcaaagctaataaaagcaccaaggccttccccttattgttcctaatgggttgattcaccctacctatgccatccccctagtgaccacaggctgtctccactcccaaatggaagacatacaagccagcatatcaagtatgaggaaggaaagagctcatttcaaatatgcctttcatcatgatggctttccacttggtgctcaatagctgcagagaaataaacacgatcaccttgggctggaactagccaatgtctcatactcccagagaccaaatacagcacaacactcaatcctagagctcatttttttttaagtgtgttttccaactctcaactttgtgaaggagctgcaattagtctatgcagtaaatgaaagcagattagagcagaagaatgtgagtagtttgataaaaagcttgccccaaagcagaggtaacaggaaaccacagttagaatgttctttcttcacaggaaaacctctgtctttggtagaatgactgcagagtttcactgataatcaaaatgcgaagattttattctgagccacaaactcagatgtctctatgggccaagcagatcatgtacctgagtgaaaaaggggtagaaaaagggaaaagca

SEQ ID NO: 7831 - DNA, 1124 bp, mus musculus
tctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtag

SEQ ID NO: 7832 - DNA, 243 bp, mus musculus
tgtttaaatatgactttgttcctgagagatgaagccactctcagtgttccaacaagttctacatgatagctagatttgggactgtggtgagttcaccttgcatgttctgtctgagccactgtctggcttgcattaggtgatatttgatctgattttattcacctgtgatctatgtcaaagcacaggacactgctagaaaaaaattgagtggccaggcaagtttgtcttctatacttctaacat

SEQ ID NO: 7833 - DNA, 552 bp, mus musculus
tttaaggtaccagattaaaaaatacatgtgtaaatgaaggtaataattgaacaatattatctcagaagccttcttactgtatgaaccagactcgtactgcagtttaatgaataacattactgctagtttgtacctacttcataagttgctgtgaggatttaatgaattaatacatctagagtactgggaacagtacttggcacatagtagaggttacaatatgttagctattgttatcatcattgttatggcaagggagttgatggataaatgggactgctatgtgtgtctccatactccttgatacaattgcctaaaattttcctggcacaatcctacccttatgcccatcccctcttcctttctaggctaatcttcctttagacgcttgactctctgtcccttttattagtgatgaccactaatatttattacacactcactatgtgctggacgctgagctaaatatataacatgcttctcgtttaatctccccaaaaacttgtaaggtaggcaccattgtttttctcgttttacatgtgaggaaattga

SEQ ID NO: 7834 - DNA, 134 bp, mus musculus
tctcaactgggacatgtcataggcatctcaaagttaatatgtccaatatttgaatttttattcttctgtaggacacttttccgtcccaggcttagtcatatccataaagggtgccagtatccccagctgcttaa

SEQ ID NO: 7835 - DNA, 440 bp, mus musculus
aggtacaggccaatgaggagggagaatggtaggggtcacccagcatagatgtgtcccactctcatttcagcattgcctcctggccagatctctagttgccctgaattcctcttaacagtacggcatagatgttggcctaacgagatgaatctgactaattactttcattttgtgggtgtacacacactaccaaactgtcacaagaaaatcaaaactacacaggattttcagactggtatccactctcccagaagttctgaatctttcaagtcagtttctgtcactaagtcttgtcagataatgtgggagaaaaaaagtgacagggaatttaaaaaatcaaagaagcagtagcccaataatagcattatgttcttcctactcagtatcgatcatatgtcattaactgttggattgctttccaccttttcacttcaaaatta

SEQ ID NO: 7836 - DNA, 765 bp, mus musculus
acacttttagaaaaagtttaccaactccttagttcagaagaaagaaggaaaaataatttcatagcatattataaaggaactactggagagatgctatctctgggaaagttgcgtatcaggagaagtttcaagaacaagtggtttcagaaagtttaccaggaacagaacgaaactgaagatgtgttctgcaaatctgagtagtaattcactggaatatagatataattggagataaaactcaactgagcagcctgtaaggaagttggtgggagagatgagggttgcccatagactgaattaaagaggaggccctggtttcaactcatgaagattgttcaacaaagacataaggcccacacagtatgattcattatgaaggttggtacaatagggaagattggtaaactatccatgctattattccaaaggaatcattccaagcaaggctgcaaattatcttcccttcacaatctgaggattatgaagtgtagaggaggcatagggacctgcttcatggatatatgcagtataaatataaaatagggtttattggggaataacatacaagcaaagaactggaggacacataaaattttcgagcccttattattccatagatagtcgtgtttaaattggacatagctaaactggacctacctatggaagggattcacatttgtagagagaaagagcagctaggaatgtgtaggtgacggtaatggaactttctgagttgaggaaatgaccttgttgaaaagatagata

SEQ ID NO: 7837 - DNA, 765 bp, mus musculus; identical to SEQ ID NO: 7836

SEQ ID NO: 7838 - DNA, 578 bp, mus musculus
tggcaccaccccatggccccatcactgctgaggggcagaatggacactcagcctgatcccaaagcccagccacattatatgcccccagtgtgagaggagagaccaacaggcatggtcaaagacaaggagaaagacggggagctgagggtgagaaggactggagtgctgtacctctgtgatagctgactgggcaagtggaggcaaatcccccccgccctcaacctcctcacccatctgcccgcccacccacccatctatccatctacccatgtacacatacattaatttacccatccactcatccatttatctatccaccatctaccctttcacccactcatctgcctatccacctatctacccatccacccaaccatctatctacccccacacccatccacccatccacatccatatactcacacacccaatcacccatccacctacccatctacccatccactcacacatctatccatccacccagccatctatctactcacacacccatccacccatctacccatctatccacttatctacctacccacccaaccacctgtccaccccaccattca

SEQ ID NO: 7839 - DNA, 9003 bp, mus musculus
agctatggggcctaccccacccagcccgggcagggctattcccagcagagcagtcagccctacggacagcagagttacagtggttatagccagtccacggacacttcaggctatggccagagcagctattcttcttatggccagagccagaacagtgagtctttctcagcgggtcacctcttcctactctttctgaatattgcttttctttttcttgttttttggagacggagtctggtcctgttgcccaggctggagtgcagtggtgctgtctcagctcactgcaacatcagcctaccgggttcaaacgattctcctgcctcagcctcctgagtagctgggattacaggtacctgctaccacgcctggctaattttgtgtttttagtagagatggggtttcaccgtgttggacaggctggtctggaactcctgacctcctgcctgccttgacctgccaaagtgctgggattacaggcgtcagccacaatgccctgaatgttgcttttcttaaacctgagcagcactgagatgttgaaactgttccatatttcttttccgtgaaacagtgtataagtcttaaaactttttgggatctgagtcctttacagggcattgtggcacacctgtagtcccagctactgaggaggctgaggcgggaggatcccttgaattcaggagtttggggctgcagtgagctatgatggtgcctgtgaacagccactgcattccagcctgggcagtgtgttgaggccccatctcaaaaacataaaaaaaaaaacaaaaaacaaaaatgtttattggtttgtgattctgtttccatttattttctttggcttttaatttttttgactcttcttattttccatcagcatgaaagagagcatattttctaaaggaagaaccagttttaggccaattctgaaatggagaaaatggttttgtttgaaaatgtatgaaatcatgtgatacataaggaggtgggatttgccccaaggtcctgaagtgtaactaagaaaggtggttgtcctgtagatactgcacgcacagctgcatattacagtgctgttaacagggatccttgggcctgggtttagagggtggtgctggagatggtgttgggattggcggggtgaaattggaactgtactaaagagttggtagaagttgaagcattaaatttaggctttgaaaggagggtaactatctttgcctatgagttgcaacatcactaacagcttctgagaggctggctttatgagtataggtattatgttttctttaacccattccttacattttctctttcctggtggcttttgtgactccctttttcttatcctggtagcaggctatggaactcagtcaactccccagggatatggctcgactggcggctatggcagtagccagagctcccaatcgtcttacgggcagcagtcctcctaccctggctatggccagcagccagctcccagcagcacctcgggaaggtacggtggtgttgatgtcggggaaggcttgaaaagaggggtgaattgatgaggaatgataaagggaccagcagtaggagcagttcagaggtgtaattggggtaggggagcctgtgttgggtacagagaatggactccactaaaagtgaaaggaaattgggggctatgctgggattgtgattgtgttttttgtttgttttccctagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtgagatgtcttcagctttgtctgcagcccattttctttttctttttttttttttttttgagacggagtcttgctctgtctctgttgctgaggctggagtgcagtggcacaatctcggctcactgcaagctccgccttccgggttcgcgccagtctcctgcctcagcctcccgagtagctgggactacaggcatccgccaccacgcccggctaattttttgtatttttagtagagacggggtttcaccatgttagccaggatggtttcgatctcctgaccttgtgatccgcccgccttggcctcccaaagtgctgggattacaggcgtgagccactgtgcctggtgtctgcagcccattttctataaggatttgtattctcctgttttagcttaaaagagggttcctgtcttgtttcctagctgtctttttactttcttttgtccttcattgcctggcacttgtcaaaccttttcaaaccttttagtgctactttacaatctttttgttttttttttttaatcattctttcttttctcacaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcatttgctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtctgagaggaccctgaaaatctacctttctaacaagtccccagtgatgctgatgcgtctggaccacactcagatggtttacagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaaggtacttgtggagaggagtgggagctttctgtcagtgttgtaggcttgtggatttcacacattagtaaaagcaagtctttaatggttgccagcagtaaaaacaagtcttagtggttgttgccagcttaatttgttgaggaaagagccttagttactgttttctaaaagagaagttctatcttaacacaaaaagtataacttatcagagtaccctaaactcttgagatttgtactctatagtaacttttagttttatctttcaatattggagtgagagacagttttctttaatggaggtttacatgtgaggtaggaagaagtaactgggaagaggggagctgaagtttgggaattataaacctcatgttctagaggaagaagatggaaagggagtactgtagcctttaaaattgatgttacctcattttgctttcttcagacaaacaagaaaacgggacagcccatgattaatttgtacacagacagggaaactggcaagctgaagggagaggcaacggtctcttttgatgacccaccttcagctaaagcagctattgactggtttgatggtatgtatgagaaggctggcagaggtggggctggggatatagggcagcaagccttaggaaacaagccatagtttgagggttcttttgagtcttccaacacttactttagctgcggtttcaggtagtctcatttttgcttatgtgtcagcagattataaaccatttgagaaaggcacgcttctcttgtattttcggattaatgtgtcttgcatttaaagtctgttgatgattttttgtttctctaggtaaagaattctccggaaatcctatcaaggtctcatttgctactcgccgggcagactttaatcggggtggtggcaatggtcgtggaggccgagggcgaggaggtgaggagctacctgctagtggtgcagaggggtaatggggagagtgcagaagatggtaaaggcttgcatggaatgggttagatttaccaaacttggagagggagcagacccatacttggtctatctgcattaggacccatgggccgtggaggctatggaggtggtggcagtggtggtggtggccgaggaggatttcccagtggaggtggtggcggtggaggacagcagcgagctggtgactggaagtgtcctaatccgtgagtgaaacttaatttttttcttagttctcttgcatgcgtgctctttgatatattggtactgaggtatgtgcgtgttttccaaagaagtaaatgtcaaggccacactgttggggtcagatttagccaaaagcttacctaggtaaggttgatgtaatgggaaaggtaatggattgggttcagtaatactgatttttgttcctgactctgagaagcaagccgttttgtctttctgaagcttcagtttcctcactgtatctctaaagtcaccgtagtttcttcctagttctaggtcttgcctattccccatcgctccagactgattgtcttcctttctccttagcacctgtgagaatatgaacttctcttggaggaatgaatgcaaccagtgtaaggcccctaaaccagatggcccaggagggggaccaggtggctctcacatgggtaagaaaggcagacctggtgctagggagctgggaccaaagaatccttaatttttcagcggggaggctcggggaacataggggaatgggaatatgatagatcttgtttcttttgtcctagggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggtaagactttaaatcagaataaaaaagtagagcagttgaacagaggccataggataacagggttttgttgagaaagtggtttcattttgagggctaggtggaaagacctgaggttgtaaccagtagtggagagggaaggaaaattaactcagggggagtgaatctgtagacccacttgagataagatactcgctgggttaggtaggaggggcagataggatatctaggcttggagaggctggtaactcaaatataatggatacttaatttttttttttttttttgcaggggtgagcacagacaggatcgcagggagaggccgtattaattagcctggctccccaggttctggaacagctttttgtcctgtacccagtgttaccctcgttattttgtaaccttc

SEQ ID NO: 7840 - DNA, 674 bp, mus musculus
agcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttatt

SEQ ID NO: 7841 - DNA, 638 bp, mus musculus
ttcaaatctgatggggaacctaacagaaactagatacctatagagtaattaaggattaaactgaaagaattccccttgggtagcagctttggaaggttttgttttccaaatgactttcttcgggtgttggtgccattgttggggcaggagggattgagtgaggagagtggctgagggtggggggaaacagctcgtctacttgcgggatggggtttagggtgaggagagagtggctgctaggagctgcttcatgagccttctgcttggagcatgtgaacctgataatgaaccttgaatttatcattgcaatgagtatttcataggaaactgtgtgagcatttcccaggcccttccttttatattgactgcgtcaccacagctgatgttacctcttttttgtttcagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatggtaagttacccttggccctcagtgttatggctctccggtgggtgctgtggtctgtg

SEQ ID NO: 7842 - DNA, 951 bp, mus musculus
tagaggggaggaaagaaataaaaaccgagcaatttctagaaaacatgatgattaaaaaaaaaccatccacgcttttggaatggacggattctttaacacctgtggatttccttattctgtgactagcaagctcccaagcccacaggtaggaagcttcagccagtgtgtgtggaaaaaacgccggttttgggatacgacggacaagtcagaagcctgcttgaaccgccgtcacccctttgcagccatccaacaccacgaacagcaaaaacatcaggttctggcaacctgtggggacaaagtgaccatcagcacggggaggtcgctgtcagagccgcgtcacagctcttacgcctcccagaatggtttttggtgtgaggattgctgcatggattgagaaggtggaatttgattggaataactggatcatctcacggatggctgaatcctaaaatgcctacaaagcgtgaaactgactcaggatttcacagaggatggtaaggctctgatttttccacttggcactcatctgggtgttatcattagcactttggtttaatgctgcagggtgaggaggatgtacccagaggccccactgacgcaccccgtccagtggcttctgacatgcagagctgcaggacgggcgtcgctgagctggccggggcaggctgggagctgagctttgcagacactgggtcctggtgaacgacgatgcttcgacatccactcttctgggcattcccagcctgtcctctgctctgtccctgccctcccctaattccaattggtgggattgggtggggctctctgggccccacactggtctgagagcctggcgtgctgctgctgggccagcccaggagcgaatggatgaagttcctctttctgagccgggatcaggcccagaactcccagctcgcagctcgggcagctgcctggtgctgaaaccagaag

SEQ ID NO: 7843 - DNA, 1758 bp, mus musculus
tccatccaggccttgtctcacatccaggggccaataataaagataaatttgaggagtaatgaataaagacccattccttctggagcaataaaatttatcgtggcttaactaatctggcaccatttatgcctgctgcctgcctttccagccatcgaatgactaattgataactaatttcctcaatttgtacttcattacttatcacagcagaaaggcttatacctaattctttgagccaaagagaccccatgaaatcaatggagatgttacttgccagggatcttggcaaattggccagcttcgtgggaaaggtggacttctcaataatacagctaacaggtactgagtgtttattgcatgcagaaactgggctaagcacgttacatttgtataaaaaatataagggttctacaagatgatgtaaaggataaagcccttaactgtattatcttaacacaatagaaatttaccaatgatttaatgttattcttaacacaatagaaatttactaatgatttaattcagatgtttctggttggcaaaggatgggggagttctgtattgcattcttcagattcattgagacctaaaattaagaaccaagttgactgagactctgccatcattactgcatagctgccaagcttgcccttggtcgatattcagccagcagagggagaaagagcatgaagagcgtggcggggaaggttttttttgttttggtttttgtgttttttttttttttttttggagatggagtgtcactctgttgccaggctggagtgcagtggtgcaatcttggttcactgcaacgcttgcctcctgggttcaagtgattctcctgcctcagcctcccgagtagctggggctacatgcccatgccaccacacccagctaatttttgtatttttagtagagacggggtttcaccattttggccgggatggtctcgatctcttgaccttgtgatctgccctcctcagcctccaaaagtgctgggattacaggcatgagtcaccacacccagccgggtgggaagcttttaataggccagcctagaagaacacatcatttcaactgatagggtgttggttataactcagccacagagagaccaggaaatgtggtgtagacgtgacccaggaggaaatgagttttgttggacagattgccacatgcttgtgattttatttaattcttacaacagtgctatgaagttggtcctcatccccacttcacagatgtggaaagtgaggcttgaaaaggttaagtagacttgctagtaagtggaggagcagattcttcagcttgtcatctgtctgatttctgggctcatgcttctactactgtgctagactacttctcttgggtctcaagcaatgagaagctctgacaataaatctttccccttcactactctcgctggtcatcaccactgtagctgaccctgactcactgtgaagttctgtactggtcagccatcacctctgcctgtggcactgagcttcccagaaaaacatctctggaacttgcagcaacctggggttggaagcctgacgggacccaagttgggtgatacagaattctgaggctgaccacccatatgtgtgggggcacagagcaaatgttaaattgagccaggaaagactccactaattagcgtttcttctgaactctgccatccattggctttttaacaaatgatgctattaatcctacatgttctcgattcttcactttcttcatggggggaaaaag

SEQ ID NO: 7844 - DNA, 2620 bp, mus musculus
gacaaacattcatgttatatttgtaagagaatcatgattttactgtttttaaacattgcaacctcaaaactcaaaattttactatttttaaacattgcaacctcaaaactcagcaacacaaacaaaatgggcttcatggaggttacagcttgaatacacacattaaccacattatctcatgcaactacacatgggcaggctctttgggagtcccgagaatctataccagggggaactgatattgtctatttgatcactgcagactcccctgtgaaagtgacatctgagttgaccaagcatggggtttataaggtatgtagcatgtgtaggaggagagaggaatttaggagcaagtcagcttgtcacagaagctgcccgaaatcatttcttccaggaggagatttgtggtcctgcgaagggtgggctttggacaatacttcagagaagctggaagatttggcagctgccattgtctgtgctttgtgataagagagtctgccagtgagtgatcttcagatgggctgaggccagaggtttggggagatgagagctgagaacctgggggttggctgtcgctcacctccctttcctgggatgagtgttccaagcacttgctttgatgatcaaacagtctcctttttgaaacacattcactctaggctttgacgacaacactgcatttcaaaaagtggtggcatcattaggaaagaaggatcctggctttgtgaccagcataggacatgacacctatttccaccaaatttcattgtgtttttttttttttttaatttttattttttttattgatcattcttgggtgtttctcgcagagggggatttgacagggtcataggacaatagtggagggaaggtcggcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttatcttagtacagaacaaaatgaaaagtctcccatgtctacttctttctacacagacacggcaaccatccgatttctcaatcttttcctcacctttcccccctttctattccacaaaaccgccattgtcatcccggcccgttctcaatgagctgttgggtacacctcccagacggggtggtggccgggcagaggggctcctcacttcccagtaggggcggccgggcagaggcgccccaaatttcattgttatttaataaggatcatgtcatagttttctgaccacttttattctggaagctggctacaggagatttttttgtgagcagacctctctacctgggatgctctttctcagagcatctctcttccctgtacttcatttacttttctaccccaggttcatttcctctgaatggcctttccagattgccccatctaaaatgcatctttccctcaatctctaccattatatcctgctgcagcatagcgtgaaacagaaattacgggagatcttttggactgagctcctgcactaggccccagtagacgggaccaaaccaagtggagtcgcgcatgctaaatgctatatcgtcaaactaaaacttaaaggaagcagatagatccccaaacaggccagtttttcctgaaaacaggaggttccagtctacttgagtcagcataataagaaagtctgctctgctttcactcttacagaaaagttaacttgaagtaactcgatgttaaacaatcaggttttctttccccctattgctctgtttccttgcttccacgtaaaaaaaacaaaaaaaaaaacaaaaaaaaaacaaaaaaaaaacactcttctgctacttctgctattgcccagtggggccattcattctcttttgtagaatggaggctgcctgattcataaataattaataaaggtcagtgatatggtttggctctctgtccccacgcagatctcaccttgaatggtaataatctccatgtatcctgggggggacctggtgagatgtaattgaatcatgggggcaagtttttcctgtgctgttctcttgatagtgaataagtctcacaagatcaggtgattttataatggggagttcccctgcagaaattccctcttgcctgccaccatgtagggcatggctttgctcctccttgccttctgccatgattgtgaggcctccccagccatgtggaactgtgagtgaattaaacctctttcctttataaattatgcagtcttgggtatgtctttattagcggcatgagaacagactaatacagtcagttaaatctataattaaattgcctgtaattttgtcttttgataataagctggcggctctcctccactagccattctcccctcttccacagaaaattttagcttagaccaaggggatgatgggggaaagtgaaacaccaattaaaatgcctctttatatccgatttaaaagaaaaataaagaaa

SEQ ID NO: 7845 - DNA, 3145 bp, mus musculus
cagtgcactcagagaaattaatcattccatcttggtccagcacagtctggctttcatgtccatcatttcagtagaagcactcccaccaagccaccaatgccttccttgttgaaaagagcatgggtactgtcattctccttctttttaaaaaaaaaaaatattttagtagtttttggggaacaggtggtttttggttatatggaaaagttctttagtggtgatttctgagattttggttcacctctcacccaagcagtgtacacgatatccagtgtgtagtcttttattccccaccctactccctgccttccccctgagtccccaaagtccatcgtatcattcttatgcctttgcatcctcatagtttagctctcacttatgagaacgtatgatacttgattttccattcctgaattgcttcacttagaataacaatctccaacttcatccaaggtactgcaagtgtcaatatttcgtttatttttatggttgagtagtattccatggtgtatatataccgcattttttttatccattcattggttgatgtgcatttaggttggttccatatttttgcaattgcaaatcgtgctgctataaacatgcgtgtgcaagtgtcttttttcatatgacttattttcttttgggtagatacccagtagtgggattgctggattaaatggtagtccttcctctttgcagaattttccagatttgaccattctttccttcctgaagaactccccatcatcttgacttctgtatagcagtaaattagagtggttgaggccatttgatatggagtcagaaagtctgagagcaacgccttgcacccctcctactgagtgtgcaatcctgagcaaattactccagcagtgtaagcctcagtttctccaactgtaaggagaagacaggagttacacccacttcaaataatataaaaataatctttgcaagtctcattgcatagtgaccagcacaaagagcattccgtgaaagcgccattatcagcacattctcctggtgtttgactgacaggcttatgtttctcagcctgttttcctggcttccactcttctgctctttacttaaaaactgtttcttggctaggtgtggtgacttttgcctgtaatcttagcactttgagaggcggaggtgggaggattgcttgagaacaggagttcgagaccagcctaggcaacatagagaggcctcatctctactaaaaatcacaaaaattagccaggtgtggtggcatgcacctgtggtgccagctactcaggaggctaaggtgggaggattgcttgagcctgggaggtcaaggctgcagtaagccataattgtgccactgcactccagcctgggtgacagagcaagaccttgtctcagaaacacaaaagactgtgtttctccagggctctttcacataccctctttcgttttcgagctatgcattctgactaggaagactccatagcctcaggtattatttttgagctggagagtttcctccttttgtacctccagtctcaatttttcttttgagtgccacactcaaatgatgccgtatctcctctgggatatctcccagggaactcagactcactctgcctcacgttgagtgcacagccttctcctgaaacccaaacttcatttggcatccactatctcatgatccattaggtgctcaagccagagtcttcctcaccttcccagccagttattcattgtgtcctgctgttttaaactatccacttcgtctgtttccactgcatccccatccttctggttgagatgtctccaatagcctcctaattggtctccctgctgccatgtttgctcacccccacttcatcacccagcgggagtgatgctttcacagtgttggtcagaccatgcaactcccctgcctaaatcactgcaataaattccccttattccgagaataaaatctcaattccttcctttggcgcagtggatgttgtggtgtgctgccctgaccttcctacaagactaagacatttatttccccagtgcctgggagtgtaggtgaagccgtccctgtgaactttatagaattaatcagggaagaaagaaagggagaaacatagtagatgaagtttgcagcacactcagctttaatcatgaggttagtttgccctctgacctgcttcctcatagtttggtgcttattgtcctggaatcatgtagaccctgttacaagattatagctctccttaactactctgcaggtaacaacttgaacattataaaatgttatgttttccctttgagatattctttcaggtcctacataccagtgaaactactgttttcagctggtctggaggaacccatgagaagctgattcaccaaggaatgcagttgccatgtcctgatgatttccttctatttgccccaaccaatcaatgaccccaaatttccagcccctcagcctccataatccccttaaaacctccagcccagaattccttggggagatggatttgagagtctccttccatctcctttcttggcaccctgtgatcattgaactctttctctgctgcaaaccctggtgtctcagtgcgttggtctgttactatgcagcaggcatatataccttttggtccattgactgctgataactcatagctgactgcctccctagaaagagtgttgccccatccaaggtcatgtctcttcattctgtgcaacaactggtcagagttgaggcacacaagactgcctcccttgcttccatttggaacatctttgagggtccaccccagttccagtgcccccacataagaccacctgcagcttctattgtcactgcagttttccctacttcctccctttgtccagcttgcttccttcccatccttatatctgttgttctcaaaaccactccccaacaaaatccctgcatgtgaatctctgctcagaatcttttcccctgggagcctgactcacaacataagtcttacaaggttctccatgacctggctccagctcaatgcccagtacaaagtggatgctcagtgagtaccttggattgattggctcattggctggttgcttggttggttggggtaaaatgcatagaacatgagaattcaggtgaagaatatctctttcacgt

SEQ ID NO: 7846 - DNA, 746 bp, mus musculus
aattactttggagagggaatgagagcaaattttatttaattgtgatttctttggtttgataccaaacctcaggttttcagtattatgaatgctattgatgagtttgtttttatcatgccttgtctctttcactgcagcaagggatacgtagctacaagacacctaactttataagactttctaaaagtaacccaaagaaaaatgttcaatgttagaggaacatgttcttcaaaaactagaaaatactaggctaacttaaagttaggacagtatttcattcacacagtgccacatttcatcttggtacactgtagcaccttacctgatcttgaagatgattgtctgagcaaaccacttgagttgtcctggactttcctcttcatgagagagagggtctggagagcatctagaggcacttcacacgtgcgttagcagacagggacacttggagcatctacaggtagtaagctctctacctggatggaggaaatgtggagggaaccttttgcccagagaagcagggcagatggactgtagagtccccgtgtaaatgaggcctctctctgaactgcaagaaggagttgaagaagaggtagatgtatttttcaccacctacagtaccttgcagttttgtaaaacttacacaagtaacacagccagccttttcaaggcgttggtaggtttgtgttttatccaaagtggttttagactcagattttattaatgggttatgtaggagggggaaa

SEQ ID NO: 7847 - DNA, 456 bp, mus musculus
atatccacattctcatttgcggtgattaaagaaccactctgctgaagtttctcatgacttgcctgacctcgttagtttctttgataccaaagacaggtgtcttcctttcccccttgcctactgtctcctttacacatgtggtgacattcaggtgaatttgaatggcttttggctaggcaagccagtatcagtaaacacactggcttggacatttggcccataactttttatacccgaggccaggtgttggccgatgtgggaagagggctggaaagaggcagaatggtatttgtgtgagtgccagacccctgtggactgttttgctgagatgctgtcttatggagtttgtagaggtgaatcaacaactgtctttgtgaaaggcaaatgtcaccttcaggttttaattctgagtggccagcagcccttacattgccactgtatatcatcagagccact

SEQ ID NO: 7848 - DNA, 2185 bp, mus musculus
tcatctcagacagtgtctgaacttaacaacaagactttttgtaggaagacaccttaatttcaaggtgtgcctctgacagcaggaatatcaacccatgtggtatgtcagtggaggagatatttttagaccaagccctgctattcacttgtagtgcagtggcactaacaccagcttaagatgacacccgtttgttatgtcacagttctggaggtcagaagcccatggatagcatgtggctcagctgtgtcctctgttagagtctcacaaggataagatcaatctgttggcaggaccagctctgggggtgaattaagttgttggctgaattcagttcttcgtggttgtaggactgaggtgactcttttctgctgggggctggtctttgatcgtagaggcagcctgcattctttcttatgcttcccatgtggctcgctcctacagcagcaggacaaatccctctcatgctttgaatctctatgacttcttattttaaaaaatatatttccataagtttttggggaacaggtggtgtttggttacatgagtaagttctttagtggtgatttgtgagattttggtgtgcccatcaaccaagcagtatacactgcacccaatttgtagtgttttatccctcatccccttcccaccctttccctctgagtccccaaagtccattgtatcattctcatgcttttgcatcctcatagcttagctcccacttataagtgagaacatacaatgtttggttttccattcctgagttactttacctggaataatagtctccaatcccatccaggttgctgcaaatgccgttaattcattcctttttatagctgagtagtattccatcgtatataccacagtttctttatccactcattgattgatgggtatttgggctggttccatatttttgcagttgcgaatcgtgctgctatagacatgtgtgtgcaagtatctttttcgtataatgacttatttcccgccgggtagatacccagtagtgggactgctggatcaaatggtagattccttaaagaactaaaagtagaactctctgacttcttctgccacatacctctgactccagccagagaaagttctctgcctttaagggctcctaggattatgttgggcccaccaaaaaaaatccaggataatctccctattttaaaggctatacttttaatcacacctgcaaaatctcttttgccatgtaacatcacttacaggttccagaggctagtagagtctacatgtgtttggagagccagtctgcctaccacactagagaaggaggtggaataacaggatttttaccctggctccaacacttactgtaattgtgagcaaatccctgagttctaattcctatctctgcagaggagataggagccaggacttaacaactctatcataatcccatttgagagtttcagcttaaataaaattgtatatgcaaaaagcatttctttttttttgagacagtcttgctctgtcaccaggctagagtacagtggcgcgatctccactcactgcaacttccgcctcctgggttcaagtgattctcctgcctcagcctcctgagcagctgggactacaggcgtatgccaccacacccagctaatttttgtatttttagtaaagacagggtttcaccatgttggccaggatgatcaagatggtctcaatctcttgaccttgtgatccacccaaagtgctgggattacaggcatgagccaccatgcccggccataaaaaacatttcgtcagttcagcacatacatagaagtcattgctaatactgttctttttttttttttttttttttgagacaaggtctcactctgttgcccagactgaagtgcagtggcctcagcctcccgagtggctgggattacaggcgcctgcaaccacgcctggctactttttgtatttttagtagaagtgaggtttcgccatgttgaccaggctggtctcaaactcccgacctcaagtgaccaccggcctcggcctcccaaagtgctgagattataggcgtgagccactgtgcccagcctaatgctgttcttataccacatggtgctatctctattttttaattttatatttttatttgctcttatgttgtgtggtttcccctctgccaccctcagtaattctctagtgaaagggagcagct

SEQ ID NO: 7849 - DNA, 565 bp, mus musculus
aagggccatgcagtggccaccttcacagtcacaccacagaagatccagaacctctggcatctgcctccgtgcggggcattaggtagagagccacttttctgcaggcaatggaggctgagacctttcttctttactagcccaggggtattgatggccctgcagagacgggttttgattacctctcactggatcccccagcagcctgttaccagaaagaagggcagacgcagggagcctgggtctgtgctcagtccccgctgggttttctccttttatggtcagcctacagtgctctggcttcccagacagaatccaccagcttgtgtttgggcttgggccgaaatagctggtctgtggggagctgggtacctcctgggagtcctcaggcccacagcgggggaggaaccgctgaagccctttatcttctcaggaaacgtgcctggggccttacacatccgaggctgggtggggagtctggggaggaggaagggagagaggcatgtttaaggatggggtgtgaggtgacatgagccccagggatctgggctgggaagctcagccccag

SEQ ID NO: 7850 - DNA, 437 bp, mus musculus
taatctttcttaccttggtgggttctaaatattctttctttcccacgtgtttttacctctttccactaaataaactctttgccagttagaaccactttgttatgtcttcccacagtacactgtgttttcatgacttggcatttctgattcttttaaaaccattaatctttctccacagttataaaacatgctaaataataatggaatttgattgttgaattcagcttttgtgactctctactcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcaggtaaagaataagttatacctattaatcacagatgg

SEQ ID NO: 7851 - DNA, 437 bp, mus musculus; identical to SEQ ID NO: 7850

SEQ ID NO: 7852 - DNA, 1791 bp, mus musculus
cctttgatctggaagtgacttcagaagacaccttgttcacagtccttgaagacatagtctggccggcagaattcccaactcatgttgtccatagcagatatcaccaatagatgactgcattttccctccatggagccctcacagagctcatcacatggtgctcaggaagtcaaaccaaaggatcagaatcagtcagcagaggagatgagttctctatgccatctcacatttatccccaaagcccagggaggctgtgtaatttgttcaaggtgacacagcaagtatgtggcagagcaggggctcgaattcaggcctctgatctttaaggcctgtgtttccccctccacatcagtgtttcaggaggtggaagacttgaagcactgggaagctgtcttgcattgcattaaacaacattgccacatagggaggaaatcatgcttcccttttcaactctccattagtacttctaaatacctcaagaaggaagtgtcaatttaaccctgtataatacattttatattctctctctctctcttttttttcaagaggccaggggttcagatattgttggcggacaaatctagctaggattcaacaatattgttttatttttattttgcggctcctatttaatgcttgcttatggcaagtctgccggctttccatttttggaaacttccattttaaattttctatttttaaatgcatttactttggtagtgcaagagtgatctaattttaaggaaatatcttaaagaggaccacacatgatacacacaaggggatggcaaagttgtgtgcatcctgcgcggacgcccgagatgtgggaaatccggggaggggccccgtgtgagggtgctgcccctttgcctcctgcaggagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggtgagcagagccgccctctgccccgcgtcccagccccactctccttccttgtcctccctgtcaggcctggggtggggaggttcttaagattcagagcgaggtctctgacagtcactggggattctgccctcagtgaaaaacccaaagtccctatcaagcttccctaccaagcttcagaattagtgattctcaactatggctgcccttgggtggggggcattaaacatcttccagttctcccacccctacccagaacgcataacatcagaaactcaggactaatttcattttagccgctcctttgcaaactccctcctcactatccaataataatgaactattattattattattattttgactcagagtctcgccctgtcgcccaggctggagtgcagtgccgcgatctcggctcactgcaacctccacctcccaggctcaagcgatcctcccacctcagcctcccagtagctaggatcataggtgtgtgccaccacacctggttaatttttgtatttttagtagagatggggcttcaccatgttggccaagctggtcttgaactcctgacctcaggtcatctgcctacctcagcctcccaaagtgttgggattacaggcgcgagccaccaagcctggcctgtccaatattaattaattcaacccatgtttactgggcacctactatgttccaagtctgcagtaggggctgggaat

SEQ ID NO: 7853 - DNA, 1309 bp, mus musculus
tcttctatgtatgttttttaaactgtgggtcatcactcattagaagttcatgaagtcaatataataggtcaagaataccatgaagaaagcagaacagaaaatatcacagtgcatcactctcaggaagggtagatattgtttcacgaaactttttttttttttgagacagggtctttgtctgtcgcacaggctggagtgcagtggtacaatcatagctgactgtatcctcaacctcccaggcccaagagatcctcccacctcattctcatgagtagctgggacttgaggcacatgccatcatgcctggctaatttctaaaactttttgtagagatagggtctccctatgttgctcgggctggtctcaaactcctgagctcaaacagtcctcctaccttggcttcccaaagtactgggattataggcatgagccactactcctggcctcatacaatttttatttgatataaacatatatagccatgagtgaactgggtcaaaatgtaaaatgtgtctcttactgcaggtaactgtcaatgtagttcgaatatcactgtgaaatatatagagaagaggctctgggggctcatgaacttggcccatggactgttgaggctttttttttaatctttagagatgatataaatgtagtgctttgaattctttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccc

SEQ ID NO: 7854 - DNA, 316 bp, mus musculus
agggaaagaggagtaaatgttcagatgatgctaatttgtgcctctcgccgccggcaccagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaaggtagctctggatggctcccactatgccagaaccaagtgctgccccttgaggactgggataggatgggaggggagggtgttggaggga

SEQ ID NO: 7855 - DNA, 316 bp, mus musculus; identical to SEQ ID NO: 7854

SEQ ID NO: 7856 - DNA, 1019 bp, mus musculus
tgatgctctgaacagggaaagtttagagtgagggttgacatttcacatttagcatggtgtttaacaacttttcacaagccatctctgactttcaggaagtgaaatgaaaatggcagaatttatctgaagatccacaatctagaaatggaaccactgctcttttgacaggtgccatctcagtggcatcactggaaagtccagattgcctgacacactggtaaccaatgactaggggtcaggtcccaacagatgtctgggcttaagggagttaagtctatgctgaaagatggaaagggagaagaggacataaaaacaaatttgtctttctataccacaaggcttttgtgccaaggtggccatgtgtgtcaaagtcagggaatccctcctcctgggagccaagaggaagtctctcaaaactagaagggaaaggtgttttctccacatcaatccagctttggagacattctattagtgacatatgccccttcccccaaaaacaacaatgaagtgttctgtgtgctaacaacatagctttaaaaaaaaaaaaaagtaaaacaaaattccacatttttataaaacttgataaaaaatagtattccaaactgtacagtcaccagaagtacacagttatcaaaaatgcacacacttcacttggcatctccagcaccttcagctttctgtgcctggtctgttttggcatctccattttctgcagggttattcccctccttgccagcatcagcttttccctttttccctttgggtaccttctctcccttctttgcaggggcctttttagtcttgggctctggctttggaggagcaggtttagcagacaacctcgcggatcttctctgtggttcgtccttcaccttggctttatctcccttagcatccccttcagcctttctcttgggcatggtggtggcggcgacggcagcaggacgtaggtgctggacgcgggatgcagtggcgcgcgggctttggtcggtctgggggtcgttctcgcctcttcttca

SEQ ID NO: 7857 - DNA, 716 bp, mus musculus
ggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaa

SEQ ID NO: 7858 - DNA, 509 bp, mus musculus
taacatgtgtttcaatagaagaatcttaactaaaagcagaaagttggctaaattcaaagtgcttgacttcaaaatattctagagtgattagctactagattctgaatcagacatcacatctgactagagaccagtttctttcgaatgattcttttacatatacagatctattcttctgaggcagcggttggccaactatggcccgaaggccaaatttggacttgttcttataaatgcagattgtctatggctgctttcccactacaccagccaaaggtaaacagctgcaatagaaaccaaatgagattcacaaagcccaaaatgtttattatctggccctttacacaaaatcacacaaaaagtttcctgatctctgttctaagaaaaggaatgtgccttgcatttaaaggaaaatgttggtttctagggaagggaggaggctaaataattgataaggaattttcctcttttgtccttttttttctttctcattgaagaatctgatactg

SEQ ID NO: 7859 - DNA, 520 bp, mus musculus
ggctatctgcatttttatcgagccttccccagggaatatgaggatgaggaaggtctggaaacactgggttatgttaacctgcccccagagaaactgatgttggatggaaggaagaaatacaattcagtgaacgctgagagtgggaacagcttcacatacagatcagactcaggcatggcaccaggaacctcaggttgaacaaactccttgcatgactatgaagttcaagaagttgtgagaatcatcaattttggaaacatctgccacaagagagaaaatctcagcccaactctggctggtcacgttcctaaaattccccgaaatgttgagtaagccgtaagttaggggagagaatgcaccagcaagtccacagtcctctttgtgcaggtttggtgctggctgttgcaaggcggtgtcttttgcttcctcttgggccctcctaaggcctagaacttacagtacaaattacccaagactgggtgagggagacaatttacccctcatgctttcactgcccaca

SEQ ID NO: 7860 - DNA, 308 bp, mus musculus
agaagagctactcatctgttgtgtccctagggggaagcactgagctggcagtggaaggaggtgtccaccaggcctatcacctcacaaacgggacttgacaggagctgaaggagggacccaggaaggatttcctgccaggagttggaagaagtggaggcagcttgcccacaatgggggggattcctgccttgaaatgaggaatgctcactgctggctgaaggatccagcatctccaagcctggaaaaaggaagaaaacaaacggttagcagaagtctgcagtccaagccagcaagccacacaaagaaca

SEQ ID NO: 7861 - DNA, 729 bp, mus musculus
tgccagtgagagtatcacagctgccaggaccaatgattggttcagaggtgggcctgtgactggaatctggttaatgagaatatcatagcccctggcttggtgattggtacagaggtgggcagggactgaggcttggctttggtgggacctttccatgaaaagcttgctgagccagtggtatgtcagtctggtgcttttggggcttgagaggaggccctgcctgagaataaagctaatggtggagaaagcagagccaagagctagtggcctggtgacagtaattgagtctctggatccagctgagcctgaagttcatcaacctcttacacttttcaatccaagggttgaataaattccccctctgagttttgtgtactttgaactggatttctagcccttgcaactgaaagaacataggctgacttgtgtgtgcatggacacacacacacacacacacacacacacacacacacacacacacttcattcagtgcctactgaggagtccctctgcttagggaactgagcactgcctgttcccagagcatacagaggtgaccaggacagttcctgacctcaggagtcccaggaatggggcaacaagtccgacttcttgctcagatacttttaagtgtggcgggcccattctcaccagggccagctacgtcatttgtagggctgagtgcaaaatgaacacgtggggtcctttgttcaaaattattaagaattt

SEQ ID NO: 7862 - DNA, 629 bp, mus musculus
tttctcagctgaaatatagagctaatatcactacctgctgcttaaggttattaaataacaggcacatagtagtcctctatgaatagaagttgttattgttgttagtctgccattcaagttccttctggatctgactccagatccaaacaccacttttcaaggttgcaagacaacaggcttgtgtggcagatattcctgcaccgagttgcattctcactggtcacattctcttccccgccgatccagcattctctcccacctctgcctctcagtcacacagtacttcagctaaacacagggcccgctaaagtgccctctaccaagccacacatctgcatatcctcattctctcaaacccaccttaagcaccacttcctctgtgacaccacccaagagagccaggcaagaagtcctctctcctcctgggaactgccacagcacccactccactgtattccctcatattctgcagccctcatcacttttaacccattgtcaaagcaaggtgcactgtcctctccctgaacaattctcgtctttgttcatctttctctcccacctgcacacactgggctcagtgcaagcttgcggtcttgtttatacctgcggtaagttttgacaagacaaag

SEQ ID NO: 7863 - DNA, 1010 bp, mus musculus
gggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaa

SEQ ID NO: 7864 - DNA, 917 bp, mus musculus
ttttttttttttttcaaagcaacctaatttaagtgtaaaaatcaacttttctctaaacaatgcgtcaacaacctgagagctgtgaatgatggtgctaaagctgggcaacatgtgaggaaaagcttttatcaaaagcccagggggaagctggctccatgcttgcagaggacattcctgaactggatggttcacccaccatgctatgccttacattcttccagatcttcattgtcccatctgcagtccctgaacaggagccacgtgccttcagccagtgtcacagactctggctcattgtgcctgaccccgtgctccccagcttccattcttcctccttctagtaatggggctgccagttccctctggcaatttcccattcttggttcacgtgtgttttgggagacgttgattctcaggtggggatttgacgcacgcctggccaatcagagcttgtggtctcagctgtccttgcagggaggggcgaatgatgcaattcaggctaataagagtcaagaatctttgacctaaactgtctttgacccaaactatcagggacaagagccctcccttccactatgccagtatggtgaatgtggaggtctggagcatggaggtctggaggtctgattatcttgccaccctaggatccaacagacagaagcaaagtggagacaatgggactgagtcctgaggacagtattgggccccagatcaagccatgtctgaggcccatggtggactttttagtgatgtgggtcaatcaactccctattttggcaaaagcccttttgagttgttttctgctgttatcgtggaaggagtcacgattaacacaatctattccaaatgttagatctctgccttgaacagatgaattgtggatatccaaatccagccagggttccaggcttcacagc

SEQ ID NO: 7865 - DNA, 1094 bp, mus musculus
gaggaattctgtatcgaacatgttcttgcgtagatcgacagtaatgtacaagtctattgatgataacattgatggaagaaatattaacatgtgtttccaggtacattgtatacctcacttaatgggatttttacaatattcctgtagggtggcttagactattgtagtgggttgaatggtggacccccaaaatatacccatattctaagccctggaacctgtgaatatcaccttatatggcattaagtgtgaaccttatttaatttggaaaaaagggtcttcatagggctaacgaacttacagatcttcagatgaggaaattaccctgcactgattcaacccaggcagaagggaagaagacatagacaagaaggacatacgaagaaagaggacaaaattggagttctgtagccgcaatccaaggaacatctgcagtcaccaggagctaacatcagagccactagaagctggaagaggcaagaaggattctcctccagagccattggagggaatgaggctctgttgagattttggttttaaacttctggcctccagaactgcaaaaaaatagatttcaatcgttttaagctaccaactttctatcaattggttagggcagccacaagaaactaatgcaagtaacaattccattcaacagataagaaaactggcagttggagaggtaaaattaatcacccgaagtcatgaagttagagagaggcaaagctggggctgaaacctgggcctgtcagaatccaaagaccttgttcttagccatattgccggtaaatacgtaccatgttggtcattcatttctgtttctctgcctaatatggttaaggcttacataatcatataagttgttggtttacctaaaagctattgagggcttgttctgtgactttagactctgaacagcaaaatttcaggaaaaagagtacttttgttatctattgctatgtaacaaactaccccacaatgtagtggcttgaagaaactgttttggtttgcctcactattttatggctcgggaatttaggagacaattgattgagcagtttttctgcctaataggggcactgacctggattcac

SEQ ID NO: 7866 - DNA, 948 bp, mus musculus
cactaaaacagtaataaagcaaggattgaatgaagtcagtgcgacctacatttcatgtgacctgtatattttgggatacttgtgtcccaactaattggaatttaaggtctgtcaaaacattgcattatttcagcacaacccccactgctgtctgccagtcacttcagcaaacatccttctggttctctttcccagtgtttcctcctgctgctctggtactcacaggaggctttaatggacactaaatcctccctgccctatagtcactaaatcaggctcttaatagcatcctattaattgtataaaataaggatttgaagcaaaccagaaaggttttttttttttgcattttaattaaattcacattggtttgaaaaatcagatttattgagaccttaacaaccacacaacacacataactgggttgttaagtctcaataaatatttttgagaaatcaattgacttttgattaacaacaatatctgttttaataaatctcagtgaaataagatgttgagtatagatagacagacattttaattaagctgggcttctttactcttacccctaaatgccttgacccagaattgcttatctcagacttttttatttgggaaaagaaaaaatatatcttttcatctgttttaccaaaatgggtgaataaagacaatgtcgtttctgaaactgcatggagactgaatagaagcttcttatgactttagcttctcagaatctgcaccttctcaaagaagccttccatgaccaccctgtataagatgttttatctttccaaaccatgtgtgttttcttcacatactttacgtaattttaaatcatgtcatttaattatgcacttacttgttggctaccagacattgcttccaattgtaaattccctaacaacagcaagcataactgatgtgtccatctttgtattcctaaaacaa

SEQ ID NO: 7867 - DNA, 307 bp, mus musculus
tgatgagtggatatttatatatttaaattaagattgttctttaatttttgaatactcattttgatcctcagcctaccatgtttttagttttgctaatcatatcagtcagggttcctgcaggaaatgaatagaacaacaaggatgttttaattaatgagaatttaatgaaaggctgtttgcaaaggtatgagccaatttaaggaaaccaacaatggatacatctaacttgtggcagcagcaggatgcttttctcatccttagacctaaagggaaaaggaaataaaataaagttatagagctaggcaag

SEQ ID NO: 7868 - DNA, 821 bp, mus musculus
tcttcccctctcttgagagagccacttcttggttaatagaaaggctataacttataagctttgttcattagacactaaagccccaatttgattaaagttctaatttaattataaactactctagatatgactgggatttcaaggagtgaaataaagtgactactctttatactctggcttgctggaaatttcacaatcttatcctcaaaaattattgaaattctggtggtcaactcctccttctgtgtacaacacaacgcagacattttttgataagtatttgatggtgtcaaaagtctgcatttgaaccacagcaagaatacagttgccataacagagaaaggggaatgcataaaaacaatactgtaaagataaaaactatcaaaaatatccccagaagcatggctaccctcttggtgtccgttggttaattacattctaacttgttcctcagctatctaataatctatggatttgataaatcatcactaatgatttagaaattaatatgccatttatgggcaaaatgtgtctcaaaaagtttcgtctttagtcattgagagcttaaccccactattgacattatttccaatatcttctttcaaattcccatcaattttattttaagcttactaagttgctgtatttccatgatatattcaattcacatcttcttatttttataaaattccactgctcctcttattacctattcaattataaattctcttattctgcattccccaattgactataatttagtgctcatagcttctacccttctacttgtagaaagctcaagaattatttattgtgcccca

SEQ ID NO: 7869 - DNA, 152 bp, mus musculus
ctagccacagtcctactctatcagagaccaaccaatgtcttctcatttggttaaacctaccagccctaaagtaccacagagtaatgcttgttatgtttctatgtcatgggaggaggagaggatgggaggggaaaaaatcaagtaattacata

SEQ ID NO: 7870 - DNA, 1762 bp, mus musculus
gaaatattattgaattcatgtttctggtctcataacagagttgaaacagagctaaattatcagtagattgaccattcatttacagatgataacactgaagttcataaagtaaaataatttgcctgaagtcacttggctcatatattagtcattacttaaacttcatgctggtattgtgtttttgtttgtgtgtttgactgtgggtaattatgtctgtatgcccactacatataattattctttgtattttcaattcatgccaatttctagaaaaatattctcttgaattgatctgatgtttaagatgtacaaaattattcttagatggaattgaagattttatttaaaaaggccatattctgaaccaaaattgtggattgcacagtcttcccattggcgtgaggctttacaggaattatctcaatctttgctcccaataactctaccaaccacagaaagttagttttaacctcttttttttttttttttttttatctttgttgctaataaggaaactatggcttagagagtttaagtaagttacccaaagctacagttctggcatgcagtacagacagtttgaaacgctgacctctgttttaaaccatagatcttccacatagtaaaaccaattatagtataatcatcagttattatcctatagtataaccaattactgattatagtaaccaataggaacaacacagtgtggaggcgccataattaaggaggctgtgggattgtacatgaaagtcaaattgaccaagcctgggatcccaggcaggcttgctagaggagagggtgcccaagcaaccaaaagaagaattttttttgctttgttttgtttttggagggaggtgtgtgcaaggatatagagaagcaagtgaaaaaaagtgaatttcaggaatttaaaactaatccttatggtaagagtaaagtttgtgggaaattcatagaagtgtagcaaaaaatgaaatgaaaggcaggtagaggccagactatgaagagctgtgtgattcttattttattccaaagtctatgaaagttattgaataactttatacaggtatgttgcctcttcctgtgttttaggaagatcatactagcagcagcgtagaaggtagaatgggggcataaggatgaacataatcattataaataatcaccacacagcagggcttgtcagctctgcttgtggggaatgaggtggagaactgctgaaagtcctaagttcagatcagcttgtagaatccctgagccacagggtgtcctggtatcttgagaaaatcatttcagccagaactgtggtgccatcgtccatttattttacattttttagacattcccaggagactgtcttaacacgagggaaatctgactcaacgcaaaatataccgtcaatttatttttcacttgggtttataagaaattgggttagttatcaacatgccatgtattgcaatttgaatttgaacaataaatagattttcttttaatgttacttatctctgcaatggaatgtatcaaatttcaaataaataatattttgttgcagtttctctctttggcagtgttgtggtctatatatttttcgtcactataattagtctttcatcttaaacagagtgataattcattgcatgacattcagtcagaagttttgttgttgttgataaggcaaagcttatcattaggaaaaaggaggaaaagtctaatttgctagaagagaacagagtataaaaataatattatccattcagtt

SEQ ID NO: 7871 - DNA, 647 bp, mus musculus
tttaaggtctctctagattgagagaagagaggtgctaaattacaagagaaacaactcactttccaggcctctgaccttcctccttctacctccctcacgttctaacctgtttctctaatacctgaagctccaattttaccatatgctcaaataaacaccacacaatctttgaattttcaatctatgtatgatccaaaataacataacaagcatatacaatatttaagatgaaatttccaattttacaccagattgagaggaaatttactgatacctagttggatgtggctaagcagagctcgtgaagatttcttgattatccagtttttttcaatcgatgcagacggccaaatcaaagtttcaggccaaataaaatttatcttgaagcctcattgcttcactgaaattaacaggattaaccagataattggcaaaactttgtttccgttcgtgggatgtgaaatggattcaggtgacactgctctcccaggtgtatattagacacagctgggatgccatctatggtcctcattaccgtgttatgtgggttacggaagcagaatctttcttttctgaggaagcatggcatcgttttaaagaacatatttgtatcagactgtttgaggttccaccatttattgtaagtc

SEQ ID NO: 7872 - DNA, 753 bp, mus musculus
actctcatttttttttcttctatttcatacttctgagaggtaaccattgttacagtgattgttcatgattagaagctagtgatcagtaaccaaaatccagcacattctctttttgggcctcatatgtgtcaaacacgttaatagcactggagacgcagcaatgaatggaaaaaaaattcctgccattaccaagctttcattccatgaggagataaaaaatgtacctactggattgataagtaattgtattcatctgttctcatactcctataaagaactatctgagacctggtaatttataaagaaaagaggtttaattaactcacagttccacacactcaacaggaagcataactgtgaggcctcaggaaacttacagtcatggcagaaggtgaaggaaagcaagcaccttctttacatgatgagaaagagatagagagagagagatagaggagagagaagggggaagcactatacactttcaaataaccacatctcttgatacatcactattataataacagcaaaggggacatctgatgccatggtccaatcacctcccaccaggctccttcaacatgagatcacaattcgacatgacatttgggaggggacacagagctaaaccatatcagtaatataacaaattatgattaatgatttagagaaaaaaaagtcatgcaacttgtttattgaatagcagatatgattttgtctctctctgtgtctgtgtgtattgggggagaatttagg

SEQ ID NO: 7873 - DNA, 603 bp, mus musculus
taataagtgaagctattaagtgaagatgtataagtcaggaatatctggaatcaatgcatttatttttcttttccatagttactgcatatcctttcagtcatgggaataaagtaaatccatagcatttaaaatatatatttagttctgatcctcagcttctgttgctaatctataaaaatgggcgctttcaaccatgagactaaaacaccctggaacttactaagcattatttaataaactcttagccttttgcatttctttttgttttagtacgtatttttcacttttagtttatctgaaatctggcattcggatagccaaaaaaaaaaaaaaagcataattttcttccttttacattgaaaaacaaaacaactcaaatgcatttctattgttggttctgctacaataatgaaacaaaagtgttttaaaaataaaatagtatagcaggaaatgggctttataccagatgtgtctcacaaatttcagctttcccattctttagtcaaaggccttagataattacttttttgcaacatcataataatatctttattatattttacaataatttagcttgggatgtttgtcttttctgacatgtta

SEQ ID NO: 7874 - DNA, 873 bp, mus musculus
taaagcagaaaagaaaaatggtgcaacagttaagctttttaatgatgggcactaaagcaatgctgctgattagattctttgctaattaccttctgttacttagattggatgtatttcagcagaatagaaacatctattcataaatagttgttttcttggtagcaatatgaaaacatttgactctaaagttgaaaactacctctcaggattgtatcatccggtcctcagcttgctgacaaataaaatcacgtgccatctgaaacatggctagaatggcttgtattccactgggtggtatccgccttacataaggaagtgaaaggctgcagcagtaatatttatgctgagacttgaaaaccaaaaggtctgggtgaagagctttggagatggggaccagactggaaaagcaccgaggcaaagatgagctaagtctgtgaacaaaggagaaagtagtccaggatgaatttagagagttaggaagaagtgacatgggctttctaggccagcccaagatattagtgttttagtctaagggttattggaaagcctggagggcctaatcaaaaactaatatcatctaattaagtcttaagaaaatcacctgtatgcccaatgaacaatgggctgtgtgagttaaagatgaaaatagggatccatattacaaggctatagggaatgaattgtgacacctgtaccccctgccaaattgatatactgaagccctaaatggcaaggtcactatatttggagataagaccttaaagaagataactaaggttaaacaagggtaaaagtgtagaattctaatccaacaggaaaggtgtccatatgagaggaggaagacacaccagaagccaggaatatacacacaca

SEQ ID NO: 7875 - DNA, 966 bp, mus musculus
cttttttttatgtgttttgtttttgtctttctcaattattttaagctacctagggagtagaaaatgttaattatatcccccactctgaggttaggcaaactcaaagtagacactcaatgaacagttgttaaatttaaaattgaatattgatatacatagccaagcacagacataaccacttgtcaaatatatcttggaaattgattcagcgatggtgtggaaatttggaagatgttaccaaaccctaacatttttcttcagtgcaacatagaatcaccctcctgaatcctagcaccacagaatgtgtgagcaagaacatgctgaaatgtgtgttatgcaattcagccaactccaatgctgcccccagtacatttcccttttgccaattacagaactcatctgttctctttgccatgtagttattgagcttttcttggcctggcgtgccactcagggccagcccaggcattaagttgactgtctggccttcattagctgcatctaattcattccccagaaaacacccccaggccataaaatgcatctgtgtgttgtttttattaggtcatctgattgagcagatgctgatggctctaaaaaaggagtatttcccctgccaaccttaatttgttctgtttccattgcaggcaggacccatcaatagtgctatttctgtgttttcatgtactatttcagaccacatagttatttctgtattagaatatctaaagtgcagagctatttttgagagtcacctgatgactcttctttaacatgccactgattcagagattccataagcattttgctaacgtcctcagtcccatgtcatactacactgtctccactagacttttccaaacagggattgctgcccacatgttatcaatgtcaccaacgggccttctcccttaaaagattctccaactatgaaacaagttggcttaggatttctatagcaagcga

SEQ ID NO: 7876 - DNA, 1105 bp, mus musculus
taaacagaagattttgtcttctgggggtctttataaaacttcctttcctctatgtggtggctacagagagtccaaccacacttacggtaagacttcccattaagttagtataggaccaatactctttctcagacattggcagaagctagccatcaccccctataagatggtaggccctaagggctctgcatgtcctcatttttaaaccttggaaaaacagctaccttcctttgcaaagagaaattggcattagccacttctaagagactacagaccaacatatttagaatcttcctagttcttaggaagatgactcctaaatggtgtctggattcatttgttaaaagttcaaaattgtcccaacctgccaagttgttgggtgtaatgttttcatggcagcatttgtagaggaagagccaggcaggggtcaattttacacatccttagggattccaggcaaagctctcatttcctatactgtttcctgttctgagcatttatacctcatggtttatggtaatcagagttcctctggcagaagaacccaggaatactggacttaacgaatgcttaccttctttttctttccctccagtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgataca

SEQ ID NO: 7877 - DNA, 468 bp, mus musculus
ggttctccatcattacctgatgggaaatgtaacagagcattgtttttctcccttacatgtggcaggtgaccccagcatttcacctggacccagatattgttttatcacccttcgtagaacacattcttttgacaagcaggccatgtgggatcctcctccccacatccactcacttctttcatgttttcagtcaatagaaagttcaatttcaaatcctttgagaaatttattgggattcaatgaaatctatagtcttacagctgccaaataaaagagaaaataaaaatagatgtcttcttcttctaggcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacac

SEQ ID NO: 7878 - DNA, 333 bp, mus musculus
gcaggccatgtgggatcctcctccccacatccactcacttctttcatgttttcagtcaatagaaagttcaatttcaaatcctttgagaaatttattgggattcaatgaaatctatagtcttacagctgccaaataaaagagaaaataaaaatagatgtcttcttcttctaggcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacac

SEQ ID NO: 7879 - DNA, 265 bp, mus musculus
caatttcaaatcctttgagaaatttattgggattcaatgaaatctatagtcttacagctgccaaataaaagagaaaataaaaatagatgtcttcttcttctaggcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacac

SEQ ID NO: 7880 - DNA, 1601 bp, mus musculus
agaccttaatccattatttctcctgtaaatatttcagtaaccatcaatggtttcttgggatcttcccctacatcccttccctaacaggatccattgcctgcccgccttcttcgttactacctccaggcatgctgaacatcttggagcacactgtgcttttggatgtgatgttccttctgcatggaatcccacactctcctttcttattacagcaacctcactaaaggattgagtccagccatctgtcctctccctaaactgaaccccagtgtggattatatgttcctcatctggactcctttaattccccgttttcttattacaaaatcatatctaagcacaattttgatcaattataacagataaatatggagtgcttactatgtaccaggcattgtgctaagagacttatatgcattactcagtgaatcccagtgacagctttgtactgggtacactcttatccccacttcataaatgagcaagctgagctcaaagcagtcagtgagcttccccaaagcccgtagctcccacgtgataaactcatgcccagtcctgaaggcttactgaaaggaatggaaatgaagtggggatttggcctgcagttaatccaacctctctctgcttgcagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcagggtaaggctgccttccctcaatcctgagctttccaacccaccattggaatagtcgtctgtggccagaaagaagcaaaaggcccacaggcatctaagagagaaaacaccaatggcttgaagagccagtaaaaccacccaaatattgtacataatatgttattccagacttttaaaaaaaataatagacttatccatgttgagaatacttcttaggtttttccatttagttttagggagttatatcataaaactcatttaccatattatttagatatggggtctctctctgttgcccagactggcatgcagtagtgtgatcatagctcactgtaatctcaaactcctgggctcaagggatcctcctgctttagcctcctgagtagctgggactacaggttcatgccaccatgcctggctaatctgtattttatttcatttttttagagaaaaggtcttgctgtgttgcccaggttggcttcaaacctctgacctaagtgatcctccctcatcagcctcccaaagtgctgggactgcaggcctgagccactacgccaggctcaaactccatttt

SEQ ID NO: 7881 - DNA, 1173 bp, mus musculus
ggtttcttgggatcttcccctacatcccttccctaacaggatccattgcctgcccgccttcttcgttactacctccaggcatgctgaacatcttggagcacactgtgcttttggatgtgatgttccttctgcatggaatcccacactctcctttcttattacagcaacctcactaaaggattgagtccagccatctgtcctctccctaaactgaaccccagtgtggattatatgttcctcatctggactcctttaattccccgttttcttattacaaaatcatatctaagcacaattttgatcaattataacagataaatatggagtgcttactatgtaccaggcattgtgctaagagacttatatgcattactcagtgaatcccagtgacagctttgtactgggtacactcttatccccacttcataaatgagcaagctgagctcaaagcagtcagtgagcttccccaaagcccgtagctcccacgtgataaactcatgcccagtcctgaaggcttactgaaaggaatggaaatgaagtggggatttggcctgcagttaatccaacctctctctgcttgcagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcagggtaaggctgccttccctcaatcctgagctttccaacccaccattggaatagtcgtctgtggccagaaagaagcaaaaggcccacaggcatctaagagagaaaacaccaatggcttgaagagccagtaaaaccacccaaatattgtacataatatgttattccagacttttaaaaaaaataatagacttat

SEQ ID NO: 7882 - DNA, 554 bp, mus musculus
ctccaccaaatcttgagtttcatgacttctgctcagaaatctttctgttgtttcatacagcctcattttagcatctaacccgtcctctggggccttctttgtgctctttccaaacagtcggtttggctttctagaaacagcatctgatgtattattaaagtgcctgaatgtaaggatgaagttgttaaatgatgacgctgccttttccatctttctctctctcccacgtagccttttacatatcccaaagtgtctgtttacaaccaatattaagagtttcaagtcccctattccttgaataaagactaacataataccatcccaaagtgttattgagaaaagtgacagtcaccaggctttaactgcacatctgtggcctcccagataccactttgccagattacaaaggaaacagaaagacttgggatggcaaagtcaaagttcatcaaaatggaatggatctgtatctacaaattataatttcaccaattcttttattttctaggttgctgaggtcagatggctatggtatcccaagtaacttatttgttctc

SEQ ID NO: 7883 - DNA, 1558 bp, mus musculus
tttacttctctccgtgccctgccatggtgagaaccccaagcacatcagtcctgagacatcctctggcgcctcttgtctggccccacaagagccagcagggtggggagcagccattggatttgagtcatacctatgggctcctatttagaccctgggcacaggctccaagaagctgtccccctcccccacagccacctcagttcccccagttggaggcaagaccctctcctcgccccatcagcctccacaggagcttctgcccatggccaagaacagaccagcttggatcacgaaggactgagcacctggaatattctgtgcttctcccctgatgtctgaaggcgagtgcagcctcgggcctggcccacagtggctgatggtggaatgagtcagtgcccaagcaaaggtgagccagcccctgcaggaaggtcaagctctcctgcccaggtgaatccccctcatcccggatccctctgtgcctccccctgcctggggaccacacctcatgcttctcctggggttcatgagtgaactcccaatagctcttaaacacgaaacccatcttcattccactgtccttctgaaaggacaccttttgggaaaatgaacccaagtgtcccaaaagcatctgcctgagcaactatgaatgatggcctttcctcttcccacgtgtgtcctccaggagccccgtcttgccaagtccagaagaggctcatctgttctcatcgctagccactagatggcgacatcaggaattgtttaattttccaaagaaagttgcttgggaaaccacacagttctaaataaagcaaaaagcaatgaatgggaggaaggaggggaagtggaaaggcagggatttagaattccccatccctttacatggctatataacttgggcacgccctttaatctcccagaacctatgcacctgcaaaatggagctaagagaggtagctacctcctaaggtaatgctggaagacctgggagcatattaacctcctggggagctttacaaaatagtgaagtcagccaggtacagtggctcacgcctgtaatcccagcactttgggaggccaaggtgggtgggatcacttgaggtcaggagttcgagaccagcctggccagcatagtgagacccccgtctctactaaaaatacaaaaaattagcagggtgtggtggtgcacacctgtaagcccagctactcgggaggctgaggcaggagaatcgcttgaacctgggaggcagaggttgcagtgagccgagatcgtgccactgcactccagcctgggcgacagagcaagactctgtctcaaaaaaaataaaatagtgaagtccagcccccaccaggccaattaaatcagaatctctacatgtgccttccccagatactacttggatgtggggaggggagctggccaggcagttccagggcacagcctgaagtgaggatctctgctccagggcagcagttctcaagcttgggcatgcatcagaatcactggaatctcttagtaacacagattgctgggtcccacccccagatcttctgattcggc

SEQ ID NO: 7884 - DNA, 1571 bp, mus musculus
atcagtcctgagacatcctctggcgcctcttgtctggccccacaagagccagcagggtggggagcagccattggatttgagtcatacctatgggctcctatttagaccctgggcacaggctccaagaagctgtccccctcccccacagccacctcagttcccccagttggaggcaagaccctctcctcgccccatcagcctccacaggagcttctgcccatggccaagaacagaccagcttggatcacgaaggactgagcacctggaatattctgtgcttctcccctgatgtctgaaggcgagtgcagcctcgggcctggcccacagtggctgatggtggaatgagtcagtgcccaagcaaaggtgagccagcccctgcaggaaggtcaagctctcctgcccaggtgaatccccctcatcccggatccctctgtgcctccccctgcctggggaccacacctcatgcttctcctggggttcatgagtgaactcccaatagctcttaaacacgaaacccatcttcattccactgtccttctgaaaggacaccttttgggaaaatgaacccaagtgtcccaaaagcatctgcctgagcaactatgaatgatggcctttcctcttcccacgtgtgtcctccaggagccccgtcttgccaagtccagaagaggctcatctgttctcatcgctagccactagatggcgacatcaggaattgtttaattttccaaagaaagttgcttgggaaaccacacagttctaaataaagcaaaaagcaatgaatgggaggaaggaggggaagtggaaaggcagggatttagaattccccatccctttacatggctatataacttgggcacgccctttaatctcccagaacctatgcacctgcaaaatggagctaagagaggtagctacctcctaaggtaatgctggaagacctgggagcatattaacctcctggggagctttacaaaatagtgaagtcagccaggtacagtggctcacgcctgtaatcccagcactttgggaggccaaggtgggtgggatcacttgaggtcaggagttcgagaccagcctggccagcatagtgagacccccgtctctactaaaaatacaaaaaattagcagggtgtggtggtgcacacctgtaagcccagctactcgggaggctgaggcaggagaatcgcttgaacctgggaggcagaggttgcagtgagccgagatcgtgccactgcactccagcctgggcgacagagcaagactctgtctcaaaaaaaataaaatagtgaagtccagcccccaccaggccaattaaatcagaatctctacatgtgccttccccagatactacttggatgtggggaggggagctggccaggcagttccagggcacagcctgaagtgaggatctctgctccagggcagcagttctcaagcttgggcatgcatcagaatcactggaatctcttagtaacacagattgctgggtcccacccccagatcttctgattcggcaggtctggggtggtaccccaggatttgctgatgctgctggttgaggccacactttg

SEQ ID NO: 7885 - DNA, 1181 bp, mus musculus
ctacacgtacacacagacatacacgatattttatatgaactgccttccttggcatttgagtttgcccctcagcttacgctgtagttgtgtaacctagcatgaaggcctgtcatgataattttatgtattgtataataatatttgctttaatcattttcttttcagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttc

SEQ ID NO: 7886 - DNA, 957 bp, mus musculus
tgggagtgcaaagtgactcacagttttggtatctcctacgtaagagctttggggggattccttggcttgctgacaggcaaggaagacagcggcagcagtgaggtaaaacacgattacttccaactgccttgcggaggaggcgcagtcgtgcggtgtgacttggacagcttgctgctctctgatggcacgcggagggagaataattaaaaaggccagcatcacttactaagtgagtaaacacagagccgttccaatcgtgctctccagctaatgagaagctgtaatttcttatacttcaaggcaagatgagacagtgatgggttcagtggagggtgtgtttgcgtggatatgggggtggggggtagtggtggtggtagagttagatcgactaattgttggcaatgtttaagaaagggattactggaaaagacagtgaaatgatgacaggaaaacatcttggaccagagccaaaaaaaaaaaaaaaaaaaatcgaggcaaatcaagtctgcagctcggagaaaacacccgtcgctccggtgggaagctccgacgggaattgctcgatgttccttagccaaggacggaatatcgtgtgagcacaaggggacagaattagggaccaccagagtccagaggaaagagctacggtatgccagggtatacagtgatgtcatacattgagaaaaaaaatgaaaaccccaaaaccagaacagatcaaaccaaaacaataaaaaccaacctgtgtcctttcctttttatgggaggcttctgcttcagtttattaaaagcaaccctcaaatgtaccttctgatagcaggagctgctgattctctgtttgtctgcagaagctgctgcagggttactgaaagacgctggaaaaaggaggttgaggaaattaagttttccattggttgggtttctggcaaacgtgccaggcgatcgtctgccatttggaca

SEQ ID NO: 7887 - DNA, 1057 bp, mus musculus
gagctccaatttaacgccatcattatttctgacattaaaggcccgagaatagtgtcacatgcccagaagctatttttttttttttaaaccagctaatcccagaaataagaaactgccatgagggacagtgagtcagggcctgtaaaagtgctttaggagaggactgtggcaatagactgacctgagcgtgggaggcacagcctgcacaaggcccttagccaccttgggcggacaggcccagcttgtgcagtgactgtccagtgagtcattaagaccctaggttttggccagacgcggtggctcatgcctgtaattccagcactttgggaggccaaggcatgcagatgagttcaagactagcctggccaacatggtgaaaccccgtgtctactaaaaattagccagccatggtgatggacacctgtaatcccagctactcaggaggctcaggcagaactgcttgaacccaggaggcagaggttgcagtgagccaaggtcatgccactgcactccagtctggttgacagagtaaaactctgtctcaaaaaaaaaaaataagtctaggctttgtgttagattctaagtttgaggcttagctgtgctgcttgtgccaaaaccttatgactttagggaattttacttaagttcctcatgccttggtttggctcatctgtaaaatggaacccataatagtacctactaccaggtggaggcaaaattaaataggatgcagaacacagactctaacatatcaaagagaagaaaggaacctacaggatgatggacagggagggacatctggaagcaacagctgggctccaggcttagagatcaaccagtgccaaggggggcagatcagaaggctctagaagaactttcataagaagacaaaattagtagaatgcccaatatatctggatacattgagagatgatgcacacaaccggggaagacttcaggtatatgtcaatgacagaagactaagaaaagcaaaaacagaaccactgaaaacagagtcatttgggaaaagaagagtaaacagaatatactacatggc

SEQ ID NO: 7888 - DNA, 1295 bp, mus musculus
aaaaaaatgtaacatattcaacttttaaaaaaattgaattaaagttgtatctttcttggagtctatatttgaccatgaattgtgtttccaaaattatatttgctcatccattttttttgccgttctctgtaaggcctcagttttgtttggtctttaaaccctgaataaaacacctaggaacatgtttccatttgcagtatttcccttttaggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatggtaagtgtggcatggaagactgtaagaggaaaatttattcaatgtggattaaatgtctggcagttcttttctatgcagctatttgaaacaaaaaaaattcaatttctgaattgctttggcaaagtatctgttgaatgtaaagaatgagtacaagatcctggtgatgagacagcatcatatattcaaagatggagcgcatcatatttcattacttaaatatttgactcatttatgaaaaactagtgtttgttgatggtaaatccattaatagtcacctttatgtattataaagtgttagttgctcaatctgcttttttctacctagtgttgatgctcttaaataatatggctgtcagcaacctgccccatggggcaattctttattttaaaatcatttaaagcattacttttttttttatttgagactgagtcttactctgtcactctgtcacccaggctggagtgcagtggcgcaatctcggctcactgcaacctccacctcccaggttcaagcgattctcctgcctccgcctcccgagtagctgggcttacaggagcccaccactatgcccagctaattgttgtatttttagtagagatagtgtttcaccatgttgcccaggctggtctcaagttcccgacctcaagtaatccacccacctgagcctcccaaagtgctgggattacagacgtgagtccccatgcccggccctgttactattgtatttgttgaagatattcaacaatgcaaggatatttaagatgcattgttttttatttgagtttttcagacatagtttttccagaaatataaacaatataccattaaatatcgatgcattac

SEQ ID NO: 7889 - DNA, 1295 bp, mus musculus; identical to SEQ ID NO: 7888
